United States Patent 9,271,455 (SOYBEAN POLYMORPHISMS AND METHODS OF GENOTYPING) - sequence listing, part 2

SEQ ID NO: 4339 - DNA, 742 bp, Glycine max
  misc_feature (640)..(641): n is a, c, g, or t
  misc_feature (708)..(710): n is a, c, g, or t
gattttcgccaaacgacgtcgtttcatggctccctgtgcggctgcggcggagtttccggtgggtctccgggttcttgtggtcgacgacgacgccaccacgttgaagattatcgagcaaatgtccattcgctgccgttaccgcggttagttacttttttttccaactcgtatacgaaagtcactttgagaaaataatcactttttttttctagttcactggcttaccacttttgaaaaataatccgttttttttttcgaaaaaaaaaaaatttgaatttggttttggggaaacggacttaatggcccttaaaacaagaacattttgggttttgtaggggcctggaccctggagggacctggccccatcctttcggaatttcccaatttggatttgaattggaaaaaggaaaaaaattaatctttttaattaaccctttaaaattttcggttaaaagtttaaggtatttcttttctaaatctttaaaaaatttggacccttggaaaaaagggaggcctaagaaaaattggatggattttctggttttcacagttgtttgggcaaaggggttggggcctttaaactttcccttttcaatttccaaaagggtccgcccggttgttataaatttttttcgggaannagtgaagggaatttttccctttcggggaacccccccggttgaaaactcgaagaaaaaaaattgaaannnaccgggggaaaagaattgggaatttttttttg

SEQ ID NO: 4340 - DNA, 828 bp, Glycine max
aactgatcattcctacaagcttgaagaattcctcaatcgcttggaggaagaacgcctcaagattgatgctttcaagcgcgagcttcctctctgcatgcaacttctcaccaatggtacacaattgaattcacccttttataaacatgcacaccaaactaaattcaaaattcgatccccccaataaactaatcaaacatacagaatccaaaaccttaaagattcaagctacccagtctaaaataaatattgatatatagataaatagatataattaacactaacgaactcgatcagttttttctaataaagtctagtaattatatatgaccaacctttattatcatcttcttctattccggtatctttttggtaatttctcttcttttttcatatatatttgcctactttaattgatttatttgaatgttatttaggtagtgatattaatcattaagggtaaaaataacaggcaatcatatgcatatttttatttcaatagtattcttttgtgcacaccaagcaatctagttaattagccacacaaatgtctttggttggaacagccatggaagcttcaaggcagcaacttcaggcctttaaagtaaaccatggagcaaagccagttctggaagaattcatacccatgaagcacttagcctcagagagctcagagaaggcaacaaacatgtctgacaaggcaaattggatgacatcagcacaactatggagccaagcatcaagcgaaggaaccaaacaacaaccaccaatcacaacccttaaagaatctgatataggcttcagcataagcccaaagttggctcttgacaa

SEQ ID NO: 4341 - DNA, 375 bp, Glycine max
gagagcttcagcagcctcgtcaatttaaacaaccaagcattggggtttgggtttgggaacaataatagcaacatcagcatcctcgatgcgacgtcgtttcggtttggtgttagtgttactaatccgcacgggaatgatcaggtgcttgcggcaccaggtggaggccatggtcagtggcaacaacaacagcagaatcatcatgagttcggtacggcgtcgtttcttgatcacaccgtgccgcttgagttttcttcgctgcagcataaagctgggcatcagggagggtttggaccgttggattggcaacccggtggggatcaaggtttgtttgatcttcctaacactgttgatcaaccttactggacacaccacact

SEQ ID NO: 4342 - DNA, 370 bp, Glycine max
agtcgactgtgagtcatcaacaccggtcacacgaagggaggggggtccccctggcctatgtgcaagagcctggataagtaaatgccactgtgtgccctgcgcaatttgaaaatcaattatatgaatccttgactcatttgccattgtttcttggatgacagcatttgcagatatgtatgcaaacttccagtatgggcaaatctggtacaaaatgtgcatgtaactcattagctctttgcttgttggttgttcacacttaagggatttgtagatgagattccctgatgattccaaccttgctctaagcccctctaacaagtaagcacccaacctctggattggatcaccagagactgataccaatttccca

SEQ ID NO: 4343 - DNA, 368 bp, Glycine max
agtagtgataccgaaaccccatcaagaaagagggttctaagtggtggtgattttaagtgcaagacttgtaacaggaaattccaatcgtttcaagcacttggggggcaccgagccagccacaagaagctaaagctcatggcttcaaacctttcgtgttcgaccgtgacacaaaagatgcaccagtgccccatttgtggaattgaatttgggattggacaagcactgggagggcacatgagaaaacatagagcttccttaaacgatggtttgataactcatgatcatgttgtgccaacatctagtggtactaaaaggcttcgtttgtgcttggacttgaacttggcaccgtacgagaatgatctcaacct

SEQ ID NO: 4344 - DNA, 400 bp, Glycine max
ctacactgctgcagatgctgagaacaacaacaacaacaacaatgcagggtcaagtgacatggccattgcagcagaacaatctgagtcttctggttacaattttcagctgcaaaggcaattaggtgaggaccatgataaccaccattcggctttcattccctcacctattgacactgatgcaatagccttctttccaacaaccactgcaacctcctccatcaatttccaaacctaccctcctgatataatctcaagaaccaacaactccactgaggatcttggcctttcccttcactccttccaagaccctggtttgattcatggccagacccaagcaggtgcaaaccagacacaaacaccttccaatgaccaaagcctcttctctggctcaactcaagtg

SEQ ID NO: 4345 - DNA, 347 bp, Glycine max
ccagaacaaaggtgaaaatcgccttcataaccaacgatgctgcgaggagggcagcatacaggaaaaggaagaagggaattctgaagaagatggaggaactcagcaccctttgtggaattgaagcatgtgctatagcatatagcccctatgatcccgagccagtgatttggccatccgaattgggtgtccatcatgtgctgggaaaattcaggaccatgtctgaatgggagaagaacaagaagatggcgaaccaggagagcttcctagggcatatgatcgcgaagcacaaggagcagctgaagaaactcgtgaaggaaaacaaggagaaggagatgaccgtgttcata

SEQ ID NO: 4346 - DNA, 270 bp, Glycine max
catttattgctaacatcatcatctttccgtccataaaataaaacacacacactgggcctcactctcaaggtacttccccactgttcccattttatgcccgtactagtctgacccttttagtggcatagattgaggtacaattacaaaagcatattacccgtatcgtatcctttctgctacaaccaccccgaaacacactgcgttttttttgtgtcaaacttcaaccggggctttcttacttctcttctcttcaactttttagtgtttttt

SEQ ID NO: 4347 - DNA, 820 bp, Glycine max
  misc_feature (806)..(808): n is a, c, g, or t
  misc_feature (815)..(817): n is a, c, g, or t
gattagtgcatcagctggtcatagatggaccacactctctgggagtggcatgaatgagattggagtcagagtcactgtgcataagagctcagaccctggccaacctaatggtgtggtgctaagtgcagccaccaccatttggctccccatccctccacaaactgtgttcaatttctttaaggatgaaaagaaaaggcctcaggttgtgacatgtttaactcaattgtcttatctgatgttgtcaccttagatacgtttttaacattgtttttcgtttggcttagtgggatgttctttccaatggcaatgctgtgcaagaggttgctcatatagcaaatggtccacaccctggtaactgcatatctgtgcttcgagtgagtcatgctttctctcaatgctctaatcaaattttggttttacatatgttgtcaattcctaaaaacataacattttttttaatttagtcccaattaaaatgttatttgtttttagtcccaattaaaatgcattattttctggtatttgttttggatatgcattgtcggtatttacactgtcaactattaagaaattacttttggtacgagttttaatgcaattatttaaaagtaaataaatttactaaatgacaatttgcgattgaatgacaatatgctgttagtgtatatattatttattctctaatttaagccttaaactgtctccctttgttttgttttcaatgcaatcaatttcaccttacaatctataccttgttgtacgcttaatttcttcataggcattcaactcaagtcaaaacaacatgnnntcctccnnnaga

SEQ ID NO: 4348 - DNA, 748 bp, Glycine max
caccacccagttttatgggtttgactgtaccttaaacccaacacagaacgagatggtgtcagtgtcagtccccaacatgagaaaaccacggttcccaactcaaaccgcaaaaggttcaccgaaaaatcaaaactttgaaacaaaaacctcacatggtaagaggtctccagctcatgctcaagatcacatcatggctgaaagaaaacgaagagagaaactcagccagagcttcattgcccttgcagctcttgttcctggcctaaagaaggtaaataagtcaaatatcatcatactactactatttactgggattcaacctgggtcgctttgattcgtgcttaaaaaaaatatatcatactgctatgctcgctcctaaatcaattacccctaaatcaattattataatgttaacaagtgcataacttcattcaaacaaatgttcatatgtttaatccaagaattgattctaaaaattgattgacttaaaactagtttttaagtagccttaacattggattcaatgattttagactaaactttactattaacttaaaaaaaaatctaattcaatttaatccagacacattaccacttgcctaaaagacaaataacttatcatgtggaaaatctgttaattcacacagatggacaaggcttctgtgttaggggacgctatcaaatatgtgaaagagcttaaagagaggttaacagtgcttaaagagcagagcaaaaaatcaagggcagagtc

SEQ ID NO: 4349 - DNA, 381 bp, Glycine max
ggctctagtcacctcaacagcctttgaatgcctcaccatttcatcttcaacgcgcctttggtgtgctgctagttccatttttttttcagcaagagggtctcttgcatccaagccttgtccattaccaggccctgactcaggaggggtaatacctaccatagaataggagctgtaaaacttcctttctatgcttctcagagatgaagattttttctcaaattccttggaagaattctcagttctcctcttaatcttgagctcttcagattgcttgacagatatcacatggacaacattgatgaagcttttgattgcttcggaagcaactgtgtccggaacacggtcaagggctagtttccattcatcacagaaagaaagcac

SEQ ID NO: 4350 - DNA, 714 bp, Glycine max
gagaaacaagtcaatcagtttgaatatggaacagcagggtgtgtacttcatttctctttagtcttgttaccttttaaatacgtaaattatgatcattcgtcatgcatgcacatataatacatacggaaattgtgcaagcatgcatttgtacgtacaattttgtagcaatgaagtaggagtttaggatttcatacaaattactcaaatttcttactacttgactgacctaatagattttataatgcagtaatttatcaattagtacatgcacatccaggtgatcatagatacaagttgatctttataattaagaatgatatataaattttattaatattatactgaactcacaatttatttattaaagtttatataattttagtactatatatatatatatatcattttggattcctccattatgaaatgaaaagactagcaatacagcctaactatgcttgatttaaaaatatagatatatttttttgtcgcagttcgtttcggcttcagcaagagcaaactactgcttccaaaggaaaagaaatagagacgatcgaggactggttgaggccaaagcagtcataatattaatatattgcaactttgaatgttcatagagttaaaatatattgttcgtggtcgtgtgtgtatccatcaaatatatagttccaagcctcaaaattctagctatatagtacgttaagcgtccattga

SEQ ID NO: 4351 - DNA, 388 bp, Glycine max
tgagttctctgagtccgatttttcatttaatttagcatcatatgtgtagcagccgcctttgtattttcttttcttttctttttatcaccccatgttattggtgtgcctctgttaaagattcaacctgactagtcactttagtggatctcttctcagttatatattttttcatccacttgcaatccaatttcacttccacttgttaatagcaacctttgcattctaaattatatgcaaatgtaaattttatctgataactagttagagttgttgagaaataatttgtatgcatttctcatgccgatctttgagattttttttctgataaacttttaaatttaatttgtttcaaacgaatatcacgggtcattggcatctaggacattaa

SEQ ID NO: 4352 - DNA, 272 bp, Glycine max
ctttcctatttacccttctgagttttaagtatttatatcaactatttatggtcatgttctccttaagtaacttccgagtcctttttttttatttttttcttttatcataaccttcttctggagctctgtggaagttactatggacacaagcaggtctgagggaaaaagggtcatgaggtacaaagaagaagatgatgataatgatgatgaagaagaagaagaggtggtgagtgagatgggttttgaagaagatggaaggaggaataagaaaa

SEQ ID NO: 4353 - DNA, 314 bp, Glycine max
actgcaagagcatgtgacggctgcataacgaaacgtgcacgttggtactgtgctgccgatgatgcttttctctgccaggcttgtgactcttctgttcacttggcgaatcctttggctcgaagacacgaacgagtccgcttgaaaaccgcgtcctacaagtccaccgatgaacgacgacaacctcccacgtggcacactaagaaacctcgaacgcccagacatgggaaacattctcgtaacaacaaccctttccacttggtccctgaagagggttccgaagaggcgaattcccatgatgagaatgaggagcagct

SEQ ID NO: 4354 - DNA, 734 bp, Glycine max
cttgtttgatctttcgagatggccaacgggatatcccatgctgcctgcagatgcgcttcattgtggtagggcaaactgtacagcaaaaatatatctaagaacagcatgtttgaaacactacttactttcctttttctgtttagataaaagagctgctactactagggggaaagaaaaacatttttgctttttgcatattttagttgcatagtatattttttaataattaaaaaaatctccagataccagcagattcatagagataaaatttattgtggtagagaaaacatttgtattcatggaaaaaataaatattattcttaggtaaatatttgtttccacatagcagcatgttcataaagataacaaacaaaactattgcttataaatatattttagagtatgaacataccaccaaggctctttgcagcatcttttagactcccagcaaaataacgttgcaagacttcaagactgattgatttctcagtttttccacgtttcctctctaagggtttctttatgtttttagtctctatggagggcatatgatcaattccgtctgcatttttaccaagactccttccatcattcatgtcgttacagtacatcaatatttgttgttctgatggatcctgtggcacttcctcccccatgtttggtgaggtatcaagtctaggtggtgatttaatagatggtgtaattggaatagattcatgcctcgtatgaactct

SEQ ID NO: 4355 - DNA, 379 bp, Glycine max
tacacacacaagaaacggatttcacacaattgaggatcagagaaacaaagacaaccacaacaataacaataacaacggtgatgactgctcaagtgcatcttcaattactgtttccaatgaggaaagtgggaaaagcacgtctcaagaatcgattatggtgcccaacagcaacggtttcatccaccaggttccatgcatttccactctcccttggccttatccttttccctcagcagcacctgctatgtgccctccagggtttcccatgtcattctaccctgcagcattttggaacattccatggtttccctcacaacactcacaccattctgctcctactccaaggtctcccagttccggtcctaattctccgacacta

SEQ ID NO: 4356 - DNA, 1166 bp, Glycine max
ctgtgctgtttgcatgctgtcacagcagtaccacctcctggtatgatgcagttttttctcctcactatataattgtgtaggttatttgaaagttcaatttctacctgtgatttcaaatcaactgatcatgaggcagataaatcagaaacactcgtgtgtgacaggcacagaaatggcccagttagtatgtggaggttgccatactttactcatgtacatccggggcgcgacaagtgtgcaatgttcttgttgtcacactgtcaatctagctttggaaggtattgtactattaattgtctctctgaggtttaaggaattgtgttgtgtgtgtgcgcacgcgtgcgtgcatgatggacagactttaagacatgtctcttgtgagctaagtgattgtgatttcaagtccctattttgggggtaagcaataagcatcaggtgtgtatttgtgacagcaaatcaggtggcacatgtcaactgtggcaactgcaggatgctactcgcgtaccaatatggagcaagatccgtgaaatgtgcagtttgcaattttgtaacatcagttggggtcagtgtaatctcttgtccctcacttactagattttctttaaactgtctctagtcccaatcatattgagaaggttcctgcaggtgtatgtgtgtgtgccagaagagcatttctctctattcattttggaagagtagaaatagacttgtgtcctgtctggataaatttctccgtaatcacttataggaagagaaaaaaaataagaaagtaaaatgaattgaccttcttccataagttaaaatcaagttatgcacttcattttcataaaagctctttatgtttgacttgaagttaaggtgcataagttgattttaacttatgaagaagttcaatgtatttcatcttcatataagtatttatgaacaagtttatcccatcaaaactttttaattggtagcaaataagatcaacttttttttaatttaattaataaatagaaggaatgaacatagaaggaatttctccaatttgagaagtgtttttaagggtgagcaaaaattagaactacagaattttcgtgatataagcaatgatttacactggtgttactaaatgatgcaggccacagcaagcaccactgagcagaagttcagcacttaaaaca

SEQ ID NO: 4357 - DNA, 448 bp, Glycine max
cctttactttaatttgcttattttccaggagctgaaaaaaatgggagaaagtgctttgttctctgtgtagagtttggcagagaaagataacaacattttttagtcctttataatgccagttccacttgccccatacccaacaccaccagctccatatacaccaccagctaatggtatcatatctgcctttctctcttctctattgattgccaagaaatcttgccatcatctcattgctttacggctccaaaggggtctagcttagttggttgagcatgatgtgtgagttgttgcaaatcccttggtgtctatctttgattcttaagaatcaaaaagaatctcattgctttgtggtgatgaaatggttggagatttgaattcttggttctttttcatcatttggacaaaattctaaaactgaatgcaaagctgacatgactaaaaacaa

SEQ ID NO: 4358 - DNA, 384 bp, Glycine max
ttctggtcaatcaaccatgccaaatcattcaaatcaaccatgcttatattgtgcataatcttacctgcactaaggtactgaaacatgagctgagtcatctccttttccctattatccttcctttgtttcttcaactggtctttggccttcatgattctctgcctcagaaaactctcttggttcaccatcttcttgctttgctccaattcaggcattctcctgaacttagcaagcaccctttgaacccccatcggggatggccaaacctcgggttgaggatcatagggactgtaaacaattgcacatgcatcaatcccacaaagggtgctaagttcactaaccttcttcattagacccttcttcctcttcttgaatgttgcctta

SEQ ID NO: 4359 - DNA, 685 bp, Glycine max
ctccgcgaccaaaacggaagccaattcatccttaccctcgtaagctagttgagtttccaaagacaggaatttccaactcagaacacccactgaggtctaattctctgaagtcatcagattttggtcaagaaaacaattctcccaagtcagttttatctacagttgtttcagaaactgttggttcctccgattcagatacatctagtcgatgtttgtcaccagcctcatccattagtggtgtccccacaaacagatttccacttgctgagcccaaaacatcatttaaggaagaagggtctgcaccaagttcagctcatgatgagcaacctcctgtggtacttcttaaatgctaatcaattttactttcttgactacaatatcatcatgagaatacttttaaaaaatgataaatatttcatgttcttatgtttgatcttaaaatctaatttaaatacactgtacattgttatctaatcataaactgacaggtatgctaagatcgttaatttttgtaataactacttcaacaatgatacttgggatgatttctaattagttgatattgcagtacaaatctttacatagataatacatgaaaattaaactctcccttgattttaatgtgtagaaactggagttttttcacaaagaaagtgtttctaccagagatgatgcaacagaagaa

SEQ ID NO: 4360 - DNA, 334 bp, Glycine max
gttgttggccagtgaattcgggtttgaggcagcctgctcctagggtggtggcggagctggctaatggtgtgagacaggatttgaggctgagcaatagctatgaacctcaaagacaggtgcaaatgcaaattgactttagcggaggcactagcaggccttctgatgtggaggcctcttgcaaggaggagcaaccgagtgttgccgatgaaaggaagcccaggaagcggggaaggaagcccgccaatggaagggaagagcccctcaatcatgtggaggccgagaggcaaaggcgcgagaagctcaaccagcgcttctatgcgttgagatctgtggt

SEQ ID NO: 4361 - DNA, 403 bp, Glycine max
tccgttgaagaaccagaagattcagttccggcgccgcggtcctccggtggagtccgattcggaggagcgagacgcgtcgtcgccggcgtcgagcgacagttttccgccggagagtttcgagaggaagaggccgcggttgatgagttctaacaccacgaaaggaagcggagaaagacggaaggcgaagggttggggaagcgcggtgagggaactgactcaggcgattctgaaattcggcgaggcgtatgaacaagcggagagttcgaagctgcagcaggtggtggagatggagaagcagaggatgaaattcgcaaaggatttggagttgcagagaatgcagtttttcatgaagacccaggtagagatttcgcagctcaaacttggaagaaaaggtggtaaccct

SEQ ID NO: 4362 - DNA, 372 bp, Glycine max
agtttttctagcgtaccatgatcatcagtgtgaacatcagaatagcattcctcgtaagaggcagtattgttgactaggtcatggtcttcaccaaagaatatttcaatcccaccattgtctgcatcgtcacctaccccccaaaccatgttcacctcttttacttctgcttctgggctttgaactttctcttcgctagttgatgcagttgctgaattggaattaagggttaaggtgctatccgttctgggtatacatgatgataaagccttaacccttatgggttttggtagataaactaaagtcttctctgaccctttgttattctcattcttttgcttattcttctttttacccttcttcttctctggtgca

SEQ ID NO: 4363 - DNA, 1098 bp, Glycine max
tgttcttgagatatccaacttaatctctgagctgttctcacttctattgctgctggatccctcagtttctttgttgaggttgatggattcagttggttctctgcttttcagtgccaatatctgtagcagtgtgtgacagcagtgaaatttttagctattccaaaaaataatactacatgcaggaaaagttggagtattatcaagtgtgtaatatcagcctaaaacaaaggtgtcaatgtcaaaaatgaaccaaatgattgtttatttttccaaaccaaggaaactatatgcattgcatgacaaacatgtaattgagtggaacttggtcttcatgaagttactgaggatgattggaaaaagcagctttatagaaagttatcatatcagttccagaagttggtgaaaggaaataaaaggctctgagactgagagccataataaatattttttttggaaaagcataataattaaagaaaagcatcgtgattacctagctttattgtacagaattaaaacaatctgacatatagcagaacttgaacatccgatccctctattccatcgtcaatttaggactaatttaatttgaatcaatttctcaacaaacacttatgagaaagatataaaaggattttcatgaggtaaaatacatcaatattctcttataagttaacttacgtacctcaatggaaaagttaactaagaaagtttcttaaaaaattgaggtgtattttaacttatggaaagagtttgatttgcttacctttctaattaattttattttcttttttgttaataaactcatctgaatttggccttaattagtaatttaagaaaaattggtcttcttttttaaagttttcttctcacatgtgaaaccaaaatcttacatagaagttggaagaaaattagaaacctcagtctgaagtttttggttctgaaattgaagtgcatcattatctgctttgatagcttcatattgtcttttgagaagatcatagtccttctccaactgcttggtcttccacctagcccttctgttctggaaccatatagcaatctgtctaggttgcaatccaagagcccttgcaagctgca

SEQ ID NO: 4364 - DNA, 404 bp, Glycine max
tttttcctggggcttcttcctcaaccattcccaacgttgtgcttcagccacaaccactgccagtgcccccccagatgttccctcccactccaaatatgatgatgctgcctccgccacccatgtttcagaactacatgcttcctgatgggagcatgatgaacccccatgggtttaatgacatgggaatgggaggatttggaggaccagggccttctggttctggtgctggtgctggtgctggtggtttcttttgatcctcccggctggatcttgatgcccttctgtttttaattaagagttcgcgcgagttgttgttttaatttcagtgttgttccgggttaattagctagtttcatgtacgtgacaacatgcatgcttagcactgattgattagctagggttcg

SEQ ID NO: 4365 - DNA, 598 bp, Glycine max
  misc_feature (119)..(121): n is a, c, g, or t
tccctgagagaggtgcatatgtttagtgctcaactgtacctcaaacacgtttgcctgtgaaggatgatatatacaggaaataaaaaaaaattgccctgggtgtctagatgttagttttnnnctgcacccactttttatgagttatggcaagtaatcaccctgattttactttttgatggagctagtaatcatggaatgaacatgcaacaagttgatgcttgctatggttacattcccacaatggctcaagaaagtactaattctacctcctcatatccaaggcaattcaattgcttgcaaaacatccctcaaagccaacccatatttgaagatttaaagccacttgattataagaatgagatggtagattttagttatcaagttgatgtgccactagattcaactaatcaacttggtgtgtatgcggactggactaataatcaattcggtgactttgaggactggattaatcgacctattgatgggtctaatcaaccagttaatggtgatcttgtgggtttggacaataaacctaatgaatctatcttgcaaaatattcctgttcaatatcagaataagcaacaaggaggagctttga

SEQ ID NO: 4366 - DNA, 715 bp, Glycine max
cttctataagacagaagccgtgtcagtctgcaaaagtaaaaaataaataaaaaattaccacacactacagtcatattcccagtcatctcttctcttctatgtaatgctaaacagagagcatattgttttcttttctctaaaaaaactgtgagaaagaaagagggcatgcatgggaaagatgaatcatatcaagaaaaagtatcgttttcttcaagattgttatctattattattttatttggaactaggggactaacgaggttaattggatatgcaaacttttataggttttctatgaagatatatatttgatacttcagttttttattccaattttggatataaattaagtttatgtaaatgttcaattgaataattaaattaggtttaaacctttccgaatggggaaacgagttgatgaagggcggtaattctgtcacctaatttctccttcctaacctgaaacggacaagcacatgcttaattaatatgttggcttatgtttaattttcatatcaagataaaatgaagaaaataaaaattaagaaaacatgtgtaggaacaagacaagcaagaaaaacaacagtgaccacccacacacatgtgatgtttgtgtgcggttatgtgtgttggtttgcctgaaaaaagtgttcgaggttggaagtttctgtctaattgtttgcaatcgatgaaaataccttgaaggtcgattgag

SEQ ID NO: 4367 - DNA, 366 bp, Glycine max
gcctgcactcggcgtcggcgtcggcgtcattcctctcctcgcagccacgccgtgcctcgaatccgacaacaacatcctcggaagtaggacacgtggcggcgggggaattcagctatggcaagaccaacaacaacaccatcaaagccactacatgaagaagcagctgcagcagggtcttctcgaccataatagtaacaccagttcggggaatttgattcagaacagtggcgaggtaactgcttctggaactagtagcggcggaacaacgtgccaagattgtggaaaccaggcaaagaaagattgtaccaacagaaggtgtagaacctgttgcaaaagccgaggctttgattgccctacacatgttaa

SEQ ID NO: 4368 - DNA, 394 bp, Glycine max
gggggatcaattcaagttctgattcctttgtgagtgccttacacaagtttaggtttggtttggcatcataaaagggacataaagcaaaaaatagttttgtggggagcaactgttggttatggattgggatgggaaagagtttgcttgggatccacgtgggttggagctgctggccaatggtgaaggccagaagagtgaagcagcttcagtggatttgaggcttggtggggaaaaaatagccccagatgttgctaaagacacaaaagaatcgaaaaccgtgtcatcgccatctggttcgtcgaaaagatcccgccttcagaatggatcacagaacatgtgttgttctgttgatggatgcaattctgacctcagtgattgcagagattatcacagg

SEQ ID NO: 4369 - DNA, 373 bp, Glycine max
cacaagaagtgcaaagctgggagtgcaaggaatcaacaacccattaggaataagtgcaaagcttcattaaaagctggaagaggaaaatcacaacaggggtctgactctggatcctaacaggaattatcatcatcatcatcttctgcatcaacaacctcatcatcaaaatctgattctaaattcaagaaggcatgtaacaaaccaagaagaccaagaatctcatcctcaccaattccatatccaattccaacaacaaagggaacaacaatcctacacagctttagacacggaactcttaaacccactccaaccaccaaagaaacggtcttgccgcccgcctcttccgccgccaccaccttcctcgcttacttta

SEQ ID NO: 4370 - DNA, 1309 bp, Glycine max
tctaatttgtcagagaaggttggtaatttctgttgatgactgtttcttgtacttgggtttggttttattcatgcttaattatgtgattttccttgtgggttttgctctggtctgggacatgttgagcagcggagaaggggtaggatcaacgagaaaatgaaggctttgcaaaacctaattccaaattctaacaaggtacacaagtttcttcaagtgacttcaaccttagctttaacgggaggattttgtagttattagtaattagttagtcttggtgtaatgagttgttgtatgcgtgtggcagacagataaggcttcaatgctcgatgaagctattgaataccttaaacagcttcagctacaagtacaggtctgtatctcttgtatatgctgcatttttgtcctatttgtaaggctgaaagcttcattttcttctgtattcctaacttcaattggaaattaaatgaaattgttattttgcgaattttgatgttgcagttgttgttgtccgtcttgtctgctattcttttgatgtgaacagtaatatgtatgggaaactgcaaaatataggaaaatatgagaaaatcctagctggaactgttgtcttgacgccaaataaatggttttttacttgaatgcataaactgctatcatttatgctgaagcttgcaacaaagtcttactaacatttgatttgaaatgccattgtttttctttgctgctatgataatccagtgaattcactagtagtttcttgttatttctatttgcatatatatatgtaacaggtgctgttggaattgacatgtatattgaattttggtgaagattcctttaacaaatgataacaagtggaaagattaaatttttctctggccagtcaagataatacgattattaattgtttcctattacagaaaatgagcctgatcatattgttgattaggtatgtatcaagtttacagaaaaaatgggagaccttagttgctcgcagtgaaaaaaaaccttccctctaaattaattagtattacaaacttattctcagtttcagaattaacctgaactcgaagcttatgataattaaaatgtgttactttgaaaatgggttttgttctgatagaattgacttttgaaggtagactagtcctgaacttaacctttatgaaaatatttcagatgctgtcaatgagaaatgggttgagtttgcatcctatgtgctttcctgaaggcttgcagcctctgcagttgtctcagatgggtatggaattaagtgaaagaaacaggtttacctctttaaacatgtcagcta

SEQ ID NO: 4371 - DNA, 362 bp, Glycine max
gaattgttcattggacttcctgatacaagagcaagacacatctctcatcacgtctagtagaagattacttattccctggctatggaaaataaaataagggtaagcctaactgtatcatcaatgtatatgtatcctgatgctctagtaaagataataatagaataattttaaatcctcttacagtatcttcctaataatccttctaattattaatgaaatgaagaaaatattaaattttttctctgttttccaagtgttaaatgtttttacattttcatctaatattttctttatgaagtataagaaaattattgggaggatgttataggaggatataaattattctaaatagtagtggtaat

SEQ ID NO: 4372 - DNA, 292 bp, Glycine max
tgaggaggagttcctgagaaacatcctcagtgaaccttctgagagtgagatggtaaccgttgggtcagccaaaaggcctccgaggacatacattttgtcttttgataactccaccataataccagctactcctgaacccacttccagaaaacgcacacgccaaccacaaaatctcaacttagaaccaattaaaccaaaccccaacacccagcctggaaagaggggtagaagctgttcccagactctggatcacattatggccgaaagaaaaaggagacaggaactcacccag

SEQ ID NO: 4373 - DNA, 407 bp, Glycine max
gggattttccggccgccgggagagcagggtcatggcggagaagacggtggtagtgggtcagagttttcggagcttccaccttcgacgtggtcagataccagtggctatcctcctccaccacctggttgacatggaatacacattttttttctttattctattttttctctttctttggttaaagaaagaacaaggctttcttctgtttatttattttaatttatccgtttttgcttttttagattatttggagtccagttcactgaatttttatgtggttttgggttaaactgttactatttgctgctgttatttgaataaatactatttgaagagtagggagtagggaatgggaggttggaggatgcatgataaaggctttaagcctttgaggtagatacgaatgg

SEQ ID NO: 4374 - DNA, 364 bp, Glycine max
gttttatcaaagccttggctgcctctacctattggacttaaggctccagcgcttgatagtgtgatgagtgaattacaaagacaaggaattccaaacattccaccctctagtgcttgaaaccaacccttcatggaagaggttcttccctttcatatggtgtccattaaaggccacttaaccctaattcgacgacttctcatccattagatgttgcatgcattgcgtatatgttacatctaagctactatgtcagtgattcatatctttcttcttttgctttgccagtaaaaggaaaagaagaaaaaacttttaagccttttttctaattttcatgtgctataatgtattagttaatggtttcaag

SEQ ID NO: 4375 - DNA, 383 bp, Glycine max
ggtcacttgacttaccattattcattgcatgcaaaacaccattataagtactgtttctgttgttctgctctatgatcttcgacaaggccttactttgatccaatatagcattaaacatatccaaaccacccattcccatgccattattgctaccaccatccaccatcccattcgcattgaaattatattgtgacaagtcttgttgaccattgtgcatgttgtggttcatgatcccatatgatggtggtgccatgcttgtgacaataaagcttttttcatcactactcatcatgctgttgttgttactattcactgttgcacccatttgtgctgctttttggagcaatgccgtggcggacatgtgaggtgaaaggagaccattt

SEQ ID NO: 4376 - DNA, 488 bp, Glycine max
ttattagtgcacagttgaaaggatcaaagttgcagtcatacgtgacaacaacaacacctgatttcaattcagaactttcatatacatggtaatcaaattcatttacagtggcagttttaggagcgaaagttcatttcattagaacaagtcactgaaaggtaccgtttcctttttttgtagtcagaagagcaaattaaggtagagaaagtaatgatcgagcttggagtggtgcctatttcgtttccaaaacaagggcaagaagtcaatgaacgcacctcggagtatcacttcaacgttaggagtttgaagaatcttaggttcgggtattgactttcacttatgaattgaagactaaaatggttccatccagctgtagtattttaacttagaaaaactgcaaatttcggactcgctatttattttagcgtagaattttggagtagtatttgtaggcttgagcaaactttcctaagtgtggttaccctggt

SEQ ID NO: 4377 - DNA, 1220 bp, Glycine max
cgagtcagacccttcgtgtggttgttggtcgagcagcagcagcagatctgtggcctcaactgaactgaagctgtaccgagcattcatcttctgtgttcccatcttcttcactctcattctcctctttctcttctatctcttctacctccgaccgcgaactaggctccattggatttcacactttcgccttcccagcaacaacaaccgcaataatgccatctccacattgggtttgggcttgaacaaagaacttagagagatgctgcccattattgtctacaaggaaagcttctccgtcaaagatactcagtcagtaattcattcattttctttccccttttttaggattttcaacacaaccccttcatgcccagaagcttcagtaattgctggccttacaagccacacaacaactaataggataggatttgatatcatcttagaatttgggttagaccctaattcagctcatgagatgagggttgttgcccatttatataccctagtttagccatgtcactagtaatcaatgtgagatcttcagcacccccttaagttgaggattgggcatggtagtccaatcatggcccaattatagtttacttgaaaggcacaccaacaaccgctaggataggtctgataacatcttcgaactttggatggacctgactcaaccacaaaagtttgttcataggaatgagattttccctctacttatatacactgttttagtcatatcactaatcaatgtcaatgtaggatgtcaaaaatattcccctcacatcaaagataggacatttcaaggattgtaggtagtccgatatgggtagcgtaataggcctaacaacaaactgctaggatagattctgataccatcttagaatctagacttaagtctaattcaacccaaaagctaactcttgcatgggtgagaattctccctcacttatatacactgtcctagtcatatcactagtgggctctgatattctcaatgttgtaatagattttaagtaatcactttaggataggacaatgttgctgtgttttggagttaatgccaactaatttcaggaagtgtgttcaaaaagatttcccaaacacttgtttagaacttgcttgtgatgcactcagcttttgagcttcatttgttggactggaaaactgtgttttgtttttctttagcttccttcatctacgagattctttgtgcagatgct

SEQ ID NO: 4378 - DNA, 718 bp, Glycine max
tcctatgtctgttgattcgagtgggaaattggtaattactattgcttttcctttttggctagttttggatgcatatttgacttaagtatgtttttagtcaatgaaaataagacgtcttttttttaatccctacttaaagtttattcatctttaattcttatgtatgaccactttttaatcccttgttggtggctgaaagcacctttttatttataatttttaagaattaaactaaataatttaaatagactaattataaaaaagtgtgtttaggaactaaaaatatactttagcttataaactttttactatatttcactaatttttctgtgattctttagcaaagtaagattttctcacttgtaagaatttgatgtcacaggtgaggaatgtcgttgtgggcgttacaacagataagaaatgatacttgccacatgaaaatgttacacaagtgtaaagggaacatcatttgactcgtcaactgctggtgcttgaaaatattgttcgtgtatatgaaattgcagcttattagttaaagatatttttgttctaaatgagatttagactgatttaatttacatatatgtatacgaggaccagtggaaagggcacacaacttgtcatttattgaattgccaaggtcctctttttgctgcagttgtatcacagggtttttcgcatctcgaattacaagtcctagatgcacatttgattcctc

SEQ ID NO: 4379 - DNA, 357 bp, Glycine max
gttgatcaggacaatctcatatgtgcttgttgtggttgccaccgcaactttcatcggaagcacaccattttcaacggcatacctgaaactcaaacactagatcgagtgcaggggatgaggcctaagagaaagaagaggactactttctcgtcagagcaaaggaacaagctgatctgttttgctgagagtgtggggtggaaacctcgaaaggataagaagaacgaaatccaaagcttttgctccgagatgggaatgacccgtaggatgttccttatttggcttagcaacaatcgtcaccgggcaatcaagaaagcttagaagttgtttgtttcgctgtcatggttgaatcagtcttgg

SEQ ID NO: 4380 - DNA, 364 bp, Glycine max
gctcttctgtactgcagagccgattctgcgaagctttgtttcttctgtgaccgtaaagttcacttcccaaaccagcttttctcgaagcacaagcgcgcgcagctctgtgatgcgtgtggagattcccctgcctcggtgctctgttctgcagaaaactctgttctgtgccaaaactgtgattgcggaaagcaaaaacatttggtgtctgaggcgcaccaacggaggccactcgaggggttctcggggtgcccttctgtgactgagttgttaacaattctgggtctcagtgaaaaatctctgctttcaaatgagggaacttcccagattgatgatgacctttcggatttgcacgtgtggagtgctc

SEQ ID NO: 4381 - DNA, 366 bp, Glycine max
ccacaccaaaagaaacacacacactcagaaacaccaagagaaggtacttgtttttttttcttttcttttcttttctctgttctgttctgtcacaacttagtacttcacatcctttgctttgttatcttcttcacatgttgcttttgttgcttgtcttgtcctttgagctgagtgatgattgattccctttcagtagcagaaagatgggttgccgttagtttctatgactttcgatgttatgtatgtgtgagtgtgatagaaagttagaaactacaacaactcatgtttttcttttaaacctttttatttggtatgttttttttcttcttcctagctagttaatttgatctcttcctgattctgaga

SEQ ID NO: 4382 - DNA, 390 bp, Glycine max
tttttattgcttcttccgcttgggatccacttgtttcattgagtcaggttcaatcttttggaggctcttcaatggtttctcatagtgagtttgccaattccaactcatcttaccctcttgttttggataaccaagggataagcaacacgtctcacctggttcaatacatgtctgactcaaatcttgggggcatggtccccaaggttcactcctatgcaagtgggggattctcagaaatggttggtgctggctctttttgccaacataggtctgctgatatggctaacacagggtatccaatacattataatccgatcaaggaggctccaattaatggtgaacaatctcaggttgaggactcaattcctgaagaggaagcaccaggatctg

SEQ ID NO: 4383 - DNA, 1132 bp, Glycine max
tgtgtctttggatagcctttgaacttgtttcttcacattgcacgtgtgatgcgtgcagcggtagtagcttctttattgaccattttcgcaatgcaaaatgagaatgaagcacaaagccattcagtatgcatgatctcattaaaattaaccaagatgcaaattattaattcagtagtctcattttaaattttatggtttaaagaaattggttgaatcatttttaaatttatgaatatcacttttatttcatcacatattttagctatcctgtttgagaaaatgcataccttaatgaaagcatcttgaaaatttagtgcatatttctgtatacatatcacctctaatcatcaatttaataacattataagaaaaacatttttaattagatataacaatttcttaggtgcagattatgttattttcaaattagaattgaagttatattttgataatctgtataataaaaatttacattaaaatattatgtagattattattgaagtgaaactttagttctgattagaaaacaattcaaacagcactttatgtattgtatctaagttttcccttttaattatcaacttgtcccagattcatctaacgaggattaaaactgaagataaagtcaaaaacaacagcaggtaaatcccatttttcttgtagtggctagaccaaattaatatcattcttattccaattgattcactatgttttcgtatctaagttcatgtggtgagaaccatctttttgtatgttcccacgtgaatcatcctcccttgttccgtacaaaattgcataaaccatgcatgcatgcatatatgcaacaaaaaagaaaattaaaccaatcaatttcatttcacacacacatatgcatataccttggatatgtgctattcttcacagctttctgaccatatttcctccagcgataaccatcatccaaaatatcatctgcacttctcgtttgaaacgcaaaccttggtactcgtgttgttttcttcatcctcccacctttccttttctccttgtttcccttttcctcctcacaaactcccttattttgagccacaaaagaaaaagaagaagcacattcaattgcatctttagcatccccattaagcaataagccgtt

SEQ ID NO: 4384 - DNA, 856 bp, Glycine max
gcattgacacataatagagttgtggggatgataaaaacactggtttttcacactggtagagcccctaagggagatcgaactgattgggttatgcatgaatttagacttgatgacaaggtgctggctgatgaaggcgtattgcaggtaaacaactttgactgaacaagcaagtgtgagttttgtagtgtttgtgactggatttctagtatagttgctacttcattgccctctgtttcactagaaaggcattttgcaggcaagcaactttgtggaagtatatgtgagtgttgtagggtttgtgactgtgaggatgttaatatagttgttgctattattgtcctctattacattacagtagaagagatgcagagatactattgttggatatgcataaatgcatgttagaattgtgtcttttcatgttaaactttatccttttagctgatttatggccgttgatatactttgcatgtgcttaatttatatggtatggaatgacaagctttgtttgttatcttgttactgtgcatttgtctaatatagcatcccttcctgccttccgagtttgatttgttgactttttttatattctctactctctagttttgtggttgttctgccagtgaattcttcttgtaaatttatttaattgttctactggtttgttatatgtattgtaggactcctatgtgatttgtagggtgtaccaaaaggagggtcctggtcctaggaatggtgcacaatatggtaaaccatatgaggagaaagagtgggaaacagatgaggaaattgattctgtacaatctgcccctgttgctgctgtttgtgcacctgttcctatacaacctaggaaagc

SEQ ID NO: 4385 - DNA, 388 bp, Glycine max
acatggtttcatggttgtgttgttgcctttgtgatccgtgagatgaaatgagatgagatgtcagaaaacatgtatcctaggttgttgttttttgaccatacccattcgaagatggcatgggttaagcatcaaatccagcaaaaagatggttacttgagctactcaccaccccttttgtcttcttcttcttcttcttcttcttcttcttcttcttcttcacccccttaccctcttggtgctactttccacaaggaatcatcattgccttcttcaacaccaccaccaccaccatctggcaccagaattagtcctgctgttcttttcatcatagtggttcttgctgttttgtttttcatctctggcctcctccacctgcttgttagattta

SEQ ID NO: 4386 - DNA, 373 bp, Glycine max
cccgtctttgcgtgtgttctttcttcttcttttttttcttttcccacttcaaggggttagttaatctagaacctctttatatttcttaaaggggtctctcttttatcactttagcttattcccatattaacaagtttgattttgatccttatagcacgaccgagacacacaaaaataaaacttatgaacggtgtgaatgagatattgctcgacttcatgaagcagtgaagatgttaatttcaagttcttagcttctcttatgggccaattctgtgaatggaaagaatgtagcatattttcctacttggatcaattttgtttaataggacagaatttcagtatatggaaatatgtcccataataaactgcgaat

SEQ ID NO: 4387 - DNA, 841 bp, Glycine max
aaatggactcagaaccttacagcagaagctacctcatgtgaggaaaaataggagaggaccaaggtctcgcagctcgcagtaccggggtgtcaccttctaccgcaggactggtagatgggagtctcatatttggtatggtttatgatgttcaatttctagtataagatgaaaatcaatagatgtggttaaggttttaaattgtggtatgtaattaccaagattttaaattgttgtcacaatccttaatattgtagaatattacagacaaatgtagtagatgtagttgtgattgcggtcgcaatgtgatggcaaagatcccaaaaaccttgacattgtggccacaattgtggttgcttatggtttttcaaaacctttgcaattgttgatgtgatggattttggggtctactgaaaccacgcagtgaccataattgcagtcacattttgcctagaattttgctaactaccatgcaaccataacttaaaaccatgaatgcagtaatcttaattattgtccttgctgtcataattagttgtttggtggtctggtctgggttgacatcattgagtttttgcttttattgaatgcagggattgtgggaagcaggtctatttgggtaagtgaatatttgatttaatcggttggtgctgttttgaataattttgattcaattattggttagaagctatttctgtggtgatttttttttatttttttatgaataagtacatttgtggctgaattagcctaattttatttttgtaggtggatttgacactgctcaagctgctgcaaggttagggctataaatacctttgactgaagctacattgtgttcaac

SEQ ID NO: 4388 - DNA, 443 bp, Glycine max
tgtgcacgttacgccatagtcatatgcataggggcaacagctttgttgtgctgcatgggagtattgaggtgcatccacagctggttaagaatcgggaaccaagatgggccttgggctaatgaaacggtgccagattttgaggctctagcgggctcacggcccacaacagtcacgggcctcgacaggcccacaattgaatcgtacccaaaaatagtgttaggtgagaacagaggcttaccaaagaagggtgacaagacctgctcaatatgcctatcagagtacatacccaaagagacagtgaaaaccataccagaatgtggacactgctttcatgcacaatgcatcgatgaatggcttccactgaacgcgtcgtgcccaatttgccgaacttctccacgaaagttaccacaaccacgtgctcgatcatcaccacaataaagcta

SEQ ID NO: 4389 - DNA, 371 bp, Glycine max
atggggacttacgttagggaaacgccaccaaatgctgcgtcatctcatcaccatcatggaatctccaatgctcatgaaccaaatgctcgctccatataaaattaatgaagagtactgttcagtaggagaacaagacttcttggacttgattagcttaactctcagtgattggtgttagagtactgttgttgaggatggttaattttataattaagggctgggaattggggagttagtatatattcctaatcctaattatgtgcatctttaatttatggaataactttgttttttgttttaacttctgataatttggattttctgatgtttaatgtggttttgtctatcccttattaacagtgccaagctta

SEQ ID NO: 4390 - DNA, 519 bp, Glycine max
tgccgcaggcgactagctggccataatgaacgtcggagaaagcccccaacaagctccctcttgacctctcgctatgccagactttcttcgtctgcttttggttagaaactatcagtaaaatatcagtttcatgtctcttccaattttttcatagggaagcatatttagtttcagcttgtgtcattcctggcatacaaaagtaaaacaaactctaatgtctggcacttttattgacagataatagtggcagaggtagcaactttctgatggaattgacttcatacccaaagcttagtctgagaaattcacttccaactcctagatcatctgagctagctcctggaaatcaaacctccacacttagctggaatggcaactcagagacatcatctgaccttttcttgcaaggttcggtgggtgggacaagcttcgccagcccgggacatcctccaggggaaagttacattggggtcaccgacacgagctgtgctctctctcttctgtcaaatcaaacatggg

SEQ ID NO: 4391 - DNA, 1222 bp, Glycine max
aatagaaagtggcgaggaaagagaacaagagatggaaaaatatgaagaccaaggacacaaggtacggttggtgttgtagttactcagaaaaatggttttaagaaagcgtagcaacgtttttgtgacatgtttgtacatacaacactcttaaatgcttaaaaccactctcatggctcggttttgtctcttcaattttcctttatttgcatgcatcacaatgatttttcaaaattttaattttttacttctaaagttgtttttcaatgaaatcttataccccttttatttattttttcttaatttcgattgaaagttggttttatgaatgcttccaattgcgagatttattgctgatgtgtaattttgaatgttttggaaattaataagtcagagtgttgaaagaaaaattttctcttttcactttacaattccaaaactggctatttttctggaaaagcttatataggttttgtgacctttctaaggaattggagtaaaatttgtttccgccgttcacatacagcacacttttctcgtgttctgctgtttgtgattaattctgttatgttgtttttgtggaacattttgatgttttagtggtgatcacaacaatctaccgaacaatttcagtcaactctgtttgtggaacaggaacatcactgtttcattatacataatctgccatatatactaacaaaaggatcagcttttggagtatttttttttggcttttcttttatgcaatatttcttcaaaaattattctaccttgttgccccatattcttcttcttcttagtgttataagcttataaattataattgtcatgtcaattttagaaaattgtgaatatatacacacacacacacatatatatcttggttttatttctgcaattctgcggcattgattttaataagcaaaagatttttcaaattactaggatgctggagttgaaaatgttactgaggaagagctagaagttgatcctcctccaaatgctgaagagactaagaattcaggctcatcccctgaggctattgtgaaccccaaaacaccttccatagaagaagaaacagaaaaatcaaaaggtgacaaaacagagaaggaacaaggtgatgcagccaactcacaagagaaaaccctgaagaagccagataaagtgctaccatgcccccgctgcaaaagcatggacactaaattctgttactacaacaactaca

SEQ ID NO: 4392 - DNA, 379 bp, Glycine max
aacccaagattgctatggcttttgtgaccctgcatgcccttacaattgttacaataaccctgattacttcttctctccaccaccaccttctatttcacattcaagccaagttaatcacatatcctcctactcgatcattcttgttactctattcacggtcatttttgttgtggttggtttctacgtgatcaaagtgaagtgctatgctgcatggtgcgggtggagattcaacaacggttccgttccctctcaatcagacactgctgaggagtttctcaatgagaaccaagttgatcaccccgtgtggctcattgccactgtggggttgcaacaatcgatcatcaactccatcacggtttgcaagtacaagaagaatgaa

SEQ ID NO: 4393 - DNA, 384 bp, Glycine max
tgggtttcccagtggggtactcggagctcctcttcccgaagcttctccttcacatcctctccctcctgggcctcctcaggaagctgatttgcagcctcctccgcttcatgggcctccacgacttcctcgagcccgacattgcctgggccgaaacccagacccgagtgcccgaagagttcgaatccgtgtcggccacgctcatccgggaaatcctgccggtggtgaagttccgggagctggtggatcccccggagacgtgcgcggtgtgtctgagcgagttcgaggaaaacgatgagatcagacggctggcgaattgtcgtcacatattccaccgaggatgtttggaccgttggatggggtacgatcagagaacctgccctcttt

SEQ ID NO: 4394 - DNA, 432 bp, Glycine max
accactccaaacccaccacaccaccattattcatatctcattctctaacctttcactcttccttactcactctctactttgctcatcatcgtagatgaaccaacacttctagtctctcttactttataaccatgtaaaaatgagtcacctaatgaaaaattagtagcttcttgttgtgctttttattttgtttgtgttgagataaatttgtttgtttgtttggtattgttttgtgttttatgaattatttgatgggtgaagaaggagaagtggtgagaaagcaaggacaaaggggtgttggtggagataagtggtacttgtatagctgcttacaagactgtaaatattggtgctgtttaatacacgagactagttctctttcgatggtcccttttgagtgaaaaaccttgtcttctcagctttctttcgaga

SEQ ID NO: 4395 - DNA, 366 bp, Glycine max
acaaactagttggctcaattctctttgaatggctttggaggctttgaattcaccaacagcagccaccactccgttccgtggctaccaagaagaggaggaggacgaggaggctgaccttcacttacgtgagccttgggctaaaaggaaacgctccaaacgaccgcgttttgagacggaggaagagtacctcgctctttgcctcatcatgctcgcacaaagcggtaacaccagaaacatccacaacaacaacacccaattaccgtcttcttcactgtcagacaaagaagcgtcgccgccggtgaaactaacacacaggtgcaccgtttgcaacaaggcctttggttcttatcaagcactcggtggaca

SEQ ID NO: 4396 - DNA, 341 bp, Glycine max
ttccggtgcctttgcagactggtcggcccctccgtctgccatctccggccgcggtgacgacctctccctcggcttcaatgcttcatccgccgccactgcgcacggcggcggagccatgtggccgggggtatcgaggtcgttcaactacaacctggcgcctcaccatgacatcttcgtggtggcgcctgcttcctccttctaccaccaccacaacgacgtcgtcttatccgatccaaacaacaacaacggttccaacaattccaacaaccctgcaacggcacacggagtcaacgttttccctctcctaaccgccacgccatgcctcgagagcgagggcataa

SEQ ID NO: 4397 - DNA, 370 bp, Glycine max
ctcgggatcgaaggcttgctcctcctcagcttcggccgtagttttctcgccggagaagttggtccgcttgaaggaaggttcgtcggcgggggaatcgcctccggcgtcaacggcgcgcttagttttcatagcgttggggtttgaagtgcgaggggatcgggggaccaagctttgaagcatgatcggtgcgggtcgagagagagaatcgaaagctttggaggaaagttttgggggaaaagtgacaaaactgagagggaaagacaaggaaagtttgtgcagataggtagacggtgtgtcagaaaaggagtgtttggagagagagagagagaaaaaaaataaaataaaattaagagaggtaaaaaaaaaaaaa

SEQ ID NO: 4398 - DNA, 371 bp, Glycine max
gcggctttgagctatggaaccagcaacagcttcaacatcagcaacaacagctcatgggccatgaccctcctccgcagccgcgccctctctttcaccaagatctctactccgcgttgggcgttgggcccagcaggcccatctctgacgatcagtcgtcttcgagatccagtttccttcttggagcaagcggtggcggtagcgcaggaggagggattagctgtcaggactgcgggaaccaagctaagaaagactgccctcacatgcggtgcagaacttgctgcaagagccgcggcttcgattgccaaacccatgtcaagagcacttgggtccccgcttcacgtcgtcgcgaacgactacaacaactttctgcg

SEQ ID NO: 4399 - DNA, 376 bp, Glycine max
tctcacagtcgtcccttgttcactatacggccgcggccaaaccgtgttaccttctaaaggcaaaggccaccaagtaggggttgtcataccaagaagaccccttggtcctacacttgattccgcaactgtttccccacctatttctcacgtttatcatcgccattatccgaatcatcctcaacaattcaactcaattcctggcagttacacttcaatgttcaacacaggtggttcactagcaaatgcttttgatacaacatatggagtctttggtgagatgatatatgcaagggtctttgggaaccagatgactaacacatatacatacccgaattcttatgatctttcaaggaacagtaatccgaggatcagaagg

SEQ ID NO: 4400 - DNA, 496 bp, Glycine max
aattttttttgatggttttggatcagctcttcatcagcaaggtttacacgaacactcctcttgtgagaggttccagtggtgtaaggataatcaccaagaaattgaggccaatatggagactggccattgtaaagtttttatggagtccgaagatgtaggccgaactatggacctatcgttgcttcgatcttacgatgaattacatagaaagttggcagacatgtttggcatagaaaaatctgaaatgttaagtcgggtgctttactgcgattcagttggggctatcaaacacattggtgatgagccattcaggtaggaataatcccaatcactaccatattaaattggaaaatgtggtccatcctagagcctgacttgtttatttatttgatgttgttgcagtgacttcacaagaacagccaaaaggttgactattctaatggattctggcagcaacaatgtaggagtgtagtgggctttatcgacatttccatct

SEQ ID NO: 4401 - DNA, 406 bp, Glycine max
accaaaggagaactttgtgatttctgaggaaagtactcaatctttccgcaacattgatctgaatgctaacttaaatgaaaacgaagacaaaaatgctggcacagctgttccggcttcattgcctgagcccacttccatggacactgccatggagattaaacatgaagaaattccaggctggtccctatctgatgtggacaagatgggcattgacactatgcagcttgcaaacctaggtagtcgactagaagaggacgaagaagattatgacgaggaagggtaaataacatacactttgggggattaactctgctggaagctcatggtaacagtagcagagtaagtacgtactagtgctatgatgactagcctctagtactgtatgtctcccatgcaaagtatctga

SEQ ID NO: 4402 - DNA, 409 bp, Glycine max
aaccagaagattcagttccggcgccgcggtcctccggtggagtccgattcggaggagcgagacgcgtcgtcgccggcgtcgagcgacagttttccgccggagagtttcgagaggaagaggccgcggttgatgagttctaacaccacgaaaggaagcggagaaagacggaaggcgaagggttggggaagcgcggtgagggaactgacgcaggcgattctgaaattcggcgaggcgtatgaacaagcggagagttcgaagctgcagcaggtggtggagatggagaagcagaggatgaaattcgcaaaggatttggagttgcagagaatgcagtttttcatgaagacccaggtagagatttcgcagctcaaacttggaagaaaaggtggtaaccctagcaacaatctcaaac

SEQ ID NO: 4403 - DNA, 376 bp, Glycine max
tcttcttcattcccttttctttctctgcactccatctttctttccaaaacccacccttttctattcctcttcctcttcctccttttcccttctttttatttccttacactcacaacatttcccttaaaataaacataaacaaaccagcactgttcttgacccccaaaaaaaaatctctactatttattaactatattaattcctccataatataatcatttgttttccttgttttctgttttctcttataatatataaccttcttttatctattttttctgttttgcaccttgtgattgtgagttatatctatttatatttatatatcattctctctcttttttttggatgtgtctatggctggtttggatttagg

SEQ ID NO: 4404 - DNA, 911 bp, Glycine max
  misc_feature (601)..(601): n is a, c, g, or t
  misc_feature (621)..(621): n is a, c, g, or t
  misc_feature (644)..(644): n is a, c, g, or t
  misc_feature (679)..(679): n is a, c, g, or t
  misc_feature (682)..(682): n is a, c, g, or t
  misc_feature (724)..(724): n is a, c, g, or t
  misc_feature (735)..(735): n is a, c, g, or t
  misc_feature (745)..(745): n is a, c, g, or t
  misc_feature (777)..(777): n is a, c, g, or t
  misc_feature (784)..(784): n is a, c, g, or t
  misc_feature (887)..(887): n is a, c, g, or t
  misc_feature (889)..(889): n is a, c, g, or t
acatcaacatcaacaacaacatcatcaacaacaacaacaacaacaacaacaacaacaaccctgttccttcctctccctcaaatttcaatttctctgacccccatcattacatccctgcctctgatgccaccaccttcaaacaacacacccctgatttcacttctttttctgttgaggtaccactccttagcctttccaattctttttatgcttccccacaaaaaaaatgttttatcacttccacacacccttttaacccaactcttcaatttaaatatcaaaattgaaacttgctcaacatcaaaattctctattactaatagtcaaggttttaaattgcggtcacgcggtcgcgtttttgtggcgatccttaatattctaggaaattgcagataaatatggcggatgtcaacgcaattgcggttgtggagactcagaaaaaccttgatgttatggagaaaatcgtagtagtagactattttttaaaaccttgctgatagtttatatgtttttggcttcaaagctttaaggaaacttagaacacagagtttggtagatcttttgaaaattcaaaaattgcatttttggatggccttttttntgttagtgagtggaaatttnttttttgtttttgatagaagagngtggaggcatcgaaacctgtcccaccaccacgttnttnttcgtcaaagaggagtagagctgcagagttccataatttgtntgaaaaggttntgttttgatntttcaattttatgagaaaccttcctatttttnttagttntgattgatgattttgatgtgggcagagaaggaggagtaggattaacgagaaaatgaaagccttgcagaatttaattccaaattttaacaaggtacaatatctntncatatatttataatcattttcc

SEQ ID NO: 4405 - DNA, 389 bp, Glycine max
ttcttaccctccaagtgaaactttgcaaggggggaatctgagtggtgcttcatcaattacttcactgtctaatcaatcccatgattcacagacggatatgcactctcaaggactcatttttacaaataattcaggacaaattagcaataatgtgccatttctcgggtgggatgaccataatcatgatagtagttaccattcaaatgttattggtaactcaatagactctctgattgatccagaaggtcatacttctattaactcaacctacaacagaaacttggacttcaatttctgtgatcccttacaaatgaagcatgatggaattatgggattgagtgacgaaaactcattgaaacaacaacacaggtacatcatgaaccagcaga

SEQ ID NO: 4406 - DNA, 601 bp, Glycine max
ttataaattcccattcccattgccattgccaccaatcttttagattcgtcattactagtttaatttccttaatattgttgtttggtccaactaaagttgtttaattaaatataacgtacaaagttaggtggatttttataagtatttttttaacttgcatttttttttaaagcatagatgcttaaataaaaaagtgattatcatcagagaatcctaaaagcacctagtctaagttttatccttaaattaaccaaattggttccctgaaatgacaaaggcacaaactaagaaaagatttataaatgcaaatactaaattgattagtatttgtctgatttgaaacataggaataagctaagttttggttaggtgggattgtgggaaggctgatgatgaatggtggttttttattatgttaaattgaacattgaatgtttaggtgatttttgtttgactaatgaagttttgtgctgtttttaatcaagcagggaagttgcggaacggcatttcatcacccttacggtgaactgggtggatttgggattcattcagtgatagtagacgggggcagagaggcaagggtgtcaagatacagagagaa

SEQ ID NO: 4407 - DNA, 503 bp, Glycine max
gacgcgtcgaaggagattcagacttcacaatcgttggatcaggaatcacacatagctgttttgctctttgggaataacatgatcgaaggagacgcttcttcagatgggtattccagtagttcttaatctcattgtctgttcttccaggtagttgggatgctatagaagcccacctaagtgaatataatatcacaagtacggattaatgcaaccaactatcaaagtatggaggtctaaggttatttatgaaatttgaaagttctccttttccttaaaagttctaattagtatacaaggaatccttgatgtcaaaagggattgaaagaatgacaattaaaaaaatgaaaacactatgcattgaaactaaacaatatccattggtagtgacacattttttagtatccaacaatggccaagatgaatatactatgcagcttattagtaaaataagccttcaggacctagagggttttggtattgcatgtgtatagtgtacatgttga

SEQ ID NO: 4408 - DNA, 400 bp, Glycine max
ctcacagtaaccacagttaatagtgtcaggaactaagcaaaatcaaagagtactatactaccatactaccataccaaaataccaacctcaacaagacctacaagaaaccctttagacaagtaaaagaaaaaaaggaatctgaatctcaccctatagacacaagaatcaaaaaaggaagaacaatttatgagcatataaagtgggggggtgtcaattgtcatcactcatcaacaagttgtgcaaactgcaaaggggagcaaacttaaactatgcagaaagcacaatagaagaagctgaggaatgggcatgaagagcactgggggagagattgttcaagtccaaggagggcacattgttcggtccacaggtagaaaagataggcacagcaaggtttacactg

SEQ ID NO: 4409 - DNA, 319 bp, Glycine max
ctaccaggttctctaatgttgaagaaggtggctccgattaatgcttccaatatcgtgatcgataaaaacttagatacagttttttaggtgttttttgtgctgttttctaatcagaattagagttttatctcgataatctaatcaagatttattgatataaaactctaattccgactaaagaacagtgtaaacaacacatgtggaacaatatccaagttctattttgtcctggtttcgtcctctgttcttttttctttccctttctaatcttgaggattttttacttgtcacgtctgttcataaagatgggtccaaaagg

SEQ ID NO: 4410 - DNA, 383 bp, Glycine max
aaacaagtgaagcgttccattcctcaatgcccaaaacgcagcgtttcgtcatctctcagcggcgcggcttgccaagccgaagctgcgattaaggggcggctatgccagcccagtgtcaaagagccttgattctcttggacgcagaaaccctcggctgagaacagagtgagcaacatgctggcttgcttgtaggcgttgaaacccaaatgcaagggtctgaagccggctttcccgagccgatccctccacttagcgagcggctcgtggcgctcgagccgcgccggtccctcacagcacaccacgttgcatatctccctctgcaaatacatctccgccaaagcagccttgtccggttcgaccgggcacgcgtcgagcgagtcgaa

SEQ ID NO: 4411 - DNA, 740 bp, Glycine max
gagagggagagggagttcaggtgcaatggtgaaggttaaggatgaagaagaaattgatggtgatgtagcgtgttatctggaatcggtttttgatgatgcctttcattggaataacattgagtctgtgctgtcagatgcacgggaagagaaggagggtgtggtggcgtgtgatgtaggtgtcggtgatgaagaaggaggaacaaagagagacatatttttgagactaaactatgatgaggttattactgcttggtctagccaaggttcttctccatggacaacttcaaacccacctaagttcaactctgattatgacttctccttggtactactactacttctaatacttgactttcttttttcaatgattttgtgcttgtttggattaaaatttacaaatttaagtttgaaagttcaaaccgagtttgcaaaaatagtcctcccttttctttcatttcaaattaagttttaaggaaaaattgaagctaaacacaatttacaatgcaacccaactgaaaactaaacaagagtctttttcaattttacttttttaatagactttgggagcctcccaactgaaaattaaccgaacatgccctttatctctttgagtaatgctagctagtatataagctatgcatgcacaattgtatctatcgtcatctatgattgacatgtgagtgtttgttattttcagggtttgagtggtgtaggtggggaagtaagaagcttaagagggc

SEQ ID NO: 4412 - DNA, 386 bp, Glycine max
agggtgagcccgtggctggttgaaattgtatcaaacatgcctaccattcatctttcccattactcaacacaacaaaagaagccaagattccctcaacacccggatttttcttttgatggtcagatttcattgccagcatttcccagcaactttctaggtccaagcaatccgtttggttgtctagctgaaagtactcctgctggcatacagggagccaggcatgctaattatggtatatccctatcaaatctccacttcaataaactgcagtcaggcctatttcaagctggtttccctccacttgatcacactgcttccccagtattgagagtctcctccaacaatgcagcaacaatgcaaaaggtcggcacgggtgacaacgtctc

SEQ ID NO: 4413 - DNA, 369 bp, Glycine max
aaaaagatttataaatgcaaatactaaattgattagtatttgtctgatttgaaacataggaataagctaagttttggttaggtgggattgtgggaaggctgatgatgaatggtggttttttattatgttaaattgaacattgaatgtttaggtgatttttgtttgactaatgaagttttgtgctgtttttaatcaagcagggaagttgcggaacggcatttcatcacccttacggtgaactgggtggatttgggattcattcagtgatagtagacgggggcagagaggcaagggtgtcaagatacagagagaagcgccgaactaggttgttctcgaagaaaataaggtacgaggttaggaaattgaatg

SEQ ID NO: 4414 - DNA, 409 bp, Glycine max
caaaaagaagcagaggaaaagagagatagagagagaagaaaagctgtgaagagaagagtctgaaatctgaatcataaataattggtttttgagatgaagaactgcgagttgtgcaagcttccggctcggactttctgcgagtcggaccaggctagcttatgctgggactgcgacgccaaggttcatggagccaacttcctcgtggaaagacacacgcgcacgctcctctgccacgcgtgccagtcgcccacgccgtggaaggcctccggcgccgccctcggaaacaccgtctcgctgtgcgagagatgcgccggcggaaccaccgaacaaggtcaagagagccaaggaggcaatgacgacgacatagacaccgacatagacaccgacgatgaggatgactacgatgaga

SEQ ID NO: 4415 - DNA, 400 bp, Glycine max
tgagcaacagaaagagcattttgaaacgaatggtccattgacaccgacctaccatcgtctctaatctcaatcaccctgtgcctgccctgaaagctactcaagtcgctaaaagcgcgcaatgcaggctttggatacgctctagtgtgatgcatgttttcttctacttcttcttgcaccaccacgccaaactcgttgccactttctacactttcattatcaggagaagtttcgtttgttgaaggggcctccacctcaacctgagaagaagtgaaagtgaatatgccagcacgacacaaggggcagctagagtgtgacttgagccacgtgtcgatacaaggagcatggaaaacgtggctgcattttggcaagagcctaacactttcgtcatcttgaaactcga

SEQ ID NO: 4416 - DNA, 378 bp, Glycine max
tactgctgtcgaaaacctgagatgtcctcgatgtgattcatcgaacaccaagttttgttactacaacaactacaacctcactcagccgcggcacttctgcaagacgtgccgccgctactggaccaaaggtggggctctccggaacgtccccatcggaggcggatgccggaagaataagagcattggcgtggcgagctcggtggcggggaagacagcctcgaccaagatgaaaaccattgcatcggagtttggaaaatcgccgggctttggcggtgggttcgaggtggaacacgaacttccgccaccaccgggccaaatcctctggggatcgccccaaaacacccaccttctagccttgctgagagctacacaaactca

SEQ ID NO: 4417 - DNA, 402 bp, Glycine max
cgtcttgtggcagatggagcactcgtgggtcctaccaccaccgttcgacgccgaactcgtcgtcactgcggaggaggtcgggtggttttctccggcgagcttccggtggctggccttgtgtcctccgagtgcttggtaagaggagaaggctttgttgcaaaccgaacatttgtagctcagtttggcggcggatagcggcgcagaattgttgtcggagacagcgggtttggcggtggagacactgccggcgccgccgcgagcgagcatgatgagacaaagagcgaggtactcttcctcggtgcatgaagggtgttgcagttgttgctccgtgcggctacgcttagaacgctttcctttcgtccacggtgtctctaagtaactgagactggtttcttcaaaggg

SEQ ID NO: 4418 - DNA, 361 bp, Glycine max
cacgccatgagaacccacatgatggaggtggcagacggatgcgacatcgtggaaagcgtgtctgagtttgccaggaagcgccagagaggggtttgcatcatgagtggcactggaacggtcaacaatgtgaccctcaggcaaccggcttcgtccggttcggttgtgactcttcacggaaggttcgagatcttgtccctttcgggatcgttccttccaccacctgcgccgccggctgcatcaggtttaaccatttatttggccggtggccagggacaagtggtgggaggaagtgttgttggaacactggttgcttcaggacccgtggtgatcatggccgcttcgtttagcaacgctgcttata

SEQ ID NO: 4419 - DNA, 411 bp, Glycine max
gaggctcccggtcgggccggccgcggcgattcccgcggtctcactcgaccggtcattctttagtcctgccgggcgaagacactgaacggttcactttgcggcttcccgaggaagttagaaagcagatattgcagaacccgcaactgcatcgcgcgagaagcctcgttatcttaccgagagaaggtagttcgcggcgggggtatcgaaccggtgaaggaagtagcagagggagatcgtcgaggcggttggaccgggggtttaagtcggaccggtgggttttcaccatggcgccgccttttttggtgagagcgtcgtcgattaggtcgcccagggtggccaataacggtggcgaaggaacttccgctgctgcgtctttgcctccgccgcctgctgtggagtctgtttgagttt

SEQ ID NO: 4420 - DNA, 375 bp, Glycine max
gattttagctaaataaatcataaatcttcataaatggatcaagttgctcctcctccgattctcatgcaccgcaagcgcgatctctcctacgccgtcgtttcgcctgctcccaacccgagctggagctgggactgggacagcgtgcgtttcgccggcaaaccaccgccaccactctcctccccaaacgacgacgtcgtttttgaggagagtgttgcgccgcctctgcagttaaacctcgggggaaggacgaacaacagcaacagcaacaagagagttaggtcagggtcccccggaacgtcgtcgtatccgatgtgccaggtggacaactgcagagaggatctgtcgaaggcgaaggactatcaccggagacacaag

SEQ ID NO: 4421 - DNA, 988 bp, Glycine max
  misc_feature (932)..(933): n is a, c, g, or t
  misc_feature (967)..(967): n is a, c, g, or t
  misc_feature (982)..(984): n is a, c, g, or t
tttttgacttttcttgtttcacattttatctatttgctctacaatgtttaatttataatcctttttttgtttgaattccagaatcctcaaatggatttacaagccatggatagatgccacagaataggccaaacaaaacctgttcatgtttacaggctctcaactgctcaatctatagaggtacttagcaatattgtatattggcctcaatctgtagtttgacttgaggatcgtttatattgggatggatatgacaaagtctatttacagggtcgcatgttgaaaagagctttcagcaaattaaagcttgagcatgtagtgattgagaagggacagtttcatcaagaacgtacaaaacctgccagtatggatgaaattgaggtttgtattttagcagttgctttctaatgagttcttatttgttattttctcccatcatgttttgaagtagaaacaaattgttgtccattatgctagcatgcctttgatgttgaaagattttgattgtcaactctatcttttttacatggccaaaaagtcaattttgattcgcctaattagatgaacatgtagatcattaaatgattaattagtctcgttagtctcaagtattaaacttgcacacctcagcttacaattaatttaccaacacatggggatttgcttgtctgatcatactcatagtcactagattgtgttgtatacctatttggttagggtaagcctaatataaattttactggaaatatgaagtgatggggacaatccaaaatttggcacttgcatcgtttttattattgagatatatttattggagtttcctttactaccttattttaatttgttgttcgtgcatgatcaaattttaggaagatgatgttttggcattgcttcgcgatgaagaaacagctgaagataaaatgatacatacnngatattagtgatgaagacctggagaagctcttgnatcgcagtgatctannncaat

SEQ ID NO: 4422 - DNA, 869 bp, Glycine max
ggagagagccctctggtggagatggagatggatatggtcgtgggcagagatgatcaatcgtttgagttgagctttgattatgaaacgtgtgaagaggtgaaggtttgtgatttgggattggggaatgaattaggagcgaagaaagagaatgatgatgaggtgaaaaagaacaagatttcgttgcagctagactatgaggcggtaatcatcgcctgggctagccaaaaatctccgtggaccaccgctgacaaaccaaacttggaccctgatgagtgctggaaacaatgcatggtatatttactattttgatgtctcaattttcttataaattgctattttcattgccattgccattgccattgccacttaatgttgtgttctttgcttcatctaacagttgtttgattaaatacaaacgtcaagtggattttttaagtattttttaatttaaattacaattttatcttaagaacttgcattattttttaatgcacagatacttaaataaaaatttaattatgaatagagaatcctaaaactaaaagcacctggtctaagttttgtccttaaattaaccaaattggttccctgaaatttcaaaggcaagaactaagaaaagattttttattgcaaatactaaattgattatttgtatttgtctgatttgaaacatgggaataagctaagttttggttaggtggggatgggggaaggctgatgatggatggttgctttttattatgttaaattgaacattgaatgtttgtttgactaatgaagttttgtgctgtttttaattaaccagggaagttgcgaaacggcatatcatcatccttgcggtgaaatgggtggatttgggattcatccag

SEQ ID NO: 4423 - DNA, 272 bp, Glycine max
cttttttttctttttttgtcttattgactttccaatgtgtgagagccctttcccaatttttcacttcaagggctgctaaatacattactactactactactactactacttttgtttccccaccttaggtttctcaatgtcatcctccttctccttccgcgtgttgcacaacacgacaggtatgcctgccatcctcctcaatattcaatgtcttgtttcatgtaatcaatgtaatgcaaatgatttatgctcaattcccatatacgtgtaga

SEQ ID NO: 4424 - DNA, 398 bp, Glycine max
tcagttccctttcttgagtactaattttgagccacaaattggggtgtttcagtttggtggtggagaaaataacaatgctgaaccgccaagttatgcaaagggtcatggaggccggtttaataatattcgttctaaaatggattctattaattctagtgtaagtggaatagtgcctcagcttaatacaataaagctggaagagaatcaaggtttgagtttgtcaaaaaatctcttgatgactagttcgggaaatggtgtactttggaataatggaagtagtggcaatgcatggagtgaggttcctagtttcattccttcacctaaccacttgttgtgatcattggaattaaactactccaattctactgctttgctttatttcctactcgccacacaga

SEQ ID NO: 4425 - DNA, 408 bp, Glycine max
gcatcaatcgaagatcgagaacgaggaagcggtggcgcgatgcaaggagcggaagcgcttcatgaaggactcagtagcctcccgcaacgccttcgccgccgcccactcggcctacgccacctgcctgaagaacaccggcgccgccctcggcgacttcgcccacggcgaagtccaaaaccctcaatttcactcaaacgacaacaacaccagcagctcctcctcctacgtgacggcggcacagcccttcgaaattcctctcccgccgccccctctccccgatttctcccccgccccacctctccagcgggccgccagcatgcccgagatcaagatcaacaatcccgactccaggcccaggcccgagcccgtcaccacaatcgtcgaagaggacgatgaggaagacaagat

SEQ ID NO: 4426 - DNA, 394 bp, Glycine max
gtgacttgattagagccatggggcctccggaacaccctgcggatcaaatctcgggtccttcatccgaggcgatctctctttgcctctccaccactagtgcctcaccaatcttcgcaacaggtggccggcagtatgcgtcgtcttcaccgcacccggccatgtcagccactgcattgctgcagaaggcagcacaaatgggtgctgctgccacaaacgcctcccttcttcgcgggcttggcattgtgtcatcgtcacctttggattccacctcgtcgggacagcaaaatgtcctgcaatggggccaccaacagcagttggaacccgagagtggctcggtcgctgcagcagggctaggacttggtcttccatgtgaagatggtggttctggactaaa

SEQ ID NO: 4427 - DNA, 368 bp, Glycine max
attttgactggtaacattgctgacacgaacatgagagagagtttaagggttggccttaatcaaacttttccccctctagagtcagaaggaaaccatgcagtgtttgattgttccatgccaacaccatactcttggactgaagttccacacatgcaactcaaagaagaacacaagtcacttgtttatttagaagatagcttcaatcagttgccattacatggtaagcagcagcaacacatccatgtggatcaatcacaatcagttgcttcaattagttccgctccctcaataaccgaggaagaggctgctgcttgtatagaaccaaaacctttgtttgcagattacaacaatgattatgccagttctgt

SEQ ID NO: 4428 - DNA, 364 bp, Glycine max
ctcttgcacaagttgacctcctcaagaaacaaaagagcctaaccctcaagaaagtgaacatcaccacacaacactgtctcaaggttgaggctgaaaattccattctcagggcccagaagactgaactcacacaaagccttcaatcactcaatgatatcatcaatctcatcaacacgaccaccacttttgatcataacaattattattacaataataataataataataacaataataataatttcatgatgaatcccatgcacatggcatatcttaaccaaccaattgtggccactgcagacaacaacatgtttctgtggtgaagaatctgaaaaaaaaaattaaaatttcgggctagggggtt

SEQ ID NO: 4429 - DNA, 609 bp, Glycine max
ttagaaggctttttaaattcttggaaaagaattatgcagcagaaattgccaagctttaacagaaaggcaatccaaacaccattttcctgaagggggcactttgtgataacatcatcatcacaagttggacatccttcacagtgaaggacaaagagtcggctccggatcccgagcttacactgttaaacacagcccttttcctccttgaagaacatcaatcaaggcccctcctgtgataaaaatcagatagcttgtcattggaggaacaaagaatgcatcaaattttcatccattttttttaaggaaactgtttttcttttgcaactatatgactgtttccttttataaaacatggttaaaagctgtacattcagaagcttctggttgtgctcaaaggatcataatcgtagacgtcaccagctttgacaaaccggcctttcacgcgccttctgacatcagcccttgccttgcgagaggcatacctcacttttttgtcaaacctaataagataacaataatggatgttcagtcaacttagagcaaacatgatttaatttaaaaagtattattgcaatcacttacatccgtgtcttcttcttttccttgtac

SEQ ID NO: 4430 - DNA, 559 bp, Glycine max
cccccaagctgcctccttcccccgggcagagaagtgctctgatgtcgcctgctggtggaattgatgggaattcggcggccttcagcttggagtttggaaatggggagttcagtgggcctgaactgaagaaaattatggccaatgaaaagcttgctgagattgccttgatcgatccaaagcgtgccaaaaggtgtgttgatgttgtggcatttgacatactaacatgttgcctgtgaactgattgacttggttttggggtcattttcaggattttggccaaccggcaatcggctgcgcgatccaaagagcggaagatgcggtacatttcggagctagaacacaaggttcagactctacagacagaagccaccacactatctgcacagcttactctgttacaggtgggggacctctttttgttgttggtaatttagtactgtgatcatgatttttgttgtttaatttgatttaattcctttcaatcatgtgatcacagagagattcggctggactcactaaccagaatagtgagttgaagtttcgccttcaatctatggaa

SEQ ID NO: 4431 - DNA, 776 bp, Glycine max
ctctcattttcctttatacatccaatcaataatactagtgatgatagcaccccttccacaccaattccacaatatgggcaaataagcaattcttgcttgattgagactcaggacccatcccaacagcctttaaatcaaggtaaatttgccaggttcatgcactaactttttttttcaatttatattatcatttgtgttatttttatacagcactatatatcaataatttcattcagggtcaatttttttaattaatttccccttctttgttaaaactccaaaaagatatatataaggagatcttaagaaagatctgcttatttatatgcgttttcaaaatatttatgaaattattttcactactagaccgagtgcaattagcaaatctgaatctctcgttgagaaaaggaaaaagaaacgggtatctttttttatataaaaaaataaaaaataaaaaagttgttggttgatgcacatgtaaaatatgttttaccttgaaatacatgccaaacctaaccagttgaaatgacactccctttataatatatacttatctcccttcaattaatctccatcttaggtttgtgtctatcttacaataatgatgttgatttgttgagacaactagttcggtatttccagtgatcagcaatattttccattggcactttaatttcctaccctagctagttgatgttgtgttttcataaatgacaaattggaccaagccaaaaaaaaatattctgcctaactaaagcatgattgttattatttat

SEQ ID NO: 4432 - DNA, 350 bp, Glycine max
ctagtgtttcccaagcatatgctgattatgtcccaaatcccgctgttggtttaaaggctggtaacagaccgagagatggaaacacacaccaccaacgtacttcatctgagagcctagttatagaggagcagccttcatggcttgatgatctccttaatgagccagagacacctgtccgaagaggtggacatcgacgttcatcaagtgattcttttgcgtacatagacactgttaatgcatctaacctcaattatgctagtcaggacgaatataaatataagaatatgatgtctattccaccttggtcacctcaagattttgactgcagcaaagatgctcgtcatgtgcct

SEQ ID NO: 4433 - DNA, 264 bp, Glycine max
tttgacaagtggctactctctcactcttcttgccctacttgcaggcacctcctcaagtcaaatgattctcttcactccttacatattgtcatagcttaggtatcctctactcatgagtagcatcattatggctataaaacttttacttttgatatttaatgtaactgtatattcaagattcaaaaattaagatcttcaattaagttagaataattttatatcaagttaatctagctactttagtggttcatagcaaatgttttg

SEQ ID NO: 4434 - DNA, 369 bp, Glycine max
tgtcattccatgttgtagggcattatcatctggtgtggtgggacacttctggctgcagctgtagggtagccaagagcctcaggatgagggcccagaatgagtcttcttctgttgatgttgagatgatgctgaggctcaccctccacttcctttctgtggaagtttctgtggcaatggcaggcagagcagttcagtgcctctatgctcccttcttttccacttggcatgaactcaccgcacccatcagttgcattccctcccatggctgctgcatggttcttcaggcattctctgtacctaaccactttcttgtagcgatcctcctcctcctcctcctcctcctgctgctgcatagtagttggtatgcca

SEQ ID NO: 4435 - DNA, 375 bp, Glycine max
cgatggtcattgaagaggttttgcaacgtttaagtgagtgagtgcttttgcaacgaatcacaaacaaggcatagcaactcatggatgctaaaacaaatggacgacattttcgttttacaggcaaatgctattagttttttattaaggaaggaaatcaaacttgtaacttttttctccctatcttcttcttacccaactaaacttataactccccaaaccataggattgtatgataaacagaatatctattgcttgcaagagttatcacttttggtacggtgttactctatctatagaatctcaaatctcaaatctcaatctcaattgtgtttcaccttaaccattggattggtgtatttagttttaatctgtgta

SEQ ID NO: 4436 - DNA, 400 bp, Glycine max
tctatcataataccctcactcacgcatacacaagaatttttcccatcccaaaaccatgaccctccattcaccattcaccgagcgaatcccataaaaacaacacccacagtaccatcatcatcatcatcatcatcaacaaaaaacggatgaacccaaccttctcccttccctcactattccatctctctcaccttttccctttaacaatccctctctctctttctctctctcttgctcttgcttttgcttagcaataagttacaaccaccaaccctagagagcgttgaggcgacaacacagtacatcaggaacagcaaacaaggcagtaacaaacaacagtaacagttaccatcaccaccaccatcatcaccatgtcccttgaagagtcgctaagatctaa

SEQ ID NO: 4437 - DNA, 493 bp, Glycine max
ggctgatatcaaaagaggaaaattctctgaggaagaagagcaactcatcatcaatttacatgcagttcttgggaataagtaagttactatattcattcgatttcattactaaatggcaagcttaatatttttcataatactaataccgtactatataaattaaatgattttttatttgtatatgctttatttccaatattaggtggtctgctatagcaggtcatctgccaggtaggactgataatgaaattaagaatttctggaacactcatttaaagaaaaagcttctgcaaatggggttagatccggtgactcatcgtccaagatcagatcaccttaatcttctatccaatctccaacaattgcttgctgctacaaacattgtgagtaatctcacaaacacttgggacactaataatgctctaaggctacaatcagatgccacacaactagccaaactccaattgctgcagaacatacttcatgtccttgg

SEQ ID NO: 4438 - DNA, 394 bp, Glycine max
cctcggatctggaagcttccgtggcgaaacaggtggtggagcccgagaaacggccccggaagagagggcgaaagccggctaacggaagagaggaaccactaaatcatgtggaagccgagagacagaggagagaaaagctgaaccaaagattctatgctctacgagctgtagttccaaatgtatccaagatggacaaggcatcgctgttgggggacgccatattgtacattaacgagttgaaatcgaagctcaacgtgctggattcagagaaaacggaattggagaagcaattggattcaaccaagaaggaactcgagctcgcaactaaaaaccctcctccaccgccaccgccgccaccaccaccaggaccgcctccatctaatagcgtagaacc

SEQ ID NO: 4439 - DNA, 379 bp, Glycine max
  misc_feature (102)..(102): n is a, c, g, or t
  misc_feature (107)..(107): n is a, c, g, or t
  misc_feature (169)..(169): n is a, c, g, or t
  misc_feature (189)..(189): n is a, c, g, or t
  misc_feature (297)..(297): n is a, c, g, or t
gaactccctcaaacggttcatccaagcaagggaataataatagcagttctctccacaatgtttgccataacattactcttacttctctatgttaaattctgncgagntatccctcatgaactccttaggcaaaactcaaatctccaaaactttcagggcctaactcgancaaggtctagagtttctggnattgacaaacaagtaattgaaacacttccttacttcaagttctcttccctcaagggttccaaagaaggcctagaatgcacggtttgtctctccaaattcgaggacacngagactctaagacttcttccaaagtgcaagcacgctttccacatgaattgcattgacaagtgatttgaaagccactctacgt

SEQ ID NO: 4440 - DNA, 420 bp, Glycine max
aagacgatcaacggcgatgatctgctgtgggccatgaccacgctggggttcgaggagtacgtggagcctctcaaggtttatctgcataagtatagggagctggaaggggagaaaactgctatgatgggaaggccacatgagagggatgagggttatggtcatgcaactcctatgatgatcatgatggggcatcagcagcagcagcatcagggacacgtgtatggatctggaactactactggatcagcatcttctgcaagaactagataacaggtttatgcatgtgttatctcatctgtttaagcttattaattgattactataaggatggtgatatttgatttatattatgtttgattttagaaacacaccagctccagcttgtaattgttgcttgaaacttcgttgttgagagaaaaa

SEQ ID NO: 4441 - DNA, 803 bp, Glycine max
  misc_feature (787)..(787): n is a, c, g, or t
agtcattgtcaattcagacaaaaacagagggtaagataaatacaacttcatacattaaacaattattatttaagttgctaaaggattgaactgaaaacccttttctgtagtctgccattcctccgctacttaagaataatatcaaatggctataaaaaaaattgggttaaagtttagactttttattgcataatagttagcgttaaagatagtttctaagttgtttaccatttcctactatatgcctacagtttttaatttgtttaccatttcctgctatatgcctataatttctaatttgtttacctttttcttctgccttctggcaaataagattagactttttattgcataatagttagcgttaaagatagcacatatttttcttctcttttattcttaattttaaggtaataattttaaaatcatcatttgtattcattgttgatgttttggattttatcatttaattatttgcaggcctggatattcctccttgcatttagaggagatgtgcagagtgatccatcctgaatttcaaatgtgatattgtgagtctcggagcctatgtgttctatataaataaacactgcctagtgtaatgaataaaagagaaactggtgtttggcaagcaacaatagccaacctcacactttctgctttcagtttggtccttccgtcctcatggggatccttcacacgaccttattctgtcatcttaagccattgttcaaggacagcaacaccatattttggaacctcttcatttattccattttcatcagantagtgagcacgatcga

SEQ ID NO: 4442 - DNA, 831 bp, Glycine max
attgtgagaatctcagctatctagtgatgccgaagactcttcttcagagactggtggtacatttgtcgaggcactacctgaaattgaagcaagattttgggaaagaaatgtcctcataagaatacattgtgagaagaataaaggagtcatagagaaaacaatcagcgaaattgagaaactccatctaaaagtcatcaatagcagtgccttgacatttgggagtttcatcctggatataaccattattgctcaggtaatttctgcacctattccattggctgaaaccttagttcacacaaaccaagtccaatctatctatctatgtatctgtatcgaactaagttccaatatagcaataacacctaaggtggttgaaataattaaaaaataaacttaaatatatttttagggcttgtaatttaatgtttttaattttattttttcgtttctaacagtattttaaataacatattttttattattcaaagcgttgtttaaagtgatttaagatgaaaaacaaataaatatgatttgtaaggattaaaaaaaattataagtatgaaaaacaaaaaactctgaatcgtaaggactattatttaagcctaaaaaaaagttttcacgagtgataaaaaatgctcaattggtaggcatcagttgttgattttcatcattttgttccattaaaatataattttctttcaataagggaattatttctgcaatttgcagatggatatggaattttgcatgacagtgaaggatcttgtgagaagtttacgctcagctttttcatatttcgtgtgaagagttatgcatttttcggtcgtcccc

SEQ ID NO: 4443 - DNA, 482 bp, Glycine max
ttcacattgatacaaagcttatatgagcctgagcctcaaccacaacaacagaactcacttttcaccaacccctccatgtcctactcatcatcttccgcaaactatgggatatgttccaatgaactgtcaccaacttggtccaaagtttcttcccttcccaaaccctcaatgccaaagcaacagctcagtggattgcacttttccaacaacactgctttctggaattcttcagccgaagcacttaatgacataagagcaggtgtttttacttcatcacaagcccaatatcaaacggcaaaatttgaagagaaacccaactgccccaatactctattaaacaaggtaattaaattaattaattaattaatggtttccaagtttataaataatccatggctggctagctagctagggttttttgtggattaaaggtaataatttggtttaactacttcagctcaagagagaagaatcaccagacg

SEQ ID NO: 4444 - DNA, 413 bp, Glycine max
  misc_feature (12)..(12): n is a, c, g, or t
gcttcactccgnatccaaccggtgatgatcctgcttcttcttccctactctcattatcacaccctttttaatatattccatttcatgcttacctataaaaaaaattatatttgtacttatgtagtctcctttatccttggcagatgaatgatgttttttttctagttattattatgagctggtgcatacggccaagagagagagagagagagacttgttgttgataaagatcatcagtgttttgtggctggggtgattttcttttgcaaaaggtgtgatgttattgcgttatgtaggggaccacagtaggatttgtgcctttgcttttctagatatttatatttatatatttattatatatatatgtttcttttctttcttccccttgaagaaatgttaaacaaaaaaaaaaa

SEQ ID NO: 4445 - DNA, 982 bp, Glycine max
ttcttgactatacatacaccaagtgtacgtttggatatatagagaaaaaatgggtagttgtggaagagaaggagcagtgaggcaatatgtaagatcgaaggttcctcgtttaaggtggactcctgagctgcaccgttgctttgttcatgctattgatagccttggaggtcatcatagtaagtaatgctgttgtttttggatttatatattgattcgttttcactatgaaggatttctgaccatttcttttaaaaattaaacttttcagaggctactccgaagcttgttcttcagttgatggatgttaaagggctcacaatttcacacgtcaagagccatcttcaggttaggaacatagaataaaattttggtggcgcatggttatgtttgatattgggtgttactaatattgggtttctctctttatccaaaccagatgtacagaagcatgaggggtgacttgggcagacaaggtactgaaccttctttttagtgatgatcatggctcctcaatgcttccttcttctgcttatatatagtaatcctatttgtctgtcatatatccatgtctgtcatatatatatgggaacttaatttagaccatgctttgtgcattgaatgctgattgttgtttcttctcttggcacatatttgaacttaaaaaacaaagcctatgaactctcacttacgcacaagtttgggaaatctgcgactgagttgcacatttattacttattaatcttttctatgccaaaatagtgtagcaagaataagaagccaatgtccttttaaatcttcctctaatggcattttgatgaaatccacaacttttttgtttattctccctactttccatacacaactataaggtcgttacttacttgagttcaaaatataaagcattaattaattgtttcgtaaaaaaatggtctcatttttcttttcacaatgtgtattattgtcaggtaggacaccctcccaa

SEQ ID NO: 4446 - DNA, 366 bp, Glycine max
ggagccaccatggccgagactcggagatccacgggcaccgttaagtggttcaacgcgcacaaaggtttcggattcataactccccaagatggaaccgatgatctcttcgtgcacttcacttccatccgatccgacggctaccgttctttgtccgacggtcagtccgttgagtttctcctcgattacggcgacgacggccgcaccatggccgtcgacgtcacctcagccgttagatctcgtcttcccggaggatttcgcggcggcggtggcggtgggaggggcagaggaggaggacgctacgggggcggggaaggccgtggcagagggttcggtcggagaggaggaggccctgagtgttataactga

SEQ ID NO: 4447 - DNA, 412 bp, Glycine max
ccccttggaagaataggtcacttggcaagggattgttaccatggacagggtggtggtggtggtgatgatggtaggaatcggagacgcggcggtggtggtggaggaggaggagggtgttttaactgtggggaggaagggcattttgcgagggaatgtccgaatgttggaaaaggaaatgagtgagaatgtgttatggtttcttctattgaattgagtctgttactgttagttggggttggttaaatggattctgttatttttgtttctagccattggcatttccttccttccttccttccaaatatgtttttccagggctttgctaattgttttatctaatgcgcttcttttcaacaaagtgtgattcattatgcttgttcctcctcttgaatatgaagattgaagcgcaacg

SEQ ID NO: 4448 - DNA, 701 bp, Glycine max
ctgttgacattctgcgctgaaacttgcatcaagagacatgtactcaaggtttggatgcacaataacaaacacactcttggtaagaaaccctaattcccattcttcaatctatctctttcaatttttaggtctatgtcatggattttagtctcaataggatgagttgagttattataacttgtaagagttaattgagtgtgcaaagaacaagtattggaacaattttaccatttgttatctagaattctaattaatggagatctagttagggctaattcttactcaatattcctcctttggtttactttcatttgatattattatgtgatgagattttagttgttggtgattttcggttattatgtgtatttactagctaattctgagcaacattcggctgggaatggatcgaatcacttgaacagcaccacaataattgagaattctcaattctcctgagggatattaacgaaataaagagaaagaactgaagttggcagaagttcatggaagggtttgcaagtgttcatcttatcagtagcatcaggtgatggtgatcgaggagggggagtacgcaatggaagtatgcggatgagcacagagaataaattccaacataaagttgtatttaacgtgagtggaatgcaagtgcaaagctgtttatgttactactttgctgtgttccttcgcattatttgtca

SEQ ID NO: 4449 - DNA, 452 bp, Glycine max
cgatcagaaggggtttggattcataacccctgacgatggcagcgaggaactcttcgttcaccaatctcagatcaaatctgacggtttccgaagcctagctgaaggagagtccgttgagttcgctattgaatctgaatctgacggacgcgccaaggctgttgatgtcactggccccgacggcgccagcgtccagggaaccagacgcggcggtgatggtggccgaagctatggcgggggacgaggaggtggtggaggtggatatggcggtggcggcggctacggtggtggcggtggctatggtggaggcggtggctacggtggtggcgggcgaggcggtggtggcggggcttgctacaactgcggtgaatcgggacatctggctagggactgcagccaaggaggcggtggagacaggtacggcggaggcggtggtggtggtggcaggtatggag

SEQ ID NO: 4450 - DNA, 397 bp, Glycine max
ctctcctcgccgtgccgccgcatgcgtcggcggcaccgacgtgtactcctccgaggagaccatgctgcaaaagttcctcccttccaacgattctgacgaggacgacccttactcctcagaccacttccggatgttcgagttcaaggtccgccggtgcacccgaagccggagccacgactggaccgactgccccttcgcccatccgggtgaaaaggcacgccgccgtgacccacggcggtatcactactcaggaacagtctgtcctgagtatccccgcggagggtgcagccgtggcgatgcatgcgaatacgcccatggcgtgttcgaatgctggctgcacccttccaggtacagaacggaggcctgtaaggatggcaggaactgcaagagaaaggtg

SEQ ID NO: 4451 - DNA, 409 bp, Glycine max
tggggattttccggccgccgggagagcagggtcatggcggagaagacggtggtagtgggtcagagttttcggagcttccaccttcgacgtggtcagataccagtggctatcctcctccaccacctggttgacatggaatacacattttttttctttattctattttttctctttctttggttaaagaaagaacaaggctttcttctgtttatttattttaatttatccgtttttgcttttttagattatttggagtccagttcactgaatttttatgtggttttgggttaaactgttactatttgctgctgttatttgaataaatactatttgaagagtagggagtagggaatgggaggttggaggatgcatgataaaggctttaagcctttgaggtagatacgaatgg

SEQ ID NO: 4452 - DNA, 1437 bp, Glycine max
tccctgctcaattctgatcggtcctacacagttctcatgccccctttgtttcaagacgttcaacagatacaacaacatgcaggtatttaaaattatgaaaacattaattcaggatgtgtggtagacagaaagaagaaaaagaatgtctttcttttacccttttatcattatttttttctcctactagctatctcctactttcccagatcttacttttgtggaaatttgctgaaaaagaaaatgtccatttctatatatcctgtagttatagtcttcttttaatagtatatatcattactttaatttttaacatataagctatattgtcttcatcaattcatgaaagtacgggcacttgtgtgtgtattgtgtgtaatttagggcttttccttgtaacaactattgcatttcctttaattttattttattttattatcttaagctgatcttaactgttttaccatgccccttttgtagtcgaagagatgaaaatggaaaattccaagttcaattaaagatcgatgttatttaaggctatagctttttggacattgcaaagtgttaaattgtgttagatagaaaacgtgagggactgactatttgatatctagggcttattaaatcttagctaatatgctagaacaatgttaacagttaataccagcatgaggagacataaagtagtgaaacaacatcaatgaattaatttttccaagactctagtacaacgcatggagtgattattttttttcacctccacaaacaatgaacaaaaatagctgtccaatattcccttgttgggcttccgagctactactttattaggataccctacatggtcaccttttttctttagtcctagaccataggtgactaagaagtattgaaacatgtagaaaaagacgtggctccttgattatcctcttaggctttctgactcaaaatcttggccggcttgggaaaataattcttaatcctaacaaaattacatgcaatgcaacaaaggtggagtttgtatagggaatgtggtttcacagtgggacttttggaccatatcgatagttccaaatattttacttgtgagtgtgagtgaatgaatgatgagtgactttcattattcttttaaactaattaattaactatttttttctcttgaatgatattgcttccaaaaattaacctacagatgcatatgtgggggcatggatctcaatatagaaaggggccagagtctctaaggggaactcaaccaacagcaatgcttaggctcccttgctattgctgcgcaccgggatgcaagaacaacattgatcatccaagagcaaagccactcaaagactttaggaccctccaaacccattacaagagaaagcatggaatcaagccattcatgtgtagaaaatgttgcaaagcatttgctgtgaggggtgatggaga

SEQ ID NO: 4453 - DNA, 416 bp, Glycine max
acaacaacatcaacgttgttaatgttaatgatgaggatgttgtcgaagaggaagaagaagaagaagaagaggaggaggagggtgggagatcagtactagagataaagttgaggagagttcgcgggaagcaccagtgtcagagctgcgggaagacgtttcgatcttcacgcgcattgggcagtcacagaagcatttgcgaaggttcgggtaacgatagtaaaatcttccaatgccccttttgttccaaggtgtttgggtctggtcaagcacttggtggccacaagagatctcacctcatgccttcttcttccacaaccgctaataatgattctgttagattgaaagagagcttcatagatctcaacttgccagctccgcccgaagatgacgaccttagtgttgtttctgatgcctga

SEQ ID NO: 4454 - DNA, 371 bp, Glycine max
attcagagaagcctgtgagtcctgagatttcaagtgaagaaaatgatcatgatcaagaagatgacactggtggaaccaaacgctcttatgagtgcacattctgcaaaagaggcttcacaaacgctcaggctttaggcggccatatgaacatccataggagagacagggccaaggccaagcaattcacacttgatgcttcaccttcagttaacaaattcaataataacaacaatgattccatggcccttccctttgtctcagaaattatgaaccaacccacaaggcctaattactcccctttggagtctcagatgaactttcatccaccacatgccttttattatgaggtttgtaactcaaggtctcagcca

SEQ ID NO: 4455 - DNA, 1179 bp, Glycine max
gagtctatagcagaaagagatccttcacgttgttccacaggctttcttgaacggttccggccacggtgcatgtggcggtcgcagtacttctgacctgccaccgtgtccttcgagcaccgccacttcttgccgtcggtcctccggcaccgccccggctccggatccagtgcttctcttcgccagtagtaccctgattccaacactgatgtctcaaaacatgctcaaaatcagtactttcatcacaccaaattggagtaacttttaatgggcataatataaagcatcattgcataaaaaagaacctttcatattctactacacctcaaagtaaagtaacaactagaaaaatcaactataaatagcataaacttagatatagttttataactgcttttacacagtttccaatcagaaacagatttttaagttatagtgtgtttggatagttcctataatcaattttggacctcaaaatcatgatatataatgtgtttggattagatttatgataagaaataatcattattttttcatggtgacggcaaagcaactaaatagttgcttctaacatttcatggtaccaccatgatctcgaggaatagaattgattcttaggtgtcgtccaaacacactaatagaaaattgaaaaagttgagacaactatttgttgctttggcttcaacttaataatttgaagcaataaacataaatatttactaaaatgatattccaattctgattgataagaaaaaagaaacacatgaagctacgtttaagttttctctctacaactcacatatcaaaataaatgataaatgtgatgaaatattaacagttgatttacttattgagaattaatatggccactttattagacaaataattaggaagtagaaaaatggggttagaaatttacaattaggagggtgataaagttgaaggaagcttttcttgattggtagaaggagctcaggaggaacaggagcaccggccagcatgtacctgaatatcagagcctgcaactcaagctcttgccattgtgcaaagctgaagcaactctccattcctaatgagaagagaacaaaaaaatagaacctttgaaaaaaggatactatattataatataggccaatatccaagtttgcttgtttgtttctgttaccaaagagaacaaaagga

SEQ ID NO: 4456 - DNA, 368 bp, Glycine max
cgaaaccctcacaccaccaacaccggctcagcaacaacaccaccaacaccaacaacaaccgcaacaacaacaacaaccttcgaacccttcctcgctccccaacccgctacagcaacaacaacaacaacaacaacctacctccgccgagttcgccgactccggcgaactcggctctggcaccgccggcgaggagccggcgcgtaccctaaaacggccccgcctcgtgtggaccccacagctccacaagcgcttcgttgacgccgtcgcgcacctcggcatcaaaaacgccgttcccaagaccataatgcagctcatgagcgtcgatggtttgacccgcgaaaacgtcgctagtcacttgcagaagtacc

SEQ ID NO: 4457 - DNA, 492 bp, Glycine max
tttaagctagaatttgatcctccatttcggattaaggtaaattattagggttcaacagaaataagaacacttatatagttatattcatctacatatatatgtttgttctttcttcaccattcatgcataatcatttaatttgttatgcagaaagacgagcaacaattgcctgatttgcaactgggtttgagtcacacagttggaactgatggcaagatagatcattataaagaaaccccagaaatcagcaccaagctttcactttcttagagcttcgtaatgtcaataacgcaaatgctatagcctagctaatcataaaaatagagtgatgatatattgtccaaacatcaaaaataggtacacaaggatcaatattgtccctggttatataggacatgggcttgttagatatacatagtttttttttttttttaaaccccccaaagattttattggaaaaagaaatgggtccccccttattaaaaaaaaaaa

SEQ ID NO: 4458 - DNA, 415 bp, Glycine max
tgccttgcggatgcaaacaaagcaaataacttcttttttttacgagattctatagcaacgtgcatagaagtcaaggttttgatggcaaagattgaaaactgattttgtaccgatctacttaaatgaataatgaaggaactgaaactttgtaggttgtcaatgctacaattgtacagtgtatgttgtaatatggtagtctagaaaaatttcttcgttttcttcaagaattggctttcaaagtccaggttgattttctattcagattgtttattttcttgtttgggtaagtatggtacaatgaaagactaatttttggaatcagaaccagaatagaagtgagaatggggtgaattgaaatctattttgttttatttcaatctatttttatgttcggtgaattactgtggaagcttaa

SEQ ID NO: 4459 - DNA, 1030 bp, Glycine max
cttgtgtcctgctagacgcctgcgacaactgcgcttaccatcatcgaactcagctagcaaatgaaacctaatttaaaaacaaaacaaatggtgtaattcaatccataagtaacaatcaggttcaattcacaaacattaaaatcaaaatcaagaagatatttcacctgaactacaacagtcaatctgtgcttatataaattgattgattggaatttgatcaataatgtattgtcatttgtcacatccatttaaactacatttgttgtaggcaaagaaaactcttaaattattgtattaataggatccactagaagaaccatatgacagtaaaaataagagaagcactgcgagtctttgatttaagaaaaaggttctgtttttattttctttttttactaataattataaaaaaaaaataccttgtttgttttcatcttgtttcttgctctttaccttgtttatgttttcaataacaacatttcatttcatagacaattttttaaaacaaacaaagtaacacttttgtaagtaacagcaaaaagaaataacaccagagatgaaaaagatatttctttaaaccaaacaaaccctgatatttttaattgatttttttttatagcaaataatttgctcaacttttatttgtttctaaccaacaggattggagtacctcaccaactaaacaaaatataaggagcttacataaatgttgtgagttgaccacctgattgtatgaaaattgagaagtaatatatctatcaaataaaccaaaaatacctgctgcactgctgacaaaacctctgttcaattccatttacaataactttagctgttttggagtgagcatcacaaactttatgccttttgtggtaatcttttgaggagctaagatccatgttacaaccataaacttgacatacaggagcctgtgcaggcaagctggaagtgcgagctctcttccaaagtgtggtcggatgtatagatgttaaagtgaacccttcttttgcaactttatcactactgcacctac

SEQ ID NO: 4460 - DNA, 1112 bp, Glycine max
ttcaatccctcaaactgtagaagtcacccctcaaaccaaaaggccttcagcagcagcactgtccccagaagatctcacagatgctgagtggtattacttggtttgcatgtccttcatattcaacattggccaagggtaaaataataaatctctctaatttttatttttctttctagttttggaacatcaacttgtgttcccaaaaatggggtgttttattgttttttaatcttaagggtgagttagtttagttatcttcaaatctatgtgtgctgataggttaccaggaagaactctagcaaagggtcaacccatttggctgaacaatgcccattcttctgattgtaaaatttttagccgttctcttctggcaaaggtggattctgtttcttgacctggcttgttccatcttctacttttgtttgaaatctccaattattatactctagttgtttaccatgattaaaatgacagagaatctgaattgtgtcttctttgtttggtttttgttccataaacaaacctgtggcaattgtcttctctcatgctcagagtgcatccattgaggtaccatcttgttttttctttacttaatccgttaatcatccttgttttataatctcttacggtttttaacagttatcttagtgccatcaatgcaaagaaattagatgtgttagaacaggtgttccttttgaacctaccctatagtgtttagtctagaaagtcctgtaaaagtatgcatcttaattccatcttaattcctaagggtagcagtagacttgtagtttctgcaatggttgcttattatcttaaccaaggcaagactctttgtggccttttccatgcatgtagtttcaagtctaagactatgatgattaccaaaactaatttgtgtaaaatttaataggcaaagtctaatcaatgcaatgtgtaattcgtttccttgatttcaactttcagacggttgtgtgctttccgtttagggaaggggttattgagttaggtactacagaacaggtaagtttccaccttcatttaaacattaattaatttgactgttttgttatcctccctcattcatttaaccctttttctttgtgtgaaggtcc

SEQ ID NO: 4461 - DNA, 370 bp, Glycine max
gctcccctttagcacatgacgttgaacaccgatttcggagcaaaactcttgcacgacgctgtcatcattcttttgcatcctccacccgagtttctcagcgaagaccaacatcttgtctttctgatgctgggtaaatttggtcctgaagcgttttttgctgctcgacccagacccatcatgagtggtggcaccactcgtagggtctgagtcctccaggtcttccaaggggggctggggcccacctcctcctgacaaggacgggtgtgccagcatggcacgttggtgccccgtcatgtgtgggtaccccggcggggcacgatagtaagctgcaaatggcactgggggtggcagcggtgggtggtggtggtgg

SEQ ID NO: 4462 - DNA, 366 bp, Glycine max
cagcatatgacgtggcagcgttacaccttcggggacgagctgcaagactcaatttccccgaattagttgagacgctgccacgtccaacgagttcgaaacccgaagatgtccaagtggcagcacaacaagcggcggtgatgttcagaatatcaccaacaatgtcacctattaacaatcatcaaggatgtgtcaatgacaataacattattaagggtagtgtggttcctgtgagagtgggactctcacccacacaaattcaggccatcaatgagtccccattggactcaccaaagatgtggatggtgcaaatggcagaggcactcaggtttggtttcgatgatcactctatgatgatgctgccttctg

SEQ ID NO: 4463 - DNA, 427 bp, Glycine max
  misc_feature (421)..(421): n is a, c, g, or t
  misc_feature (423)..(423): n is a, c, g, or t
ctcacctcctacttctgcacaagatcacaagtgccaactcctccaaggagaagaacaacaagtaattccaacccacaattccttgagccacaccacacaatagttgatgttggcctagatgaagccacaatcatgaactaccccaagatgctctactctgaagccaaactaaggaaatttgattccacttcaacaagctgctccatatgtcttggagattacaaaggttctgatttgctaagggtgttgcctgattgtgaccatgtcttccaccttaagtgcattgacccttggttgaggctgcatccaacatgtcctctctgcagaacatctccaattccaacacctctgtcaactcctctggctgaagtggtccctttagcaaccaggcgagattaataaaaaaaaaaaaaaatagttnanacaa

SEQ ID NO: 4464 - DNA, 397 bp, Glycine max
gatcccgataatgctgaagctttggagggacttgacacccttgcaaatctagctatcctgggagagggtgaggcactcccagcatccgcccaggccacaactaagcatccacgccatagacctggctgctcttgcattgtttgcattcaacctcccagtggaaagggccccaagcataagcagacatgcacatgtaatgtatgcttaacagtgaagcgacgattccgtacccttatgttacggcgtgagaagaaacaatcagaaaaagaagcagagacaactcgtaaaaagcaacagcaacaacatcctctaccattaccttcatctgaaattttgcttgatgaagattccttgccctgtagtaacacaggtgatagtagcccaaaccagaacaaag

SEQ ID NO: 4465 - DNA, 404 bp, Glycine max
tcaaacatatctgacaaggcgaattggatgacatcagctcaactatggagccaagcaagtgaaggaaccaaaccacaatccacaattacatcattacctaaagaaggtgctgatattggctttagcgtgagcccgaagctagccctagacaacaaacataggaatgggggagcctttttaccattctcaaaagaacgaaactcgtgtcaaggattaaggggtcttcctgagttggcccttgcatctcctgagaaagaaattgaggaaaataagtgtgaattagaggcagagaaatgttcgaaaagggagaatccaggcaaaggagggagttgtgaaggggttaatgttgatcagggaaaaagtgcttcagttgcatctgaggcacaaacagcaaatactaccac

SEQ ID NO: 4466 - DNA, 396 bp, Glycine max
aagggcagcatttgaggaagaaatagacaaactttcccgtgagaaaaattctcttgaatccaatattcgtaacttcaaacaacatcagtcaacagcaaagcctaagctagaagattttctgcagcgattagatggtgttgacaagaggcagaaacaattgctgaacttctttgagaaggctcttcagaatcctactttcgttgaacatctttcacgcaaaattgagtccatggatttatctgcatataagaaaaggagattgcctcaggttgatcacgtgcaaccagttgccgaaagtagcttggtggacaatcatagcaattttagaatggaatttggaaatgttttccggcaagatttttcgaataaactcagactggagttgtcacctgctgt

SEQ ID NO: 4467 - DNA, 219 bp, Glycine max
ccagtttgatgaagagttcctaagagatattctgcagcagccagaagagggcggtgaagatctgaaaaactcatcgatcatgtcgtctctatttccaacaacttatatactgtccttcgacaaatccgctgctgaattgttaccaactgaaactgatcatcgtgattattcttcttcccaattgccctcatcatcaaattcaagggccaaccatggaac

SEQ ID NO: 4468 - DNA, 554 bp, Glycine max
ggggtgtttcccaccggggagaaaggaggctcacaagcgaacaagttcagttccttgaaaggaactttgaggtagagaacaagcttgaacccgaaaggaaagtccaacttgcaaaagagcttggcttgcagccaaggcaagttgctatatggttccaaaaccgaagggcaaggttcaagaccaagcagctagaaaaagactatggcgtgttgaaagctagttatgacagactcaaaagtgactatgaaagtcttgttcaagagaatgacaagttaaaagcagaggtaaaagaaattaagaagaaaaaagagagagacacacacaacacatacttacactcaattttgcttttgtgctttatgctactagtactacttgctttaataaagtgcaatctttattatttatcccactaatgggttaatgattggattggcacaaaatttttgttactgacaggtgaattctctggagagcaaattgattcttagagataaagagaaggaggagaattcggatgacaagtcatctcctgatgatgctgtcaattcttc

SEQ ID NO: 4469 - DNA, 1199 bp, Glycine max
  misc_feature (932)..(932): n is a, c, g, or t
  misc_feature (969)..(971): n is a, c, g, or t
  misc_feature (1009)..(1009): n is a, c, g, or t
  misc_feature (1142)..(1145): n is a, c, g, or t
ctgtgctgtttgcatgctgtccagcagtaccacctcctggtatgatgcagttttttctcctctctatataattgtgtaggttatttgaaagttcaatttctacctgtgatttcaaatcaactgatcatgaggcagataaatcagaaacactcgtgtgtgacaggcacagaaatggcccagttagtatgtggaggttgccatactttactcatgtacatccggggcgcgacaagtgtgcaatgttcttgttgtcacactgtcaatctagctttggaaggtattgtactattaattgtctctctgaggtttaaggaattgtgttgtgtgtgtgcgcacgcgtgcgtgcatgatggacagactttaagacatgtctcttgtgagctaagtgattgtgatttcaagtccctattttgggggtaagcaataagcatcaggtgtgtatttgtgacagcaaatcaggtggcacatgtcaactgtggcaactgcaggatgctactcgcgtaccaatatggagcaagatccgtgaaatgtgcagtttgcaattttgtaacatcagttggggtcagtgtaatctcttgtccctcacttactagattttctttaaactgtctctagtcccaatcatattgagaaggttcctgcaggtgtatgtgtgtgtgccagaagagcatttctctctattcattttggaagagtagaaatagacttgtgtcctgtctggataaatttctccgtaatcacttataggaagagaaaaaaaataagaaagtaaaatgaattgaccttcttccataagttaaaatcaagttatgcacttcattttcataaaagctctttatgtttgacttgaagttaaggtgcataagtcgattttaacttatgaagaagttcaatgtatttcattttcatataagtatttatgaacaagtttntcccatcaaaactttttaatggttatcaaataagatnnnattttttttaatttaattaataaatagaaggaatgatnatagaaggaatttctccaatctgagaagtgtttttaagggtgagcaaaaattagaactacagaattttagtgatataagcaatgatttacactggtgttactaaatgatgcaggccacagcaagcaccactgnnnngaagttcagcacttaaaacatacaaaatagcgaggtcattatagactctacaac

SEQ ID NO: 4470 - DNA, 476 bp, Glycine max
gtatccagatagaaccacaaaagaaagcttggcacaagaacttggacttacttatcagcaggtcatatcttttagtttttcactttcagtgaacacattttatttttctcgtgactttctgaatttaccattctttttcactcaggttgccaaatggtttggcaatacacgttggagcttccggcattcatcacaaatggaaaccaattcaggtataaatgcttcacagcaagttactgatggcagagctgaaaatgagggggagaaggaatgtgaattaatatctctggagttcagtggagaaaaatcaaaaaccccaaactctagaaaaaggaagcatttgtcagaacccctatctgaagcacagctggatatcaatggctcagcagcaagttcaccaaatgttcatctaacgcaaataggcaataaaatgaagacaaggaaaaggaaatgatgcttagttgagaagtcgggtt

SEQ ID NO: 4471 - DNA, 406 bp, Glycine max
cctcgactcttcctctcccccgtcaccgccaccgccgcttgaccttaccctaacccctctctccgtggccgtcaccgtcttcccggtggctcgtccggttctattctttgacgcgttcgcgcgtgcggacgccatgatcgccgtctcccgccgcgagatgtgtggctttgaacgccccgccgctgatttccgccgtaacgactccgattccgattacaaccgccgcgtgctccttgatcttgacctgaacgtgcctcctctcccggaggttgcctgattcatgcagggagatctggttttccgcaatttttttcgtactacttttttaagcatctgggaacactactacgcatttttttgtgacgaaattgccctcgagaaattatagtgttacggagagggagca

SEQ ID NO: 4472 - DNA, 560 bp, Glycine max
cttcaacatcaaccatcctaccaggatccaaacctccctaggcctcctccgcttccaaacaaccaaggtataccttttcgttttattccatgtctagcatgatgttttttcttgtctatgatgctatgggatcgagcatgacatatatatgcatctgtttatgtcagtttcttttttgtatgtgtgtgttttccctgagtgttagatacatcacacatagacgtatttttagatctgaaataaaaatctgcaggagtgaagttgaaggctttgactttgaacactggtcgagtacggaagaacgtgtacagaggaataaggcaaaggccatgggggaagtgggctgcagaaataagggacccacgtaagggtgtgcgtgtgtggctgggtactttcaacactgctgaagaagctgctcgtgcttacgacaatgccgccaagcgcatccgcggagacaaggccaagctcaactttcccgacagcaagaacccatgtcttaatccctttcaactcaaacacctcttttccaacctcgaatccttccttggtttggactcgct

SEQ ID NO: 4473 - DNA, 785 bp, Glycine max
  misc_feature (756)..(758): n is a, c, g, or t
  misc_feature (773)..(774): n is a, c, g, or t
ctgactctggagttctatcacaggggtggctgggaactacaatggtgccttacaagtggtacatatttactatgttaaagtagtttaattaacttgcaagcaattagagatataaggctgattgaataattaagagaagaaaaggaaggagcagaaggtcgcgggttgaacccctcctactagtaaaactaacattttaataactaacatttgtaaaaaataaaaaaaatacaaatgaacctattgtttgtttctgcagatgacagcagaactacaactacctacaccacttgtgccaactcgcgagagttattttgtgaggtattgtaagcaacatgcagatgggacttgggcagttgtggatgtttctttggataatttgcgcccaggtccttcagccagatgtagaagaaggccttctggttgcttaattcaagaaatgccaaatggctattcaaaggtatcagacactaatataatatacatggtagttttgtacatgtttgtcttttatttgtatttttcttcaaaggtaaggttgttgaaccagtgacaccggttacactgacctttcctataaccttgtgcactaggccgtaccttttattttatttttttctgttaatttttttttatctacaaatattcttagttaatgttggcttagtctgtaatctctatttattaggtcacatgggttgagcatgtagaagtggatgatagaggtgttcacaatctttacaagcagcttgttannnctggacatgcatttnntgcaaaacgtt

SEQ ID NO: 4474 - DNA, 364 bp, Glycine max
catttaacaacttggagtgctaataatatccgtagcgaatcgtcggataatctattgagagatgggacattagaggactgggattcaggttttgatcaatttcgtgcaagctttcttggatttctcgcccaattaaataattttgccgggtcttcgatcatgatgtacacagatcttagacaagccattcagattgccaagaagaattatcatcatagatctaattctcaggctcaagatggtcagtggaattctctgtctcaagatgataattccatgtctcaatcttgagttgccaattctgaaaagaaaatcccaaaacaataattgagtttcataggttgcattaaacatggtggagttg

SEQ ID NO: 4475 - DNA, 385 bp, Glycine max
cagtcccaccaaggaagctcctcacccgccgctccgccgccgtccacgacgtctccggcgacatgttttccgatgacaccctccggcacaagtaccttccccacaatggctccaccgactcctccgacgatgactccggcgacccctacgcctccgatcaattccgcatgtttgagttcaaggtccggcgctgtactcgcagccggagccatgactggacagactgtccatttgtacatcccggcgagaaggcccgccgtcgggaccctcgccggtttcattactctgcaacagtctgtccagagtttcgccgcggtcagtgtgaccgtggcgatgcatgtgagttttctcatggggtgtttgagtgctggttacacccttctag

SEQ ID NO: 4476 - DNA, 873 bp, Glycine max
tgacaaggacactcctgaccgttggtacaatgttgctcatgctgttggtggcaaaactccagaggaagtgaaaaggcactacgaactccttgttcaggatgttaagcatattgagtctggacgtgtgccattcccaaattacaagaaaactacttcagggtcaactgatcaggaggaaaaaaggtatcattccctttatacatttgtgtttgtttgatccgtataagaatagaaggcagatattaagaaaagttgataacaacgcaccttacttaaccatctgagttacatctttaatcttatacattaatagtgtcatattcctacatgttgcttttcaaacaatgctgctatctctgcacagaataatctttttcccacaagaaagcagaagtttatgcaatagttaaaattaagcaaatgctaaccaaccagtttccttggagtaatagttaaggaagtagaattaaagagcaagtttttattttttattattaaaatatgtaaaaatacgttctcttatgatttcaaaatatactctcacattatttttaataaaacatttctgcttttaactctttccataccgggtgctcctaactgattagtaagacccttaaaattatgcctaacaactatgcacccgacaaatttatttgatcttcaagactctaatatttgattttctttctttcaggctgaggaatttgaatttgaacctccagtgacccccctcaagaacaacaaattgattttctaattttcatatcaaccaacatcattaatttccagcatccctggtagtactacgtggtgttatgtcacacataattgctagtgcaatagcatcttaggctatattagtcatcataa

SEQ ID NO: 4477 - DNA, 781 bp, Glycine max
gcgctagctttgttgcatttccatgtagagaattagctaaatgttctgccaagttggtggtagctgcagctgtggtggtggtgttattagccaagtgtgattgtgtggcagaatttccaatgatagggaagaaaggtgcatgaggcattggcatgggtggtatttggtttggggaaccaaacatctgaataagtctgttgtctgtgatagcagaaagtggtggaataggtagctgtggtggcctgaatcccatcatgagtggccataacccacttcccattgacattatctgcatcatttcatttcatatatttaacacattcattcattcaaattctaatatttgtaaattaaggccaagtctaggaaaacatatataatttgtacaacagaaatgttggacctgaaaatttgcctgtaactgaagctttagggtcttcagatagtcgatggcatcgtctagcattgatgctttgtccacctagagacatgtacaagacactacttagtgaaaaacaagtgcaagaaagtttaactagaaaaactagatatactgcttaattacaaagttggtaataacgagaacttattagatagtctgagactattatatattcatctatcttcttggctaatctctacaaatatgtacgtagtcgcgttttttaatttataagaaattaagaatcaacttgactacatatcaaagtagagattagtcagaatcatgataataaaaaatcatataataatttaatttctagctggtaacacagtagca

SEQ ID NO: 4478 - DNA, 328 bp, Glycine max
ttttttcgggtttcgggtcgggtaatttcgtccccgaattctccgattttccgagcttcgatgatttcggccacgatttcttcgtgcatgagcttccgggtttcgattacggagaagagaacttggatgggttgataattcaggactcgttcctgtggaatttctaagcgggtcggggttaggataattttattatatcccaaccgtgtttagaattcggatcggatccggatttgggttggtcaatttttgtgagaccatgccctctgtgttagtagttagtgatggtaatgttttttttatgtacctagtagtcaaggtttcgaaa

SEQ ID NO: 4479 - DNA, 677 bp, Glycine max
ttattaccgtcaattcttataataacacttgcaaatagagcattatcaactttcacctttcataggtatagtaaagtgatcattcagggaatagaagcctgatcaggtaaaggcacaatcaatcatcaggttgattatgctgtttgattgattttaaaatgttatggactcatatatatatatatggtgcttataaagagtacttaattataagtggcttttgcaggttgaatgtacagtactcatcagcaacatcaaggaaagaacattcactcttcttcttcttcttccagaatgccaatcccttctgagaggcatatgttccttcaaacaggaaatggctctggtgattctggacttgttctctcaactgatgctaagcctagattgaaatggacacctgatcttcatgcaaggtttatagaagctgtgcaacaattaggaggagctgacagtgagtatatactatatactatatactatatactatatactatataataaaatacacatccatttgttgatcatcaaatcttgaactgaagagcatagaactttagatctaattgactaattcaaagtgcaaaatttatactgcagaggcaactccaaaaacggtaatgaaactcatggggattccagggcttaccttgtatcatctgaagagccctctccag

SEQ ID NO: 4480 - DNA, 412 bp, Glycine max
cttatggaacacccacttgaagaagcgtctcaaaagcatggggcttgaccccaaaactcatgaaccattggcctcatcaacttacccttttcacaaggcacctgcatctgtctccacacgccacatggctcagtgggagagtgctaggctcgaagccgaggccagactctcgaacgagtcgtcaaggttcagccacaacaccaccaacaattccaactctgataacaacaaaaccactgattctgactactttctccgcatttggaactctgaagttggagaggcatttcgcaatgttcatcatcacaaagctgatgatgacaacaacaacaacaaaatcactactaatactcctactagttcctgccacagtcctctttctacagggtcatcttccaacaagtgtgagtca

SEQ ID NO: 4481 - DNA, 1032 bp, Glycine max
gacttgactagtcagattgacaaaactcgatcaagtgttgagaagttggagtccgatttaataagcctaaggcagtgcatcagtgaaacaacttcatcaattttggaaatgatagatgaggagcttttgccccagctggttgcattaactgcggggtatatttctcagaattggatgcattagacattttccaacttaatgatgtgttaatattaatctaattttcacaataatgtttttctattagtaaaatgtttgaagaaatatactccctctgtctcatttatttgtcacttttggaatattgttttctcaaatcatttgtcactttagaatatcttgaaagtatgaattacttttttttctttctaatactacccttaagaaataaatgcagtattagatctatggccgtgattgtgcaatgtagttcataaatgtatcatcagagttggtataatgcatacatcttaagaaaataatttcttaaaataaagaaaaaactaaaattaaatttataatgtaagtaaccaaggaacaaaagattgataatagtaaaaaaaagagagaggggaggttaaaaaaattccttgttgaatttacctgataaaaaataaatgtctattgtcgttttctcatgccctatggtgaaggtcttctaaatacatatcgagtaacttaggtgtcatatattggaaacagttaaacagtgtaataattataactgaatcatgtcctgggttgggttttgctttaacctcttgattgttttgtaggttgacacaaatgtggaggacaatgcatgagtcccataaagcccaagcactcatctcccaacatttgagtaacctcagtgataatcataacacgatactaaattctggatatcatcaccaggctactattcaatttgagactgaggtttcttatttgtataatagcattggcaaacttgtaaaatttcaacaatttgagactgaggtttcttattggtataatagctttggcaaactgtaaaattcaacgggagta

SEQ ID NO: 4482 - DNA, 226 bp, Glycine max
  misc_feature (221)..(221): n is a, c, g, or t
accgcaagtcaagtcggcaacgacgcgcgtccctctttccctccaaaaaccaaaaccttcgtccctctaaaataaaaaaaaatgaaaatatttttattttcctataatttttaaaatgatataaaaaaaaacaggcatagtattagtaagtagtatgataattgtagaataattaatttggaaatgtaaaaaaaaatttggtgtttccgatagtagtagtngtagc

SEQ ID NO: 4483 - DNA, 1235 bp, Glycine max
cggggtctcctgttcctctcgatctcgtgttccccattcagaacagcttccactctactatctcgctctcgcacgctttctttcaccatcccacgtgtgagttctccaggaacttgttttgctcatgttttcctattttcatgaacaatgttagatttacattgttttttatttattttagtttttatctgaagatttgatttgattctataatcggcatttgttagtgattgattatttcttaaattttttggtgaactcaagtaaagattccatttttgtcaatgcttttcttccaaccctaatgactgcatattgctataatagcccttccttcgtccccgaatgaccctgataggccagggactataccaaaggagatggacctgcaggatacaggaagcagcagttacccaagcacccgaaggacgtgtgaagaaactctaaattctgttagaagttggattagctgggcaagataggactggtagcacctagtaggagactatgcttgttagaataattcggttataggagaatttgctgatttggttgttttctgttgtcaagttaaataaggaaaagaaaaaccagaaacttttactttctgcagtggcgaagagaatgaaaattgcacttatccacgggaaacttaaaacctttatgcaaggaactgaaattctgaaaagccttataactacccactaaagctacaccacgatcataaactgaacaacaattaaaaaaataaccaaatctaaataacagtaaatatttaaaaacctttgacttagtaacgagtaacaactactccacatcagcagtcttaaacgcatcatctaacactagctatgtatactttcattttgtctttactgctgccaaatgaatgtctcttgttcattaaggtctggggtggtgtgtttggaatgttggtaataaagtagctgtgcatgactaactttgcagtgagttactgttccttctatgggaagaaggtggaccctgagccaggacgatgcaggaggactgatggaaaaaagtggaggtgctccaaggaagcatacccagactccaagtactgcgagcgccacatgcaccgtggccgcaaccgttcaagaaagcctgtggaatcacaaactatgactcactcatcttcaactgtcacatcactcactgtcactgggggtagtggtgccagctaaaggaactgtaaatttccaaaacctttctac

SEQ ID NO: 4484 - DNA, 374 bp, Glycine max
gctctccgatcccatgtcatggaaatcgccaacggctgcgacatcatggagagcatcaccgcctttgcaaggcggcgacagcgcggtgtctgtgtgctcagcggcagcggcactgtcaccaacgtcacgctccggcagccggcctcgccgggagcagttgtgacccttcatggaagatttgagattttgtccctgtccggttcttttctgccgccgccggccccacctgcggcgtcaggactagccatatatctggctggcggacagggacaggtagtaggtggaagtgtggtgggaccccttgtggcctcaggtcccgttgtcatcatggctgcttcatttggtaatgctgcttatgagagactgcccttaga

SEQ ID NO: 4485 - DNA, 324 bp, Glycine max
cacaccagccacaggttggcatgcctcctcccccctctggacagaagcaccctaagttcatggacttcaatcagcagaagtagctaataatagttgtagcagtaaatgattgattacatgcaatattcatcacaagtaacatcctgtgcatatgaatgtataactaactggtgagacttgtgaaggatatattgtgcagttcagtgtctttagtcatgtgttgtttatctttagttctaggatatgtgtactttctgcagttctaggtgagaagcatagcctttgaaatgtaagcgtcatagctcttgggtgaatgagggtaac

SEQ ID NO: 4486 - DNA, 688 bp, Glycine max
cagtttggatttgctatgcctttgtttcggtttgtgttctgatttttcttcttccatgccatgttttcccttctcggatcttttgttttgttagtcaaagcaaaaaaatttcctatatgaagataattttccaaggccttacacacattttgttttaattcgtttttcattaaattcatttgaaaattgtgaacgctaaaagtcttcttcctttgtgtctacttttttttttaattcctcattggagtcgcaaaggagactcttttctatttttgggtgttgttatgttaacttgactactctgttactgatttggtgagttgaattgaatgtgaaaggggtttagagtggatgctgaatggagatcctatttccctgggtgcttctgactcacaatggcagtctctgatgcacaataaagatggaatgaccagtgttagttcctgtaacaccaccgagtctcagtatctgaattcattagcactatataactctggactagaacaacagaatagacgccatcctttgttcctgaaccctcttgttgttcccatggaaaatctccaaccggagaaaccaaggggttttattgatgcttggtctaacgctgaaagcaatgccaacaccaacaccaccaacaagaactctgctgcatcaattggtaaattatccctttcttctcttgatc

SEQ ID NO: 4487 - DNA, 778 bp, Glycine max
tggcgctagctttgttgcatttccatgtagagaattagctaaatgttctgccaagttggtggtagctgcagctgtggtggtggtgttattagccaagtgtgattgtgtggcagaatttccaatgatagggaagaaaggtgcatgaggcattggcatgggtggtatttggtttggggaaccaaacatctgaataagtctgttgtctgtgatagcagaaagtggtggaataggtagctgtggtggcctgaatcccatcatgagtggccataacccacttcccattgacattatctgcatcatttcatttcatatatttaacacattcattcattcaaattctaatatttgtaaattaaggccaagtctaggaaaacatatataatttgtacaacagaaatgttggacctgaaaatttgcctgtaactgaagctttagggtcttcagatagtcgatggcatcgtctagcattgatgctttgtccacctagagacatgtacaagacactacttagtgaaaaacaagtgcaagaaagtttaactagaaaaactagatatactgcttaattacaaagttggtaataacgagaacttattagatagtctgagactattatatattcatctatcttcttggctaatctctacaaatatgtacgtagtcgcgttttttaatttataagaaattaagaatcaacttgactacatatcaaagtagagattagtcagaatcatgataataaaaaatcatataataatttaatttctagctggtaacacag

SEQ ID NO: 4488 - DNA, 484 bp, Glycine max
acagctcagattcttccactgccctcatgacaatttttccatcatcatcaacaggtgcttaattaattcattcacactttttaaatattggtttttgttttttaaaattcagacacagatccaagatccatgttttatgttggttatactaataatgatgatgtctgatttaatttgcattggtttagaggaacatagtccgaggaacagccaccacatgtatggcagggagttccgatcgatgttggacggactcgacgaggaagggtgtgttgaagaaccggggcatcaatctgagaagaagcgtcgactaagtgtggaacaagtgaaggctttggagaagaactttgaggttgaaaacaagcttgaacctgagaggaaggtcaagcttgcccaagaacttgggttgcaacctagacaagtagccgtttggttccaaaaccgccgagccagatggaaaaccaaacaattggagagagattat

SEQ ID NO: 4489 - DNA, 364 bp, Glycine max
cgaagaatctttgtttcgtttgcagtttgggtttgcacaacagcaaagattgcagctgcaacgtttccaacgctgtcactgtcaacaacaccactccttcttctgctgctgctgctgctgcttatgatttcttgggcatgaaaaccagcggtgtttgggattgcacccgcttggaaatgaaatgaaaattcaaccaaattatatcaattagttagtgttgttggagagaagtgagagaatgaaattcgtttatttttgaattttctctcctattttttcttttttttcttctcttatttgtataaataattagtcgctgatatgcataatatatagtaacggtacagttgaacattattgccca

SEQ ID NO: 4490 - DNA, 929 bp, Glycine max
tcatcatcatcgtgagcccacattgaagttaggattcggaactgtggatttgaatccgcaccatcatcaagtacaaggtgttccaagaagcttcattcaccaccacctccaacctcacatctatggccgcgatttcaaacgaagcgcaagagtcgttcatggtgtcaaaagaagtgtcagggctcctaggatgagatggaccaccaccctccatgcccattttgttcacgcggttcaacttcttggcggccacgaaagtaaattccattaatatagttcatgtttgattcagttaaatccgtcgctaaaacttgatgaaaatagtcactaaatttggttactaatccatccattattgattcttagtggtgttaaaagaaaaatcgttttttccttcttcttttctgtaattattttgaaaaatcttgtgatggttgaacatggtctaattaattattacgctatgtatgaatggtttgatggtttctttattattgtatgcaaaagctagattcttttgagataaagcatatataacatttagattacgtctaatcttgagtttgtcttctcacacttgcaggagcaactccgaagtctgttttagagttaatgaatgttaaggatctaaccctagcacatgtcaagagtcacttgcaggtggggtactcactattcattcccatatgtctctctttctccatagtctttgagcttaatgagtgaagttcagttgtttattcctctttcaattaatttctgactagacagaacaagagagagagagagagagagagaggagtattgttgttagtcgttatagctaggttgcctctagtagtggggaaggtagaaccaaaggctagggacaaaaggggtatctaaaaatataatgtgataatcttagcctttgtggacttttcttctca

SEQ ID NO: 4491 - DNA, 380 bp, Glycine max
atcgtgccgcttgcggtggtgcaaccagctgtctccggaggtggagcgccggcctttcacggcggaggaagacgaggcgatcctgaaggctcacgccaggttcgggaacaagtgggccaccatcgcgcgcttcctcaatggccgcaccgacaacgccatcaagaaccattggaattccaccctcaagaggaagtgctccgagcctctctccgagcctcggcctctgaagagatccgccaccgtttcgggtagtcaatccggatccgatttgagcgattcgggtttacccattattcttgcaagaagcgtgagcgtgacggtagctccctctaaccaccttgcggaaaccgcgtcttcttcagtaactgatcctgccacgt

SEQ ID NO: 4492 - DNA, 251 bp, Glycine max
ttttgttgctctccatgcaattgtgaaccatatggtataacacatagaaggactttgaagaagtagaagtggggagggggaagttgaattttgttattctttattttattttttttgttatggactggaatttgaaagcaccttcttgggatttggtggatcatgtggataaggcaacaaccttacaacaaaacataggaacaaaggaggagcaaaacagatttggagtttatagaatgaaaggggagttt

SEQ ID NO: 4493 - DNA, 1032 bp, Glycine max
gaatttattattctatgatttgctatttttagcgtcttttttattagattggtattgggcattgtaggtggatttgacaccgctcatattgctgctaggtaaaactttttggacatagtttaaatattctttatcgtttgattggtgtcttccttaattgacttggaattttcaaatttagggcctatgatcgagctgctattaagttcaggggacttgatgctgatatcaattttgatctcgttgattatgaggaggatctaaaacaggttggaaaacgcataagcttttggtgaatttgaatctagatggaacttgtgattggttttttactggtttgttattgtttatgatggacagatgaagaatctttcaaagcaggagttcgtgcacatacttcgccgccacagtaccggtttttcaaggggcagttcgaaataccggggagtgacacttcacaaatgtggccgttgggaagctcgaatgggacaattccttggcaagaagtgaggacctacttttttttatgtttactataactgatgttgtggtttgttatgtttgtaggattagatattagtacgaatcattagatattagatattagtacgaattcaagtacctattgatttcagtttttacctattggcataactgaagtacgaattcaaagcgaattgttttcggtttggtagtcaatggatctttactcttcaggctttttccatgtttggaggaacatgtctaggatgcctgtttcaaagaaacaattggcggaggtgtttttgttgttatagagattgcaatgctttcgtgcaggtatatatatcttgggctattcgacagcgaagtagaagctgcaaggtcctaatgatacatgaattacattctacttgcactgatttttttaccctgaattatcaaagctctttacggttccaaccaatatatgtctcccttttgattttctggaaatcagggcttatgacaaggcagctatcaagtgcaatagaagagaggctgtcactaact

SEQ ID NO: 4494 - DNA, 380 bp, Glycine max
cttggtgttggcggagtcgcaccgcgggcaggggaggttctctggctcgaccggcggcgccgccaccgatcgatgcggcttgctcgctcggcggctctcgccggaattcgacgacggcatttgttaaagtgaaaaattttagtttttttgttttgggttgagtgtgatatgtgtgaggagtttttggttgtgaagggtgggtgagggggattttatgggagaaacagattaagagagagaagagagtcagagagaatataaacagagacatcttctgaggtttatatgagacagagtgagatcagctttacagtgttctgttaagcacgacatttcagtcggctgcgccttctccacacacaacaccaaccactcactta

SEQ ID NO: 4495 - DNA, 1359 bp, Glycine max
  misc_feature (265)..(265): n is a, c, g, or t
  misc_feature (268)..(269): n is a, c, g, or t
  misc_feature (272)..(280): n is a, c, g, or t
  misc_feature (282)..(306): n is a, c, g, or t
  misc_feature (309)..(317): n is a, c, g, or t
  misc_feature (319)..(335): n is a, c, g, or t
  misc_feature (344)..(345): n is a, c, g, or t
  misc_feature (347)..(352): n is a, c, g, or t
  misc_feature (363)..(369): n is a, c, g, or t
  misc_feature (374)..(380): n is a, c, g, or t
  misc_feature (386)..(388): n is a, c, g, or t
  misc_feature (390)..(391): n is a, c, g, or t
  misc_feature (394)..(396): n is a, c, g, or t
  misc_feature (400)..(403): n is a, c, g, or t
  misc_feature (405)..(406): n is a, c, g, or t
  misc_feature (414)..(414): n is a, c, g, or t
  misc_feature (416)..(418): n is a, c, g, or t
  misc_feature (421)..(435): n is a, c, g, or t
  misc_feature (438)..(444): n is a, c, g, or t
  misc_feature (453)..(456): n is a, c, g, or t
  misc_feature (459)..(462): n is a, c, g, or t
  misc_feature (467)..(471): n is a, c, g, or t
  misc_feature (473)..(475): n is a, c, g, or t
  misc_feature (479)..(483): n is a, c, g, or t
  misc_feature (488)..(492): n is a, c, g, or t
  misc_feature (496)..(496): n is a, c, g, or t
  misc_feature (501)..(501): n is a, c, g, or t
  misc_feature (503)..(503): n is a, c, g, or t
  misc_feature (508)..(514): n is a, c, g, or t
  misc_feature (516)..(518): n is a, c, g, or t
  misc_feature (527)..(533): n is a, c, g, or t
  misc_feature (535)..(539): n is a, c, g, or t
  misc_feature (542)..(545): n is a, c, g, or t
  misc_feature (548)..(568): n is a, c, g, or t
  misc_feature (573)..(576): n is a, c, g, or t
  misc_feature (578)..(578): n is a, c, g, or t
  misc_feature (583)..(591): n is a, c, g, or t
  misc_feature (599)..(606): n is a, c, g, or t
  misc_feature (613)..(614): n is a, c, g, or t
  misc_feature (617)..(619): n is a, c, g, or t
  misc_feature (622)..(624): n is a, c, g, or t
  misc_feature (627)..(627): n is a, c, g, or t
  misc_feature (631)..(639): n is a, c, g, or t
  misc_feature (641)..(660): n is a, c, g, or t
  misc_feature (663)..(667): n is a, c, g, or t
  misc_feature (671)..(673): n is a, c, g, or t
  misc_feature (676)..(678): n is a, c, g, or t
  misc_feature (681)..(681): n is a, c, g, or t
  misc_feature (683)..(689): n is a, c, g, or t
  misc_feature (693)..(695): n is a, c, g, or t
  misc_feature (702)..(704): n is a, c, g, or t
  misc_feature (706)..(709): n is a, c, g, or t
  misc_feature (713)..(728): n is a, c, g, or t
  misc_feature (730)..(732): n is a, c, g, or t
  misc_feature (736)..(741): n is a, c, g, or t
  misc_feature (745)..(748): n is a, c, g, or t
  misc_feature (753)..(755): n is a, c, g, or t
  misc_feature (757)..(773): n is a, c, g, or t
  misc_feature (777)..(778): n is a, c, g, or t
  misc_feature (780)..(782): n is a, c, g, or t
  misc_feature (784)..(788): n is a, c, g, or t
  misc_feature (790)..(790): n is a, c, g, or t
  misc_feature (792)..(792): n is a, c, g, or t
  misc_feature (795)..(803): n is a, c, g, or t
  misc_feature (808)..(827): n is a, c, g, or t
  misc_feature (829)..(833): n is a, c, g, or t
  misc_feature (835)..(835): n is a, c, g, or t
  misc_feature (837)..(850): n is a, c, g, or t
  misc_feature (852)..(853): n is a, c, g, or t
  misc_feature (855)..(860): n is a, c, g, or t
  misc_feature (863)..(863): n is a, c, g, or t
  misc_feature (865)..(869): n is a, c, g, or t
  misc_feature (871)..(871): n is a, c, g, or t
  misc_feature (873)..(878): n is a, c, g, or t
  misc_feature (888)..(888): n is a, c, g, or t
  misc_feature (892)..(892): n is a, c, g, or t
  misc_feature (899)..(901): n is a, c, g, or t
  misc_feature (906)..(908): n is a, c, g, or t
  misc_feature (913)..(914): n is a, c, g, or t
  misc_feature (918)..(921): n is a, c, g, or t
  misc_feature (923)..(933): n is a, c, g, or t
  misc_feature (937)..(941): n is a, c, g, or t
  misc_feature (947)..(963): n is a, c, g, or t
  misc_feature (965)..(982): n is a, c, g, or t
  misc_feature (984)..(993): n is a, c, g, or t
  misc_feature (998)..(1003): n is a, c, g, or t
  misc_feature (1008)..(1012): n is a, c, g, or t
  misc_feature (1014)..(1016): n is a, c, g, or t
  misc_feature (1020)..(1022): n is a, c, g, or t
  misc_feature (1024)..(1028): n is a, c, g, or t
  misc_feature (1032)..(1041): n is a, c, g, or t
  misc_feature (1043)..(1051): n is a, c, g, or t
  misc_feature (1053)..(1059): n is a, c, g, or t
  misc_feature (1061)..(1063): n is a, c, g, or t
  misc_feature (1069)..(1075): n is a, c, g, or t
  misc_feature (1077)..(1083): n is a, c, g, or t
  misc_feature (1085)..(1090): n is a, c, g, or t
  misc_feature (1094)..(1100): n is a, c, g, or t
  misc_feature (1103)..(1106): n is a, c, g, or t
  misc_feature (1108)..(1113): n is a, c, g, or t
  misc_feature (1115)..(1115): n is a, c, g, or t
  misc_feature (1117)..(1117): n is a, c, g, or t
  misc_feature (1119)..(1129): n is a, c, g, or t
  misc_feature (1131)..(1141): n is a, c, g, or t
  misc_feature (1148)..(1149): n is a, c, g, or t
  misc_feature (1152)..(1152): n is a, c, g, or t
  misc_feature (1154)..(1154): n is a, c, g, or t
  misc_feature (1156)..(1156): n is a, c, g, or t
  misc_feature (1162)..(1165): n is a, c, g, or t
  misc_feature (1168)..(1170): n is a, c, g, or t
  misc_feature (1173)..(1175): n is a, c, g, or t
  misc_feature (1178)..(1180): n is a, c, g, or t
  misc_feature (1182)..(1189): n is a, c, g, or t
  misc_feature (1192)..(1203): n is a, c, g, or t
  misc_feature (1205)..(1214): n is a, c, g, or t
  misc_feature (1216)..(1221): n is a, c, g, or t
  misc_feature (1223)..(1227): n is a, c, g, or t
  misc_feature (1230)..(1232): n is a, c, g, or t
  misc_feature (1234)..(1247): n is a, c, g, or t
  misc_feature (1249)..(1254): n is a, c, g, or t
  misc_feature (1256)..(1272): n is a, c, g, or t
  misc_feature (1276)..(1284): n is a, c, g, or t
  misc_feature (1286)..(1306): n is a, c, g, or t
  misc_feature (1308)..(1326): n is a, c, g, or t
  misc_feature (1328)..(1337): n is a, c, g, or t
  misc_feature (1340)..(1342): n is a, c, g, or t
  misc_feature (1345)..(1350): n is a, c, g, or t
  misc_feature (1352)..(1353): n is a, c, g, or t
agttgctcacgccagtggtgggcctccgaccacgacgtcacgccgtggcccgagtccgagctcccgccccagcagcccttcaccacggcgtgcttgtagtttgtaataatcaataatgctcttctctcaagctccgacttggttggtatattaattatatatattagtattttgctcatataattaagtaactctctttgtgttctcttcacaataattaattattttaattgtgatgattagtgttagtgctgcccaaaaaaanatnnctnnnnnnnnntnnnnnnnnnnnnnnnnnnnnnnnnngcnnnnnnnnncnnnnnnnnnnnnnnnnntttaccccnncnnnnnnaaccccccccnnnnnnntttcnnnnnnnctattnnncnnttnnngctnnnncnnatcccctntnnnccnnnnnnnnnnnnnnngcnnnnnnnatacccccnnnnatnnnnaaccnnnnncnnncctnnnnntaccnnnnncctnccctnantatcnnnnnnntnnntataaaccnnnnnnntnnnnnccnnnnccnnnnnnnnnnnnnnnnnnnnncccgnnnntngaccnnnnnnnnncccccaannnnnnnnacatgannatnnnaannntgnttannnnnnnnncnnnnnnnnnnnnnnnnnnnnatnnnnncccnnncannnaanannnnnnnattnnngaaactnnngnnnntaannnnnnnnnnnnnnnntnnntatnnnnnnttgnnnncctgnnntnnnnnnnnnnnnnnnnntacnntnnntnnnnntnantannnnnnnnnccccnnnnnnnnnnnnnnnnnnnntnnnnncnannnnnnnnnnnnnntnnannnnnnccntnnnnntntnnnnnntaccatttantttntctcttnnnttctnnncttanntctnnnncnnnnnnnnnnncttnnnnntttttnnnnnnnnnnnnnnnnntnnnnnnnnnnnnnnnnnntnnnnnnnnnnctttnnnnnntcttnnnnncnnntctnnntnnnnnttcnnnnnnnnnncnnnnnnnnntnnnnnnncnnnttactnnnnnnntnnnnnnntnnnnnnccannnnnnnttnnnntnnnnnncngntnnnnnnnnnnnannnnnnnnnnntttttcnnttntngncattcnnnnacnnnttnnnccnnntnnnnnnnnttnnnnnnnnnnnntnnnnnnnnnntnnnnnncnnnnnccnnntnnnnnnnnnnnnnnannnnnncnnnnnnnnnnnnnnnnntttnnnnnnnnngnnnnnnnnnnnnnnnnnnnnntnnnnnnnnnnnnnnnnnnntnnnnnnnnnnttnnntcnnnnnncnntttttt

SEQ ID NO: 4496 - DNA, 389 bp, Glycine max
acgtcctcctttctggcctcttgcgacgacgacgacgacttctctctcctccgcgacgactgccaccaccacctccaccaaccctacgcgccgcaccaccaccacttctctccctccgccgtcgccgcctccgtgccgcccaagcccgttgccgaagctgaggacttcgccaaccccttcgaagacgacgacggtagcgccagcgagaagcgcaaggagtgcgacgagatcggtgagggagccgcctcgtacggattcaacaacaagagatctaaggcgactccgtcgaacggcgccgtgtccggcggcgccgagtaccgcaaggaccgggaggagtggagcgacacggcgattgtgtgcctcctcgaggcgtacacggagaagttcac

SEQ ID NO: 4497 - DNA, 344 bp, Glycine max
tttgtcgctctcgccatcaggctttgctattctgccagatggcgcttcaaacaacggtgatggcagtgatggtggtggcagctgcctgcttacagttgggttacaaatgttgccaaatggagaccaatcaaccaagttcacaatggagtcagttgttactgtcaatagcctcatctcaaacaccattcagaaggtcaaagatgcacttggagttgcgtgatccatttctttaagacttaaatatgatcacaaacaaaaaagacttttttttttcttttgaaagaaaacataatagagggttttatattttgggtgtatagagtatatctagagtagagaaagag

SEQ ID NO: 4498 - DNA, 481 bp, Glycine max
catgaaagtggttgtgctatctcaggaggtggtattgatcaaagggatgcttgtgagcaagacaaagaggttggatgtagctccaagagggacagtagcagttatggttctccttcaatggagcaaattgattctgtgtccgaatcgaatcagcgaccagttaacgaagctactttcactgaatcttcaggtcaaccaaaggtatacatactaatactactagattcagcttctttgtagtattaattagtactgcattggataaaattgaaatatttacatgcccttgttattacattgtaggaggggtatgaagaggattgttatgcagagatactaaaggatgatatcatcaaattagatgaatcatcagtcttggtagagagtcacacaagaccacaggatcctacacagatgcaacctgcaccacaaggcacagcacaacggagaataagattaagggttgggaattcaaagcatt

SEQ ID NO: 4499 - DNA, 372 bp, Glycine max
tgatggatggaggagacgatctggctggagaccatggcgatttgatcgacggcgaggggagtgttggtgttgatggattgagataggaagtgttgtagagaatccattctggtccgaaccagggaaaggttctgaagcagaacatgaggatccgcggtggtagtattcggatcctgggactgagagtgaagtattcgggtcggattggagtttgaattggacatggtttggataataaggaagttcaacgccaagcaagtttatagattggtggtgttgtgttgtgttgcactgagctcacattaattcagtaaataattaattaatggggttattattgaaatataatggattgggaactacagtactatt

SEQ ID NO: 4500 - DNA, 382 bp, Glycine max
tttccagaagaatctcatggtataaagatgttttgatttgatacagattccggactggagtggaaagtaggtgactgtcataaagccatccagttggagaatatgacctgatgaagaaaattctaattctgaatctgactgctttatcaagtgactgcttgtgtttggaatctgaatatggatggcatgaatgagtatccatccaattttggaccgtgtcgtggaattagtagtagtagtagtagtatatatatatgccttccctgttatacactcctaatatagtagtatgttattgtgccttgtgcaaggtgatagggggtgtatcggccttgcatttttcaacaatcctaccttgtacatagttttactcgcatcctta

SEQ ID NO: 4501 - DNA, 391 bp, Glycine max
ggtgtgactcaacccacaccaagttctgctactacaacaactacagtctttctcagccaaggtacttctgcaagacctgcagaaggtactggacaaaaggaggcactcttcggaacattcctgttggtggtggctgcagaaagaacaaaaaggtctctgccaaaaaatccaatgaccaccaattagttaacaacaataatattaaccaaacacggcccccacaccaccaccaccccaaagaccttcaactctcctccttcccagatgtgcaattttctcacctcagcaacttgcttgggaccaatgcaaaccctagtttcatggagggcaaatatggaattggcatgattgagaaccctaggcctattgatgagaaccctaggcctattga

SEQ ID NO: 4502 - DNA, 667 bp, Glycine max
tcgatcactttctttcatgcttcttaggctttgatcgatctcctttttaccttctcatcttctctctttctccttccttctgccaggtaatttacaatttattattattgaattgttgttttttatttagttaaatactatagtccaagttctaagcatgtctaattaaccatctttgtattttttttcctgtattaaccctccagttcgtcttgggacagggatttgactacaggatgtaagtaaagtctgactaaaaattgtttccatcaaggatgaaattcggatattattctaacaatttaatcttaacttcagcatattaagcatattaaccagttgtgtttaatcatctttgtatattatgttcttattttgaagaaaatgggtcgtgcaagaatcagcttgaaacatatctcaaatgagagatctcgcaagaaaactttcatggagagaaggaaagtacttataaaaaaaatctctgaattttccaccttgtgtggagttgaagcatgcttgattgtgtatgatgatgggaatggtgacattgaaccagtgacttgtcccaaagaccctgtattggcacactccatacttcaaaactatgagtttcaaaagaatcagagacctcccaagaagtttggtattcaggactttgttgaggata

SEQ ID NO: 4503 - DNA, 387 bp, Glycine max
attgttgctagttattcactgataattactataattaacgtaaaacatgttgcactgcgccaacacgtcggggaatctggctgtggctggggacatgacagtgttggaaagacagagggcgaggatgaagtggcaagaagagcaagggtacttttctggcaacagcttcaacggtgttttttcttcttcttctctgcacgttcatgattccattatggtggctgctgactccggttgtgcactcgctgaggtcgtggctcaggcccaggctcgctcaaccaattcttcttcaatttcaaggacttttagttgtccacctgctctggtggagcccgagtccgagtccaagcccaagcccaagcccaccgactcctctgttgggaaaga

SEQ ID NO: 4504 - DNA, 333 bp, Glycine max
acttactacatcaacagcaaaatcctaggaactcatcagggcttgagcttgataagcctgagctggctctccattacccgccgccacacttgcaaaaccctccatactcactcttccaatcccagcctcttcttcagacccaaaagcctatggtttatgattattcatatacatcagacacccctatcatggcaaagcaactcatgacaaaccctagagactgtgagagcggcagtgatggcctaagatatcaagtttcggagtcaggtatggaagttgggtcgtgtgaaccaaatcaagaaatgggaaccggaagagggaaggaataaacga

SEQ ID NO: 4505 - DNA, 360 bp, Glycine max
ttttttgagggaagccctaaggctaagcttgctcctgcatgtgaacagttgttttgaatggatccaaatccaaattcatccaaaccatcaaagaacccttcaggtaacccatccaaaccaccctcactttccttcaccgccactgccactggggcctcctcttcaagcatcggcgaatgcccctcgaacagcgccacgtgtcccaacagcttgtccttcctcgaaaacgtagtcccgcatgagcacttccacgtggcctctccccgacactgcttgacgtggctcctcaagtccgacagcaccgcgaagctcttcttccgacaccgctggcacgacagcgttttgggacagtggcaccta

SEQ ID NO: 4506 - DNA, 350 bp, Glycine max
atcacaatctctgaagcacttcaagcagcaagaattgatgctgcccccaacgggactcatcatcttttgaaaccaaatgggagagtcctcagcttcggattagaattagaccctccaatttgtgattccatggcctcagtccttaacctcactgcagagaaaaagggtactcttaacaacaattcaagaaacaacaacaacaacaacaacaacaacggtgatgattgctcaagtgcatcttcaattactgtttccaatgaagaaaacgggaaaagcacgtctcaagaatcaattgtggtgccaaacagcaacggtttcatccaccatgttccatgcatttcaactcttcc

SEQ ID NO: 4507 - DNA, 359 bp, Glycine max
cgtccctcccggcgccaccgggctcaccatctacctcgccggaggccaggggcatgtcgtcggcggcggggtggtgggcccgctcttggcggcgggtcccgttttgttaatggcggctacgttttccaatgctacgtacgaaagattgcctctagaggatgatgatcaggaacacggcggcggcggaggctctccgccgggaattaccggcggtcccggcgaggcctcgtcgtcgatttcggtttataacaataacgttcctcctaatttaggtctttcgaatgggcaacatctgaaccatgaagcttattcttcttctccttgggttcattctcctcatgccagacctcctttctaat

SEQ ID NO: 4508 - DNA, 380 bp, Glycine max
aacaactcctttctcggcccccaagaggcaacatttgggacaatttcttcaattaatgggattgatcttcaaactcttgcagtcgctggccagctcccagcacaaagtctagccacacttcaagcagcaggacttggtaggtcgactgcaaaagctggtgtacctattcctctcatggatcaaagaaatcttttcagttttgaaaacccaaggttaagatttggagaaggccagccacaacatttaagcactagtaaaccaatgaacttgttgcatggaatccctaccaacatggaaccaaagcagcttgccaatttgcaccagtctacccaatccattggcggcttgaatatgcgagtcaatgcttctgctacacaagg

SEQ ID NO: 4509 - DNA, 357 bp, Glycine max
actgtttttcgtcatcgtactcttctccattattcttcttgtcaccgttctcttcatctacacgcgctgggtttgccgctaccagggacgactccccaccaccgcgttctccgccgcagccgtccacgcgccgccgctagcgccgcctcagggactggaccccgcctccatcaagaaacttcccataatcctccaccacgcgcctgcggaccgcgacgaaagcgcgtgggacgaaacggagtgctgcatctgtctcggcgagttcagagacggtgagaaagttaaggttttgccggcgtgtgaccattattttcactgtgattgtgttgataagtggctcactcatcactctagttg

SEQ ID NO: 4510 - DNA, 736 bp, Glycine max
agaaaagttgcttcccagtacaatactgtgagtacattgtgctctgttgcatctttattgttttcacataacctgtcaggttattgtatatgatgaggttatatatatagatgtaaaagtggcattttagttcagcttgttttgttactattagtgagatgtatagtttgagacgtgatatctcttatctttgtgtgctagagcaagttggttaaatgttgtttgaccagtggttttaagttcatgaaatgccatcatttctctccctttgctttctaagcaaggttttaaacaggcacacattttattttttattatattctattaatttgtaatgcttgcatctagtttgagctattttaatcattagcatgttgtcttgtttgaaattactttagaggaaggctaaaaaggcagttgctgccatgctgacaagatctaaagaaagtgagaagactgaagatacgaacatgactgaggaagaaagagttgagaaagagcaaaaagagctcatgcctttactcacaggtggaaaattgaagaattatcaactgaaaggtgtaaagtggttgatttccttgtggcaaaatggattgaatgggattcttgctgatcaaatgggtcttgggaagacaatccaaacgattggatttctctcacatctaaaagcaaaaggtctggatgggccgtacatgataattgctcctttatcaaccctctcaaactgggtgaacga

SEQ ID NO: 4511 - DNA, 769 bp, Glycine max
  misc_feature (621)..(621): n is a, c, g, or t
  misc_feature (623)..(624): n is a, c, g, or t
aatgtcagcaagcctagtagcagtagaggtcaagagaatccagaaaagcatcagtcaggtaaagtgccattgtagtctactagtttttttcgtacttaatatgttagctatttgtatttattcttgcttataagccagtaatgtaataatgacctaaggtatatccatttttttcttgatattcagacgaaacatgattggttgataatatttacaatctagcgctgacaattcaaatggtgcggctcactattggatcgctggtacactaccagtaactctcacatcatcaggggattgtaagttttttttagtgatagtgcacaaaacaaggataactatcattgacaatggatcacttgtgcacatttgcaggttagcttttttccggcatctagacaaaaaagctgctaagtggtgtaatatgcgagaactagctttttagcagttctcagtaaacaaacaagctaacatgtaaattatttccaccctcgcagtatttctgtcccctttcttttgcccagcactttttaccccactttaaaaagttcatactattttagagattatttgtgttgggcaagtgagcacatttgcaggttagctttttccgggatctanannaaagctgttgtaatatgcgagaactaactttttagcagttctcagtaacaaacaaactaacatgtaaattattttcaccctcgcagtatttctgtcccctttcttttgcccagcactttttaccccacttaaaagttcatactat

SEQ ID NO: 4512 - DNA, 365 bp, Glycine max
tcgcacgcatggtcgccaacatcgcaatactcgaatccgcattaaccgagagcgggaagctctgcgtggtggatttcgatatctgcgacgagaaccaatacgtgagtcttcttcacgagctttcggcccggcggaagggcgctccggctgccgtgaagatcgtcgtggtgacggagaattgcgccgacgacgagaggctgaatattgtgggcgtgttgctggggagacacgcggagaagcttgggattggcttcgaattcaaagtgctgactcggagaatcgccgagttgactcgcgagtcgctgggttgcgacgcggacgagccgctggcggtgaactttgcgtacaagctttatagaatgcca

SEQ ID NO: 4513 - DNA, 377 bp, Glycine max
tggtattgcttttgcgtaacatatcattggagtttccaatttagattaacatagtgtgttgattttgggattgatgcttgcggtgtcacctttgaggagcaatatcaaagatgaaaagaagcaaggagagatggagggtaatttctcaatggcaacaacaacaacaaccgatgatgttgtctttggtgacctttctgaagggaacttgttggagagcatcaacttcgacgaactcttcgtcggcatcgacatccacggagatgtcttgccggatttggagatgttcggcgagttctccgtggatgtcagcaccggcgaggaatcgtcggagatgaactcgtcggctaaaagcagcaaacttgagaacgatcagaatg

SEQ ID NO: 4514 - DNA, 685 bp, Glycine max
cttagaattcatcaacctatatatgtaaatatgcatcatcccacaaagtatatggttcatataattaagttaaattaccaaggataagaattatgcaagaccaaaacattgctataagatacgactgatgttgtgatatcgaaaattgatgggtataaatgtttttgtctgctgtgtagcagttggaagggtatcaaataaatccactccaactgaatcccggagttgaagagatgggatatggcaggaatccagctcaaactcatggtgaagccctctttcaacaaatggagtgtgagccaacgttacaaattgggtatgcactcactgctaattgactcaatcattgatcactttacagttgacaactgttaattactcttgtaaactgtatcaaatggttaattcactattcaccccaaaaatatggttaattcactagtaaggtagataaatgcatcaatgacaaatttggtgtaaatatgattagtaaagatgtgaggtcacatgagatggttgatttgattagcataactataatggtattagaattcattttcatttttggccaaagttttttagattccaatttttttttaataatgattttgttcaagtgcaggtatcagcctgatccagtatcagtggtgacagcaggcccaagcatgagcaattacatggcagg

SEQ ID NO: 4515 - DNA, 370 bp, Glycine max
tgatgaagttgttacgaggcagtctgcagttgaacaagtgaagaagagattggaagatgaggaagaagcctatgcaaggcaatgcctccaagtgaggcaaaaaactctggtaagtctcaaaaatcgtatgccagagctctttagggctatgtcggatttttctcttgaatgttccagaatgtacagtgaattaaggccaatatcacagaacctaggccagagcttatcatgagctgggttgcgcttattttattttttcagttattttttctgggtaaaatatatttatcttggttgtgttatatgatatgatattacacttaagatctcttgattggggatgagtcctgaagattgcatttgacagaag

SEQ ID NO: 4516 - DNA, 484 bp, Glycine max; identical to SEQ ID NO: 4488

SEQ ID NO: 4517 - DNA, 464 bp, Glycine max
ggaggagatgagatattcaagcatcaacaaagggaaaaaatgtggaaagcttcaccagcttggaggcaccaaggaagaaaagcaagaagatagaaaacaagaggaggtttagtgatgaacagataagatcactagaatgcatatttgagtcagagtcaaagcttgagccaaggaagaagatgcaactggcaagagatcttggccttcagcctcgccaagttgccatatggttccaaaacagaagggcaaggtggaaatcaaagcgcatagagcaagagtacagaaaactcaaagatgaatatgacaatttagcatcaaggtttgagtccctaaagaaagagaaggactctttgcaattagaggtaattagtttttggttcttttaacaatactacttatttgtgttgctaatgatgctcaacaaattaaagcatgtgacccttaactgtgttattttttttttt

SEQ ID NO: 4518 - DNA, 382 bp, Glycine max
acgcaccctcctcgagggcgaccgcgttgagttcgccatcgccaccggagacaacgacaagaccaaggccgtcgacgtcactggcgtcgacggcgcccctctccagccccgcgcctctgccgccaacaaccgcgccggaggatccggcttcggcgccaggcgcaatggtggcagcggcgccgcgtgctaccagtgtggtgatttcggccacctcgcaagggattgcaacaggagcagcaataccggcggcggtggaggcggcagtggcggtggttgtttcaattgcggcgggttcggccacctcgcgagggattgcgtgcgcggaggaggcggcaatgtgggtgtaggcggcggtggcgggagcggatcttgctttaggtgt

SEQ ID NO: 4519 - DNA, 375 bp, Glycine max
tgttctggtgtcgcgctccacggaattattcctccaattcctggctgaaaaatcggcgcaggttgcgattgaaaagaaacggaagaccgtgaatctggaacatataagagaggccgtgaagaggcaccagccaaccagggattttctcctcgatgagcttccgccgccatctcagcccaccaagcccgataggcccactcagcctgccggtcggcccaaattggatcctcctccccgtggtactcgccgcatcgatctatttttccggaaaccagaacttgacgacccagcccaagcccaaccacctgaaaatccagctcaagctcaaccgcctgaaaatccagaccaagaccaagcccaatcgccagtacccgt

SEQ ID NO: 4520 - DNA, 398 bp, Glycine max
agatagggattccaagtactacaaaggggtccgaaagagaaaatggggcaaatgggtatccgaaataagactacccaacagccgtcagaggatttggttgggatccttcgacacccccgagaaggccgcgcgtgccttcgacgccgcaatgttctgcttacgtggccgcaacgccaagttcaatttccccgacaacccacccgacatcgccggcggggaatccatgacgccgtcacagattcaggtcgccgccgcacaattcgccaacgctgggccccacgagggacattcgggtcgacccgaacattctcccatgcaatctctatcgccttctgtttcagaagggaccgttctaacggacagtgacgtcaccacacttaacggttcgctaacggatt

SEQ ID NO: 4521 - DNA, 297 bp, Glycine max
tcgttctcacaactacctctgattcaaactcaaccccttctcttcttaacgtttcacatcaaactactccacttccatcttccaccaccaccaccaccaccaacaacaacaacaacaaggttgctgttgaaggaactggttcaacgagtgctagcagcatatcagagtatttgatagagactcttcctgggtggcaagttgaggactttctcgattcatattttgttccctttggtttctgtaaggtttgaaatctttcttctttcaagtatcaaaaacaattgaagtttttttttt

SEQ ID NO: 4522 - DNA, 392 bp, Glycine max
ctcctctctcacgtacgcacactgttttcacctaaaaagctgctacccaatactccgtacaccgtatacctaaaccaccccaactacaacggacactaacaaatcattattattactgttactattacatcacattcttcacacactaatcaaaatcatcattttccatatatatcgccagcaagatacaagaagaaagaaagatgcttccgtttcggagattctatgggttcgagagctggctagaccacgacgctggccatgctcagagttcgctgatcaaaaaggcggtggagttggacggcgccagatcgaaaacggagcggaaatcaacggaagcgtgcaagagtcacagggaagctgagaggagacgcaggcagagaatcaactct

SEQ ID NO: 4523 - DNA, 867 bp, Glycine max
tgtctctatgaaggtgcttattcactttctctctctggtgatacaaaaaaaatgtaatttactttgttttttcaatgtttatgtgttgttatggatattacttgtcaatcaccaagtgtgttttgtatggagttttttactctgaacatgttgtttgatgcagtgtttattgtaaatttggattcttgcagccatctatctatcttttcaagttgatgctttttggtatggttgaatactgaatagcatggtatgaagtgattgatgttgtttcttttgaactgcttatgactgatttgtttgttaattgtttgtttcaaacctttggaattggttctaaagggaagtttgagttgttatgaagatgtgtctgtctgtcctcttatttttcttctttctttttttgaatttgatttgtaggatttgtgatttgatttgatttgatttgcttgttgtgtttatttcatttcagtgacgaaatgcaagcgagcggaggttgcattgtcgcttctgagagagaacaaaaatgggtttgatatcgttttaagtgatgtgcatatgccagatatggatggatttaagcttttggagcatattgggttggagatggaccttccagttattagtaagcattgttttgattggtttgtgtctattgagagacactgcatttgatatgaacttacaagttgtgtgaatgatttctacagtgatgtcagctgatgatggaaaacaagttgtgatgaaaggggtgacacatggtgcctgtgattacctgattaaacctgttcggattgaggctttgaagaatatatggcagcatgtggttcggatgagaaagaatggtttgagagatgtggagcaatc

SEQ ID NO: 4524 - DNA, 551 bp, Glycine max
tctcatatacttgatcatacggaaagcacaaaaaagaagacagaaaaaatgcatgcatattttgcagacccaacaagagtaatcatctacctctgcaatattaatatataaagcctaaggatgagaggaagaaggtggtactgggaaccatttggggtgatggaaaaagtgctttggaggaagtttgggaagaggtggaagtggcttgagtggaggcaacttagggagtggaggaagaggtggaagtggcttcttgtagattggaactggatgaagtggtggaaacttagggagtggaggaagaggtggaagtggcttcttgtagattggaactggatgaagtggtggaaacttagggagtggaggaagaggtggaagtggcttcttgtagattggaactggatgaagtggtggaaacttagggagtggaggaagaggtggaagtggcttcttgtagattggaactggatgaagtggtggaaacttagggagtggaggaagaggtggaagtggcttcttgtagattggaactggatgaagtgatggcaact

SEQ ID NO: 4525 - DNA, 812 bp, Glycine max
cattaatgggattcgtgtgtccccgagaaggagggctcgcaagttccgagctttggtttgatggctcgtgcttctgaactgagtcatagcaattccaagagtgttggtggagatactagttctggctcctctttgctccgtgttgaggtacagagtcagccacagccgccgcagcatatgcagcagaatccgaggaaacaacggcggtgctggtcgccggagcttcaccggcgctttgtggacgcccttcaacaacttggtggagcacaaggtaggcctagttgactctttgtctcatggattgttttaaaaatgatccgtgactgcaatttggactgtgaagttgatgcttttttggggtgtttgcttcgcaattatttgtatttgtccacaatttcttgtaatttaaaaaagttgcggtaatttaaaacctttaattaagaaaatttgttgcttctgccatctgaaattgaaactgtggatcttgtcctgtgtgggatcaatgtgtacctaattggtttattttgttttgcagtggccactcctaaacagattagagaactgatgcaggtggaaggccttacaaatgatgaagtgaaaagtcatttgcaagtgagtgttttttcatttttttttgttggtatttgatcatattaggacacccacaacacaattaaagaaccatatgttgaaacctaggtctcttagtctttggcttcaattggattcacccaaaaaacaaaccatggttattggttgtcactgttaattattttctacctcttgccaatttttgttgccaacaacttatg

SEQ ID NO: 4526 - DNA, 402 bp, Glycine max
aggtggcttcggcttttcaagtgttcaatggtattagtcctttcgtgaagttctcacacttcacagcaaaccaagctattcaagaagctttcgagagggaagagagggtgcacatcatagatcttgacataatgcaagggttgcagtggcctggtttgtttcacattctagcttcaagacctggtggagcaccttatgtgaggctcacagggcttggtacctctatggaagcacttgaagccacgggaaaacgcttgtctgattttgcaaacaaacttggtcttccctttgagttcttccctgtggctgagaaagttgggaaccttgaccctgagaggctcaatgtttgcaaaaccgaagctgttgctgttcactggttgcaacattccctctatgatgtca

SEQ ID NO: 4527 - DNA, 391 bp, Glycine max
ggttcgtgtagacgattattacaaaaaaaaacaaaaaagcaccaagatgaagaagaagaaagattcttatatgaacatgatgaattatgagtatattaaattaatgaagtattaatacatcattgagtatattaatgtgtggttatttaaaaataagtacttgattaatgatgcgttaataattgattaatttaatacacttagatttgatgtacatttggttgtgtaagctaggatcattcgtcagtactatatttgattagtgtagacgagatagctaaaatgccggggaagtatagtagtagaattgaaaggtgatggaggtgtacatcaaattgttgttcatctattgacttggtgagtgatgtatggttaggcttggatcaaggat

SEQ ID NO: 4528 - DNA, 362 bp, Glycine max
agcgccgccaaatcacacaccaaaactccttcgctctcactccctcctggacttccctaaccgaacagcgcctctactcctccaagctcctccactcgctccgccgcaacagcaaccctaccgccgccctcgaagtccgcgcctccgctgaccgcgtcctcgccgccactgccaaaggccgaactcgctggagccgcgccattctctcaaatccgatctgccgctggaagcagagacaccacaagaaggtcaagaagtactccgccaacaaattcatgaagaagacgacgcctgagattcggagaagcttgccggctgtgcagaagaaagcgcgcgttctcggaaagttaattcctggttga

SEQ ID NO: 4529 - DNA, 423 bp, Glycine max
tatggatctaccaagtcttccttactaaatagaaatcttaaatgaattggtatcgtcttgtcagttcaatgctgattcagtagatcatatggcttactcctctgtccttggacgctttgaggcattaccactatcttcactagcatgttgctcaggattgtcggaagcttgaatttcaggagcatcctgcttctcagccacttccaatgagctttcctcaactgtggtactgccattagccagatcagctcctgacttgcagtggtccaccttgatggtttctgattcagttttggctggagaatctttgatggcatcagaagacactccagattgactctcgatgacagatgatgatgccttaaatgtttcaatgccaggtttgcactgcttctcaaacatcatctgaaaaacatcatctga

SEQ ID NO: 4530 - DNA, 347 bp, Glycine max
atatgagagagaaacgataataaaactaaactagggcggtgttagggaggaaaaaaagacgacaaatgcgaaggaacacagcaaaactcagctttgcacttgcattccacgcacgttaattgaatacaactttaagttggagtttattctctgtgctcatccgcatacttccattgcatactcccccctcctcaccatcacctgataaataaataagatgaacacctgcaaacccttccatgaacttcttccaacttcagttcttttctctttatttcgttaatctcccttaggataattgagaattctcaattattgttgtgctgttcaagtgattcgatccattc

SEQ ID NO: 4531 - DNA, 390 bp, Glycine max
agcagggacaacggagaggacctgcagaaccaaaacctcggaagccacgaaggctcggagccaggaagcagcggtcggaggccacgtggcaggccacctgggtccaagaacaagcccaagccgcccatagtcataaccaaggaaagtcccaacgcactccgaagccacgtcctggaaatcacctccggcagtgacgttgctgagagcatcgccgcctttgccaaccgccgccaccgcggcgtgtcggtgctcagcgggagtggcattgttgccaacgtcactctccgccagcctgccgccccggccggcgtcataacgctccatgggaggttcgagatactgtccctctcgggagcctttttgccgtccccctcgccgccgggagccacg

SEQ ID NO: 4532 - DNA, 1180 bp, Glycine max
tctaggtgtatacttcattcaagttccatggtttggcaataggatatattcatataatatcatattatttcaccaatggctagtagctacacacacttttcatttgtgctattgatcactcactagtctaagtccaagggctctctgatctgtgccttttctagttgtttctactttctgcatattactgattcaatagttaggtctgaggaagttacttacatattttgtttgtttaagcaaatatttgactcaaagatatgttttaaaaattataataattaaagtaacattttagaatatagtgaaacttgaaatgaagtctaaataaagtacatatgtgatacttaagaaattatttatgaaacatgaaatgaagataacaaaaaaagattttctcaacatattctaaatataacaacttacaaaaaaatcctaaaatatatatcatagaatcaatgttttaggcttatgccaactagcaataacatcctcccatttctgaactcttaaatttgatgttgatatgtaggttgccctgttgagaagtttattaaatggaaagatatttgtggaatggatatgtccagctgttgcacaagcctatcaatgtcatgtaaggataagtagacaaaacttatataaatgtcaaatcagtaggccccattagagttcttgatatgataacaaagctttgattaaattatttttttcagatcagtgcacatgcaacatcttacggagaagaatcagatatttacaatgacgatattgtcaggggaatcacagtcaaagggatggcttggaatatcattcaaaagcttcctgttcaacaatttaattccagtaaaatgttcaaattatacaacgactcatgctgctcaatttgcttccaggtgagaaatttttttctgagcctgtgaaaatgcacgagtttaagaaccaaaagaagttaaaaaaaaatttaagatgttcctaaactctgaatttaacatacagatacccacatgtatagtatataattttccttcattttttggtcaggtatttctggtgactagtttatcattaccttgccatacacaatgaaattaaccacattatcttaaaattatattctgcaggattttgagtatgaggaatttgtgaggacacttcccaaatgtggccacttttcact

SEQ ID NO: 4533 - DNA, 1246 bp, Glycine max
ttggacccagaggaagatcaaatcctcatgtcatacatccaaaaacatggccatggaaattggcgtgccctcccaaagcttgcaggtactttaaattctcaatttacaaacaaaagaaacacattgaatttatgataattaatatatatttccattcacccttttatattataaagttggtaattgacatattccactttttggatgatttggagtcatgagattttttgtttattgattttattctgggttctttggtatcatttcttagggttattaaggtgtggcaagagctgcaggctaaggtggattaactatttaaggccagatatcaagagaggaaatttttcaagcgaagaagaggaaattatcattaagatgcatgagttgctggggaacaggtatatattggttgatttcttcttcagactaatggcattaatatgtttagtaccatgaataagatgagcattttaattagtttgcctgaaattgtaatgagcgattttgttctcgaaagtggatttgggtttccaatttcatgcttcttatctttttcttaatttctctgaaaagtaaacatgatttaattaagtggtgggggcaagcggcattaatattgataataagattgagaaggaattgggtccattgataattattataccaggcaaaagccataaaatgtgctagatagtctaggattgattgatttcattaatggacttttatcactttctaattaattttcgtaaaaaaatactagtaggaccaagacccttaaagtatgatttgttttttttttaccatatcttaatgaagtacatataatattttaattgaagattttaattatttaataaggatcatgattatatatgatatggaaattaaagaataataaacatgtgggtgggttagcaagattctctcactatatttgccttgcacggcactaagtattttggcatatttcagagcacatgcaactattaacatacactagacgtacatatattccaatgagtgcatgagatttactgtctatgtaatcctacaaatcaatacagtccaacttttacttcgttgttttctcaatctcttcaaccaagaaaccaaaacaagaatctgatgcattattaaattgatcttgatccatgttttcaggtggtcagcaattgcagcaaaattaccaggaagaactgacaatgaaataaaaaatgtgtggcacacccacttgaagaag

SEQ ID NO: 4534 - DNA, 779 bp, Glycine max
tatgccaatgatgttttcgggttttaacagagagaaggagatgtcagccatgatcactgctttgacacgtgtggtttgtggagattattctcttgttcatcacaatattgataatactaatagtgcaattgttgttggtggtggtggtggtgatgatgtttcaaatatggcttctggttctatgccaccttcgtctacttctttatctcatggtggcaactctgttctcaagagaagaagggaagatgataatacaagtgatttcttacgtggaggttcattccctgctattttaacaagtaagcaccataattgataatcatactctaaattctaaaatgataaaatattttttctttttattttctggtctaggatatatgttgatgggtccgggcatgttcacaaagagtatacaaataatttattattttaacatgcttttctactaatgcttgacataataataactagaacaacgaactcataataataataacaataataaaaataacacaagaactgaaggttaggttggaataggatcccacaaaatacccacatcttaatagaatatttatattaaacatgtttataatgattgaagattccggcaggggagacacataacataacatgttacatcatataaaagtggaaaaaaaaacctttttagaacacttatttgtttttctttcttaatgttggatatgattagctgcggaaggttcaagcacgataagaagaagaagagcgaatacggtatacgattacgaata

SEQ ID NO: 4535 - DNA, 1188 bp, Glycine max
ataattatctgagaccggacatcaaacggggcaactttaccagagaagaagaggacactataatcagtttgcatgaaatgttgggaaacaggtaattaaactaattatatattttccctagctggcatagcatttcacattagtatagataatttaatccaagttaacttcaacttaatgaaagaaattaatcctttcaccgaaaaccaagaggttgaaatttgaaaaaccaatagtactcaggctcaaacagtgaaacaaagattcccggaatatcttcattaatttctatatgttgggtccttttctattctgttccatgaagctgatggaggagcagatgcatatggcttcataaacttctactcttggtagtatacaaattcatatcaaaatcttaatttatcggcagcctcgtgttttcttttattattactactattttaaagaaagggaatagtttagttactgctctttttttcagataattgtttcattgtttgggcccatgagcactttggttttttcttagtttttaagggaagcaaaatcataatcagtgggatatatgtcgctctgcaaagattctctcttttgctgcaacatttcacgtgctttcttaacataatatatttaagcacatcatcattcaatatcccatgacattattactactgtattattatggtgacttggagcagcaagctataccctattttattaatgaaaaatgttaacccaggggtactgaaggtattgattaaaaaaatttaaatagaaatatttttatcaagagaaagaacattctacacaataaatatttttctttcttaatttcttacataatattctaaagatactgattaatgtatcctttattaatttatttaatttaatgaatatttcctccatcattatcgatcttgtccactaatcttgtgataaccttgtgcagatggtcggctattgcggcaaggttgtcagggagaacagacaacgagataaaaaacgtgtggcacacccacttgaagaagaggctgccacaaaattaccaacaaagccatcacactaaaaaacgaagcaaaaaacaaccaccaaagttggatgcggacgcctccaaatccaaccaagacgccaaactagaacaacaagaccccgttaatattcatggatcgaactctgaggaca

SEQ ID NO: 4536 - DNA, 429 bp, Glycine max
tcagaatacacaacacaaagtcaatataattatagtatatccctatgagtaggagttcggcgatgcatggaattacaagcacaaacaacaagttgaagggagttcggcgtcgaaaatggggcaaatgggtgtcggagattcgtgttccgggcacgcaagagcgtttgtggttgggaacctacgccacgccggaggctgccgcggtggctcacgacgttgccgtctactgtctaagtaggccttcttcgttggacaaacttaacttccccgaaaccttgtcttcgtacagtgttcagctcagggacatgtctccgaggtctgtgcagaaggtggcttccgatgttggcatggatgttgatgcaagaaacattgttgcgggcaaaacttcaacggtgggggcagaaactaattgcgagagtgatgagagga

SEQ ID NO: 4537 - DNA, 1235 bp, Glycine max
  misc_feature (338)..(338): n is a, c, g, or t
  misc_feature (352)..(360): n is a, c, g, or t
  misc_feature (370)..(370): n is a, c, g, or t
  misc_feature (375)..(385): n is a, c, g, or t
  misc_feature (389)..(393): n is a, c, g, or t
  misc_feature (398)..(404): n is a, c, g, or t
  misc_feature (413)..(418): n is a, c, g, or t
  misc_feature (422)..(427): n is a, c, g, or t
  misc_feature (429)..(429): n is a, c, g, or t
  misc_feature (436)..(436): n is a, c, g, or t
  misc_feature (438)..(447): n is a, c, g, or t
  misc_feature (449)..(452): n is a, c, g, or t
  misc_feature (458)..(461): n is a, c, g, or t
  misc_feature (467)..(471): n is a, c, g, or t
  misc_feature (473)..(478): n is a, c, g, or t
  misc_feature (480)..(482): n is a, c, g, or t
  misc_feature (486)..(493): n is a, c, g, or t
  misc_feature (498)..(504): n is a, c, g, or t
  misc_feature (512)..(512): n is a, c, g, or t
  misc_feature (514)..(523): n is a, c, g, or t
  misc_feature (525)..(541): n is a, c, g, or t
  misc_feature (543)..(550): n is a, c, g, or t
  misc_feature (559)..(562): n is a, c, g, or t
  misc_feature (567)..(572): n is a, c, g, or t
  misc_feature (574)..(583): n is a, c, g, or t
  misc_feature (588)..(590): n is a, c, g, or t
  misc_feature (592)..(601): n is a, c, g, or t
  misc_feature (606)..(608): n is a, c, g, or t
  misc_feature (613)..(613): n is a, c, g, or t
  misc_feature (616)..(620): n is a, c, g, or t
  misc_feature (624)..(642): n is a, c, g, or t
  misc_feature (644)..(656): n is a, c, g, or t
  misc_feature (658)..(667): n is a, c, g, or t
  misc_feature (674)..(676): n is a, c, g, or t
  misc_feature (680)..(680): n is a, c, g, or t
  misc_feature (682)..(682): n is a, c, g, or t
  misc_feature (687)..(691): n is a, c, g, or t
  misc_feature (699)..(700): n is a, c, g, or t
  misc_feature (705)..(707): n is a, c, g, or t
  misc_feature (709)..(714): n is a, c, g, or t
  misc_feature (722)..(722): n is a, c, g, or t
  misc_feature (725)..(726): n is a, c, g, or t
  misc_feature (730)..(732): n is a, c, g, or t
  misc_feature (737)..(740): n is a, c, g, or t
  misc_feature (749)..(755): n is a, c, g, or t
  misc_feature (760)..(763): n is a, c, g, or t
  misc_feature (766)..(766): n is a, c, g, or t
  misc_feature (768)..(770): n is a, c, g, or t
  misc_feature (784)..(792): n is a, c, g, or t
  misc_feature (794)..(794): n is a, c, g, or t
  misc_feature (801)..(803): n is a, c, g, or t
  misc_feature (808)..(814): n is a, c, g, or t
  misc_feature (817)..(823): n is a, c, g, or t
  misc_feature (833)..(837): n is a, c, g, or t
  misc_feature (839)..(840): n is a, c, g, or t
  misc_feature (847)..(847): n is a, c, g, or t
  misc_feature (853)..(857): n is a, c, g, or t
  misc_feature (863)..(865): n is a, c, g, or t
  misc_feature (873)..(878): n is a, c, g, or t
  misc_feature (901)..(903): n is a, c, g, or t
  misc_feature (905)..(905): n is a, c, g, or t
  misc_feature (911)..(914): n is a, c, g, or t
  misc_feature (917)..(919): n is a, c, g, or t
  misc_feature (924)..(924): n is a, c, g, or t
  misc_feature (926)..(930): n is a, c, g, or t
  misc_feature (940)..(952): n is a, c, g, or t
  misc_feature (954)..(960): n is a, c, g, or t
  misc_feature (962)..(963): n is a, c, g, or t
  misc_feature (968)..(968): n is a, c, g, or t
  misc_feature (971)..(985): n is a, c, g, or t
  misc_feature (992)..(1001): n is a, c, g, or t
  misc_feature (1003)..(1020): n is a, c, g, or t
  misc_feature (1024)..(1024): n is a, c, g, or t
  misc_feature (1026)..(1028): n is a, c, g, or t
  misc_feature (1032)..(1038): n is a, c, g, or t
  misc_feature (1043)..(1048): n is a, c, g, or t
  misc_feature (1052)..(1059): n is a, c, g, or t
  misc_feature (1065)..(1078): n is a, c, g, or t
  misc_feature (1082)..(1087): n is a, c, g, or t
  misc_feature (1092)..(1102): n is a, c, g, or t
  misc_feature (1104)..(1106): n is a, c, g, or t
  misc_feature (1117)..(1117): n is a, c, g, or t
  misc_feature (1122)..(1132): n is a, c, g, or t
  misc_feature (1146)..(1149): n is a, c, g, or t
  misc_feature (1151)..(1161): n is a, c, g, or t
  misc_feature (1166)..(1168): n is a, c, g, or t
  misc_feature (1171)..(1171): n is a, c, g, or t
  misc_feature (1175)..(1180): n is a, c, g, or t
  misc_feature (1185)..(1188): n is a, c, g, or t
  misc_feature (1191)..(1191): n is a, c, g, or t
  misc_feature (1200)..(1202): n is a, c, g, or t
  misc_feature (1204)..(1217): n is a, c, g, or t
  misc_feature (1220)..(1227): n is a, c, g, or t
cttcttcttcttcttccttcattttcttctctgcatctcacactgatcataccccaaacaacccttttgagatatgtttatggttatggattcagcagaaaggtgcttagattctcaactatggcatgcctgtgccggtgccatggttcagatgccacccctcaacacaaaagtcttctactttccccagggccacgctgaacacgctcatgggaaggtggaatatttcgggaaaaaccatcaaacccgtgttccaccactcatcccttgcagactctctgccatgaaatacatggcagaccctgacaccgacgaggtttatgtcaaaatgacactcncccctttgaggtannnnnnnnnccccccttanacctnnnnnnnnnnncctnnnnnctccnnnnnnncccaccccnnnnnnatcnnnnnncntcctatntnnnnnnnnnnannnncttttnnnncccctnnnnncnnnnnncnnncccnnnnnnnntttcnnnnnnnccccctcntnnnnnnnnnncnnnnnnnnnnnnnnnnncnnnnnnnntccccaatnnnnaaatnnnnnntnnnnnnnnnntatannnannnnnnnnnntagannncttcnttnnnnncccnnnnnnnnnnnnnnnnnnncnnnnnnnnnnnnntnnnnnnnnnntttatannntttncnctctnnnnnccccctcnnctttnnntnnnnnntttttttnccnncccnnncttcnnnnctccttttnnnnnnntcttnnnnttncnnnccctccctcttcannnnnnnnncnttttatnnntcttnnnnnnnctnnnnnnnctccctttcnnnnntnnttttttnttttcnnnnncctttnnntccccccnnnnnnctccccttttttctcttttctcnnntntccttnnnnccnnnacaancnnnnntctttaaacnnnnnnnnnnnnntnnnnnnntnncaccnccnnnnnnnnnnnnnnnccccccnnnnnnnnnncnnnnnnnnnnnnnnnnnntttntnnnttcnnnnnnnttttnnnnnngttnnnnnnnntttccnnnnnnnnnnnnnnttcnnnnnnccccnnnnnnnnnnntnnntttctcccccntcttnnnnnnnnnnntttttttttccccnnnncnnnnnnnnnnnctttnnnttntccnnnnnngcccnnnnttntttcccccnnntnnnnnnnnnnnnnnccnnnnnnnntttttttt

SEQ ID NO: 4538 - DNA, 381 bp, Glycine max
tttctctccttccttttcatcactcacttttcactcccaagtcccaaccacaacccctcctctcctctcctcgatcagtgccataaatcaattctttctttctatctatctctgtccacaattctctttatgtcaacaaacctaaaactaaaacctgcttgagagagtagggaattaattaattaattttctttcatttcatcttttaagttgatctgtgaaaatggcttcatcttcctccaacggcagttccagcggaagcaagagttgggacatcgacggcgacctcgccggtttcggctacaaagtccgttcatcggagctgcaacacgtggcagaaaacatggagcgtttagagaacgtgatggacattgtgaacta

SEQ ID NO: 4539 - DNA, 1172 bp, Glycine max
  misc_feature (1165)..(1167): n is a, c, g, or t
  misc_feature (1169)..(1169): n is a, c, g, or t
cgggttgtttggtccgtggagctccatcaacagtttgtggctgctgtggatcaactgggaattgacagtatgtatccttcacctgggttttttaattttttttttcttttgaaactttgttgcatttccattgaaggattatgtaacaaaacttgggatgcataatcgacgaaattctatgggtatattgttcagttgtcatacatgagttttgattgtctcaaaacaacacttttactactcgggccttcagtttttagccaccatagttcatatcattgcctctaggttttgcatgctgtcaattttcaaattattctggaaagtaatatttaataattaataaataactaaaattccattttttggctttaatattacatcaacagtcaagccctatcccactggttggggtccttgccatttagttctataaaaaaacatttttttttctcaaaccatttttagtagtctttcggttttctgagttctacccattttactagactattttatgcttttctagtatcataaaatcaaaccatctttggtgagattcactcctactttatcctgtgtgcatttgttcttcatcttatttttcttgtacgttcacccctccactccttccccttttatgttcacccatccatcttatctcatccttttgtctaaattattaatttgtttgaatatttttcttaaaagaattatgatgttcttgagttttgcctgactcaaatttgatatttgtattcagaggctgttcctaaaaaaattctggaattgatgaatgttcctgggctcactagagaaaatgttgccagccacctgcaggtatcatactgttatcctatatatactttgggaaggacttgggttaaattttaatccctaattttcttcttgtgatcatctatgctatgattacttgaaggaagtaactctttttcttcatcctgttttattacagaaataccgattgtatcttcgaaggttgagtggagtttctcagcaccagaataacatgaacaactccttcctcagcccccaggaggcaacattcgggacaatttcttcaattaatggaattgatcttcaaactcttgcagttgccggccagctcccagcacaaagtctagccacacttcaagcagcaggactnnnangcc

SEQ ID NO: 4540 - DNA, 682 bp, Glycine max
ttttttggtgtgaaagagctattgactgacattatgttttctttgatttctgcagactatagaacaaccatttgacgtgtttgatgagaatccacagtttaggcgtgccccccctatggttagagtggagaaaatgttcgagcatatccaatctaaacttcctggggctcctcagttccttctctgtttgcttcctgatcggaaaaattgtgatatttatggttagtgttttttgtgtgattatatttttatgcccaagcaattttcaagagccctgaatagaaattgtctttttttcgttgaaggtccatggaaaaagaagaatcttgctgattttggaatcataaatcagtgtatgtgtcctttaagggtcaatgaccagtacctgactaatgttatgttgaagatcaatgccaaggttaatttaatattttggttatattgtacagtatctttgtacatgatcatataagcatttgcatgtaaaccatcttatcttaattttatagtaaaaatagatgaagttatggaaaccttcatgcccattcctcacttactaggataaggcgtggttgttatgattgatttttactgcatgtgcctgtaaaccatcttgtaaactgatgaaaaccttcatgcccttccctacttactattctaaggctttggttgttacaattaa

SEQ ID NO: 4541 - DNA, 886 bp, Glycine max
tcatgtctagatggatcccgagtcaagtcaggcaacagctgatcgtctatcaggaacaagtgacagcgaggaagtagctgatcatgaaactgaagtggatgagaaaaatgttgagcctgagcccaagaggaggtaagcttttattctatataaatctgttcttgttggataattgtttgttaggagttaagatagaagggaagggaaaactagttacagagttagagtaattaattagttggccataggaattaattagatctaaataaggggaattaaggggaaatgatgcattctctatttggttatcatttgtaaattgagtgtttgttctctgtgaaaggagatccttggtgaagacaaaagaggaaacccttggaggagatctccctctcctattttctattctttcattctattcaataaaacatttcttttctttccatttttattctcggttcctaacatcatgtgtcttttctgatcttagagttgttataattctgcagaaaagcagaagtctcgcagtcagatccaccttcttcacataggactgtcaccgagcctcgaatcattgtgcaaacaacaagtgaagttgatctcttagatgatgggtatagatggcgaaaatatgggcagaaagttgtcaaaggcaacccttatcctaggtgatattgcttctcctccacactttgattccatctattgaactagtcatgactgatatgattgccctgaacttgtttaaagaaatgttcgatctgttcaattcatcactcagattatctatactactttatgtaaaccttgtcttgtcctgaaaaaaataatgctgatgcttgcttatatcatgcacaggagctattacaaatgtacaacgcaaggt

SEQ ID NO: 4542 - DNA, 443 bp, Glycine max
atggaagttatgtcaaacaccatcatcaagcaaagcaacaacatagcaatttcacaaggcaccatccattttcaaaaactttctttctggttcgcccctcgaactcgtccaccgggttaattttccttctgatctttctcttgtagctccactccactaaaagggttttcaaaggttttaaaaaacctctaccatagcaatttcaactacaaaagtcaaggattttagactaatcgcaattcgtgattgtaactgtggttgcatcggctgtatttgttggtaatttttttacaacatcaagtatcaaaataaaactgcaaccacgactgcaatttaaaacctttaggactatggtttactccttctatgacaaaacctcttcttcttcttctggctccgatatttcggggttgttcaatcctactttgcataaccttggagct

SEQ ID NO: 4543 - DNA, 354 bp, Glycine max
  misc_feature (9)..(9): n is a, c, g, or t
attcagtcncccgcaacgacgtcatctcaaggaaacaacaacaataaccctttccctgacccttcttcaggacttcccttcttcaacttaccactcaatatgcagaatgttcagttaccacctttttgagggttcatgaatctgataatatgagactgatgaagatcatgttgatggaggatttatcaccaaagggtttatattattataaggtcagcaaatattcatggactagaacatatatataaactatatgttcttcttcttcttgttattttgttttttttttcttctgttgttaatggatatgatatgatatgacatgattattattattatgtagcgagtttcagt

SEQ ID NO: 4544 - DNA, 363 bp, Glycine max
  misc_feature (111)..(111): n is a, c, g, or t
  misc_feature (135)..(135): n is a, c, g, or t
  misc_feature (241)..(241): n is a, c, g, or t
ttcttccacaggccatcaaaggcatacacaacaggaacgcgaaagaggagaaagattcaaaacgaatgcgacttgcaaggaggggaaacccggtggcacaagacaggtaanacaagaccagtgatggtgaatggnaaacaaaagggttgcaagaaaattctagtcctctacaccaacttcggcaagaacagaaaacctgaaaagaccaactgggtgatgcaccagtaccatctgggtcagnacgaggaagagagagaaggagagcttgtggtgtcaaagatattctaccagacacaaccgaggcaatgcaattggtcagatagaagtgccacaaccggtgaaggaagtggagaacaacaacct

SEQ ID NO: 4545 - DNA, 390 bp, Glycine max
  misc_feature (15)..(16): n is a, c, g, or t
actttaccaatgagnncgtgtaattcatgctgttgacctgattttgctgttgttgctcatctcacgaagaaactcattatagtttttttttttctttcaatatgtgtatgttagctggagtcgtggactggtagctacgtaggttctcgctatgatggggggcatatcatgtggtcttttctcaggtcggtggtgtgttgtaatttgtaacgagatatccgttacacaatcggatcaaattaaccgtgttttgttgttttagattaatttttttctatgttctgatgaattcgataatttcacatacatgtggtgaaaatgatttcatatataagttgtatgcatagttcatggggggaaactatattaattcaaccaaccctgtttatg

SEQ ID NO: 4546 - DNA, 365 bp, Glycine max
  misc_feature (221)..(221): n is a, c, g, or t
  misc_feature (223)..(223): n is a, c, g, or t
  misc_feature (285)..(285): n is a, c, g, or t
  misc_feature (292)..(292): n is a, c, g, or t
  misc_feature (294)..(294): n is a, c, g, or t
  misc_feature (300)..(302): n is a, c, g, or t
cctcagcagaaccgagacatcaataccgaaatcctccacaaatggagaaaaaagcgagaaaagtgcttctgaagaaaaaacactaaagaaacctgacaaggtacttccatgcccgcgatgcaatagcatggaaaccaaattctgttactacaacaactacaatgtcaaccaacctcgccatttctgcaagaactgccagagatactggacaaaaagtccanancgatagggattataaggtccaattcgcgaattataagactaatggaaattaattaatcaagncaactgntntattgnnncacaaacatgttcccttgttctatgaagcacgatcaattggtgcgctgtagaccaatcactta

SEQ ID NO: 4547 - DNA, 386 bp, Glycine max
gaccggggcatcagttttttgctggggcttcttcctcagccgttcccaatgttgtgcttcagtcacaaccactgccagtggcccaggtgttccctcctgctgttccacagatgatgtttccaccacccatgtttgagaactacatggtgaaccccaatgggtttgatgacatgggaatgggaggaggaggatttggaggagcaggaccttctagtgctggtggtggtggtggtggtttcttttgatcctgccagctggattttgatgcccttttgtttttaattaagagttcatgttgttttaatttctgtactgttccgggttagctagtttcatatgtacgtgacaacatgcttaattagcactgattagctagggttcggaat

SEQ ID NO: 4548 - DNA, 467 bp, Glycine max
cctttctttcttctcttgttctctcatggtgccgccaccagagaacatggcagcaccaaaagaccaagatgccacacaaggccgaaaaatcaccaccacaacaacaaggccagcgccggaacaaggcgtaaagtgcccgcgatgcgactcatccaacacaaagttctgctactacaacaactacagcctcacccagcccaggcacttctgcaagacctgcagaaggtactggaccaacggcggagccttgcgcagcgtcccgataggcggcggctgcaggaagaacaaaagggccgtcgtcaagccctcttcctcttcgtcatcttcatcaccaagactctcaaccaccgaattcagccttcgcggcctcaacgttccgccctcggttgaattcaacctcggcgcgttgcccttcccctcgaggctcaacacaaaccaccacattccaacaatcataaacacagggt

SEQ ID NO: 4549 - DNA, 1016 bp, Glycine max
aggtttttacctaataatctcttacatcatctagttttctgttttcatctctctctctatatatatatcatcaattttaaattttataaaatataagtgcatgtgtaacaaaacatgtatacatgagaatgtactcgctcaattttctcatcaactgttatttgttagactttgttctctaaattttacttctcactttaaagaatccaaatccatatattcctattggttcaactaatcctttccgccataatttaaggatgtattcaaagaagaggcagctatacctgatggtgagattgcattactaaatcctgaacaagaatggccatcagatgattccgaagatgatgattatgacccagagaggaaagaagacagccacaatatcaacatagaaggaactaatgatagtgcatctgaggatttaagcagttctaccagtctgtgttcttctgatggtgaatgttctccaatagatggtgtcagtcatgaatatttttctgtcaatagcagcatagattctgatgagtctgaggacaaagcctgtgggcgtaggcagagaaaagctgttgactacaagaaactttatgatgtaagtatatgaagttgtgtttcagaaaagcaaattgtagttctcaattttgaagctacaacttcagcaatggtatagaagttacaaattactggccaaatgttgattatcttaaactttgaggctgacattttaccagtctatttacagacatacactgttctttctcactggaaaaattatccctatatctattttaatgaattgggttggtaaatatttctgtcacctttataggctttagtgaattgatttaaaacatgtattgccaaatagatgtgtcacttatccttggatgtggtgtagacagataatcattattcatggaaatactactaaaaaataatgttcctgattttgtttgctgtcctaatttgagcatagtttagatcatgcaaaagaagtttcattcgagctcatc

SEQ ID NO: 4550 - DNA, 650 bp, Glycine max
cttccggcggtggtggtaagaggccaagaggtatagtggggtcatctcaaaaggccactgtcacttctcatagttccaactctaatgctactacacctaggagcttagctacgagctcctttcaccaaggtgctttctctttttctcttttttcttttcactttctttccctcatcaaagaaatgaaataaattaaatgttcatttttctcaaattaaatgatatcatcatgtgattcatattagtgtgttccatgtaatcaatctacccataaatatttgatgccgtattagtcctttatttatagggaacattaacacgtatgctataatttgtgtgcttttgaaactaattggatgtcacatattgaaatagtttgatagaataaattgatgtttaagatgaattaatttgagggttcatgagattgatgttatacttgagaagcaaaatgaggcaccaaattattaaatgattaagagagtataattcagttaattgagtagaatgtcagtgttataaatcatatgagattgtatttaatttctaagaataaaaaaaaaatcaaatgatgattttgaaatgcagatggtagcctgaagcagtcattactgggtcatgttcgagcaccagcagtgttcaagtgtcat

SEQ ID NO: 4551 - DNA, 385 bp, Glycine max
ctcttcctctcactgttgctctttagagtccaaccataggagccccaacaagccagacagaatcaaaggcccatggagcgcccaagaggatcggatcctgacacgactagtcgaacaatacggccctcgaaactggtccctcatcagccgctacattaagggcaggtccggcaaatcgtgccggctgcggtggtgcaatcagctgagccccaccgtggagcaccgccccttctcgacccaagaggacgagaccatcatcgctgcccatgcccggtacggtaacaggtgggccaccatagcccgattattaccgggccgaaccgataacgccgttaagaaccactggaactccacgctcaagcgcagagccaagggtattaacgtt

SEQ ID NO: 4552 - DNA, 382 bp, Glycine max
tatgtcatgaactacttatcccagaaccccaaagttgttattattcacgggaagagaattcgtgactgaagaaccttttgactaaacaaggtacaatatggtagaaagagtccactaattctgtctatggtcaaaagagtaaagttgctatctgtgactgtgaatgctcccaagacatgtacaaacccagattctgattcacatgattagtacaaactttccctaacaagtgaaaaggctatttgctaatgccactcactcactccctcttcatattcagatatatgccatgcatatggattatggagatttaaattacatatttaagaagaaaagttctcaaaagaaatctcctatagatgaagaactgaatatagaaatc

SEQ ID NO: 4553 - DNA, 386 bp, Glycine max
tcctcgcttatatatattattttggtagtatcactagttgatgtgggatctccaacacaatcctggttgatgtcattgcttggcctttgctcaacttgggtggcttctgttgttgttgtcgtcgtcgtcatgtttcccaaacttccctcctcgccatgaggagggacggttatggaaacatggcatgatgattcctggctgagattcgcgcgacaaacgggacatgtcacgtgagatgtcagccaggaatcaatgcaatgagggtggaacacgtgattgcatttgggcagcagcctaagcgagtctttgtgagtgaaatccgttagacagacggcgcattcgagcgtttggttggccttattgaggtccttgatgttggagtaaaa

SEQ ID NO: 4554 - DNA, 857 bp, Glycine max
  misc_feature (63)..(70): n is a, c, g, or t
  misc_feature (654)..(656): n is a, c, g, or t
  misc_feature (658)..(658): n is a, c, g, or t
  misc_feature (683)..(688): n is a, c, g, or t
  misc_feature (691)..(693): n is a, c, g, or t
  misc_feature (695)..(695): n is a, c, g, or t
  misc_feature (701)..(704): n is a, c, g, or t
  misc_feature (732)..(740): n is a, c, g, or t
  misc_feature (742)..(743): n is a, c, g, or t
  misc_feature (746)..(750): n is a, c, g, or t
  misc_feature (753)..(755): n is a, c, g, or t
  misc_feature (758)..(758): n is a, c, g, or t
  misc_feature (763)..(763): n is a, c, g, or t
  misc_feature (769)..(780): n is a, c, g, or t
  misc_feature (783)..(785): n is a, c, g, or t
  misc_feature (787)..(791): n is a, c, g, or t
  misc_feature (801)..(811): n is a, c, g, or t
  misc_feature (828)..(830): n is a, c, g, or t
  misc_feature (832)..(838): n is a, c, g, or t
gctctgcccttcatttattccctctgacaccctcttaattctgcttccagttcctctgagtgnnnnnnnntgatctcttctcactcccacaattcccacattatagtaatcctcatcacctgcttatttcgtcataaattctagatcaaactccacaccctgatcctcccttttacttcttatggagcatgtatcaactcaaatgaataacatgaccctttagtctaagaataagaaaaacacacacacacacacacgcacaacacacttcaaagtccaaagtccacaccaacccaccaaaaagtcttgttcccatggcgagtggcaagctttatgctggttcaaacatgtcacttctcctccaaaacgaaaggctcccttgctcctctgaagtccttgagtctctttgggctcacacctctaaccctgcttccttccaaggagatggatgattcatctctcttccttctcaattcccttcactctcttcatactttttttttcttttactacttcccttgctcatgaattttcactacctcaacttttctgtcacatgtatacatacatacctaccaaggtttttaaaaaacggtctaagtcacaacatcaagcttcttgtggtttccatgaccatattctgaaaggatcgcnnncncaatttaaaaccttgatacatatannnnnnaannnancaaacnnnncaattggttttttttttttttggaaaannnnnnnnngnnggnnnnntcnnntanaaaanggggtnnnnnnnnnnnnaannngnnnnntttttttttnnnnnnnnnnnaaaaaaaaaaaaaaaannnannnnnnnttgggggggggggggtttt

SEQ ID NO: 4555 - DNA, 968 bp, Glycine max
  misc_feature (962)..(962): n is a, c, g, or t
gcagctgaaagggccacctcgacgtcgtaaaggagctcctccctcacaccagccacgacgcgctttcctctaaaaaccgctccggctttgacaccttgcacattgccgctagcaaaggtcatcttggtacgtacaattaataacatgctctaactcacgcaccacccctttctttcaaaggattttcgtatcctctttacttaatctatgcaatcctcacgtgcatacttcctcctcattacccaaatataatgataagagagttattatgctgcccttacaataatacaagagttttgttattggctcaatagttcaacgacggatttaagtatatcatgcgctcatcatcccaatcaaactttaactagagtgtgatgctaatctatctatctatagctatctgatatttctaagaatcttacgttacaaattctattattagttgaatacaaagatgaaccatgcaaataattatactttggtaacgccaagtgtaattttttttaaagaaaatattgagattacttaatatgctctagatatgatgtaaagcatattgattaaaatttcatcattaagtgtaaaagtgcaccaatatcttatgaaactaggaggtataagagaaatcacctttattcatagtattgatcaaagtttacttaagaggtacgaaatgaaaaagatgcattataaaatgttttgctagtatttgaggggaatgtgtacgcaacattacaactgtgtatattttattgtggcagccattgtgcaggcgctactagaccatgatcccggtttgattaagacgtttgcgcagtcaaatgcaactcctctaatctctgcggctacacgagggcatgcagatgtcgttgaagagttgttgtctagggatcctactcagttggagatgactaggtccaacgggaaaaatgcgctacatttagctgcacgccaggganatcgag

SEQ ID NO: 4556 - DNA, 377 bp, Glycine max
accagacttcaaccaacaacaccaacaagaatccgaggaagacgccaaaccccaagatgggccccaacagggcgacgtggtggggcggcgcccgtaggctccaagaacaagcccaagccgtcggtcatcattacgtgggagagcaccaacaccctctgcacccacatcctcgaagtcggcagcagctgcgatgtctttgaaagagtcgccagcgtgggtcctgtatcctcaacggcagcaaaatggtcacgaatgttatcctgcgacaaccggtgtcggcgggcgcggtggtgacgcttcacggcaggtttgagatactctccctgacgggatcgttccttcctccgccggctccgccaggggcaacgagtctcagc

SEQ ID NO: 4557 - DNA, 379 bp, Glycine max
tgtaaccggcggtttgcgtcgtttcaggcattgggtggccaccgtgcgagtcacaagaagccaaggttgatgggagagagtgatagccaagtgctaattcatggttcaccaccaaagcctaaaacacacgaatgttccatttgtggattggagtttgcaataggacaagctttgggagggcacatgaggcgtcatagagctgcagcagcatcaaatggaaacatgcacactactattaattcttggttgagttctagcaatagtggtggtagcacagttgataatactttaccaccaaacatgaacaacaaggctaacaacaccaagagggttttgtttcctgatttgaatttgacgcctctagatttgacgcctctag

SEQ ID NO: 4558 - DNA, 403 bp, Glycine max
aagtttttctcttttttattttctttctttctttatagctcctttttttccctcccttttattagattttggtacgtgttaatgtaatgtttgtttttgtaagagagagagagagaatgagaatgaaggagaggtgggtcacatgggaggggattagagacagctagcaacagctagctggtgaaagactcaacggttttagtgggaaaattggagtgttgtttaataactataggaatcagcaaccacgtgcagatgtgaccccttcacttggcatccattggctcatgtcatgatactgtataccgccatattataaaaatttcatttcatccctatagaacttaacctgggtagtttttatttttaatttttttacccctttctttgcctataaagcttg

SEQ ID NO: 4559 - DNA, 405 bp, Glycine max
atcggctcgacattcctcgagaaaaggcgcctcgaggaatgtgatggagtcgctggcggatcgccggtgggccccccgccgggccgacgagaagtcgagaaactcgtcgacccatgaaggcggcgggggagtcgtagtggcggtggtagtggaggttgtggggttgaagttggccattgagggtaccctttggtgagggaaagatggccaattctggggtatggttggtattttaggaggtaattgtgccattacctatgtatgtacgtgtgaccccaaatatagagagataccgaaattttgtgtctactgccgtataatggcctttgtgtatctaagagtgtgtgtctgagaaaatagagagagaaagagaaaaggaacaacagagatcccaacaacctaacc

SEQ ID NO: 4560 - DNA, 1067 bp, Glycine max
acaaacactttttttctctttgctctcttagacttgattttattgggaaacaatcctaggtaactctcttacttctttttcagttttacaagtcgttctcaaaagtcaaccctgctgcttgcttctctcggatttcttcttgttaattgttgcatccactgctttctaaacactgttttttggtgccttttctttcattgaaaataaaattaaattcagatcttttttcgtttgcatgtggctttgttatcttcattcgtgttgatgatagtttgtggtagttttttgggaggtcagagtggttggctattactgaatcaccaccgatttggaatttccaatccagctgatgttatgatgattgataattactcatgtgtgcaaattaagggagttttataataatcctctgagacttccaataaatttggagcaaaaagactttttttttcttagtaaatgctagtatattcactgagttttcacactggtcattcaattacaaattactacgcatgatgaatttgtttacttttataataattatttaaagtcatacttatcattatttgtgattgattgattatatccatgaaagaatttacatatatagaaattacactctttatttttttaaattttctcaaaggaccatttaaaatatgcttaatattgttctcatgatttcacaagtatatgcaactgcatttgatgtgaagctattggcctttttttcttgagctttaaattctattgaccccacgatgtgatcgattttctttacagcttctaaatctatacgggacaacaactgatataagatgggattatcaaattgctgcccatacagtataaggttttataatttcatagcttttttcatgtttggaattgaagactaaggaaatggagaaggtttgtgaattctgcacagctttgaggccacttgtttactgtaaggctgatgcagcatatctttgtctatcctgtgattcaaaggtgcatttagcaaatgcagtgtctggtcggcacctccggaactttgtgtgccactcatgcggatacca

SEQ ID NO: 4561 - DNA, 391 bp, Glycine max
atctctaccaccaccagatcaaccacaacggccacaccagaagcttgaacaagctctataggaacggctttccaggttccggtggtggtgccggtgggtttaggattcgaattcccactgggttgagcgcgccgcagcagcagcatcctggatctgcttccaaggtgtttgggaaggttgggaatcagagattcagccccaatttgaatcaaaaccctaaccctaatcttgggaagaagagggagagagaccccgtgggtgaagtggtggctgcgattaaggtattgggagatgggtttgtgagaatggaacagatgaagatggagatggccagggagatcgagaccatgcggatggagatggaaatgaagcgcactgagatgattctaga

SEQ ID NO: 4562 - DNA, 260 bp, Glycine max
aagagaaaggtccaccgacgaagaaggaagcgagacaaggtggcacaaaacaggaaaaactagaccagtttttgttggtggtgctgtgaaggggttcaagaaaatcctagtcctctacaccaactatggaaggcaacagaagcctgagaagaccaattgggtgatgcatcaataccaccttggcactagcgaagaagagaaagatggagaattggtggtttcaaaggttttctaccaaacacaacctcgacaatgtggta

SEQ ID NO: 4563 - DNA, 356 bp, Glycine max
cccatctaagcaaaaagctgaaaattcaaggaacagaagacacagacacacacaaaatgttagagaatcctcaagaagaggctgcaagtgatggtggcaacaacaacaaaaagaagaagaagaagaagaacggtggcaaaaagaacaagcagaagaacaaaggcaaagaaaatgatgagccgccaaagacacaagtttacctaccaaaaccaattagagtgaaggcaatgtatttacaaagaacggatagtaacaccttcacctttgattccaattcagctagtggatcaacaagccaagagaaggaggaaagccccgtgacaaaagaatcaaacgtggttagtgaagttggtaat

SEQ ID NO: 4564 - DNA, 717 bp, Glycine max
  misc_feature (689)..(698): n is a, c, g, or t
  misc_feature (700)..(711): n is a, c, g, or t
  misc_feature (714)..(714): n is a, c, g, or t
atgttcatggcttagttgccccagaggactgtcaggagattcattgaagaggttaccccaccatatgatctcaaaggcagagaatacctgctgtgcaatatgtttgcaggtgattattcttttttaacatatgtccatctcctaatcctttttctgtttcctatgtgaaaataattaaaaagaacaaagaatattcataaggaggctctggaaatactaatattaaagcagtaggtaggtattatgtgcataattaaccaaggaagcctctaatttttcttgcttgtgaggatattaatgagatttaatgaccacaaaatgcataacacttcctacaagtcttcattattcccatttgagtttttttttttaatgaaactgttaatgtaatgatcttaacattgagaagtgaaatttacaggatattgaagtaggggaaattgcaagaagcttacctcgctgtcaccatacatttcacttgatatgtgtggacaaatggcttgtcaagaatgattcttgtcctgtctgcagacagaatgtataacttgttccttgggcaatttgagattatctttatgggcggatgtatatgttttattatttgtttctttacatacaaactgaaattaccattaagttttgtatagttgacattggcattttgtactattctgcgatgtaatgtaaannnnnnnnnnannnnnnnnnnnnttnttt

SEQ ID NO: 4565 - DNA, 968 bp, Glycine max
tatttatttatcttacttagttttccttgtcaatttgatttggtagaaaatagtcaacaatattgatgtatgctaggatttttaaatctttttggcacattttgtatatagggcatatgataaagcagcaataaaatgtaatggcaaggaggctgtcaccaattttgatcctagcatctatgatagtgagcttaattctggtaattacggaatgaactgagcttttttgtcttcactaatgttctaatcaaagtttgtattttattattctcattcacaagacgtaaattgttaaatacattattcgatggcagaatcctcaggaggtgtagctgcagatcacaatttggatttgagtttgggtaatttgatctctaaacatagcaatagtcaatcatcgaggaatcacttcccaaattctgcaaccgatcagcatatgccacctgaatctaattggcagagtgggggaagcaagcctaaggttcatgtaatattttctaaaattcgttatttattggctagttcactcttatgtatgattaatggaaaaatgtgtttttaattcctataccttcaatcaaacataaataaggttctctatactttggtgaatttaatcttcaaacttttaagcgtatgtggatttaagtctttattttgggtgatttttattttcataaatagtcaattagggacagtatccatgtctttcaaaatttgagtactcaattcactgatttaagagtacaattgttgttcacgtttgattgatagtataaagatcaaaaatacattttttttttccttcaactaatttcctgctgaattctacatgaacaccccttttgactcctcatcatatttcattcagctggtaaatatacttccaaaaccatgtggtagaagcaacatagaagcctatgggcacggtgagagtgaaaccttgaggttgctaagccaaactcacc

SEQ ID NO: 4566 - DNA, 215 bp, Glycine max
cctcggcggccaccaaaacgcgcacaaacgcgaacgccagcacgccaaacgtgcgcacctccagtccaccatggttcatggcagcaccttctccgacgcgcaccatgtctacaatctcatgaactaccgctacggttcttccattccaacaccaccaccaccaacaatgccttatccaacatggaacaacaacaacaacaacacgcgcttctacg

SEQ ID NO: 4567 - DNA, 349 bp, Glycine max
tagagttgcacaatcagaatgggatgtgttttcaggctgcggtgaatgatgggtttaggaacgcttccgtcaagcgtattggaattagcagggttgattcgtaaatagtatcatcggagaaaagaatgttcatttgctcctcctaatgggaaaaaaataagaagaatctgtttttttccctgttcttttttatttttaatcaatgtttttaggcaataattatggttaatgtacagtgagacataactcgatcgatccgaaggagaatggtaatcggaagaaagagggagatagataggtgttattacccattagataaaatctgaaatctatgttgtaactttttttt

SEQ ID NO: 4568 - DNA, 687 bp, Glycine max
aaatttttttcgcaaatagagagatcaaggtttaaatctggcaatgcacatgatgactcagcctcaccactcgcagcatctgagacttcaccatggttgtaaacacgaggtgatttgcttgtctcgttcttgctattattgtctttcatgccaaagtgttttgaactatcatcagacataggtggattctgataaacggaagggattgtatggtttaatctatgattatttgggtcaatgccattgctaataagcttttttcttatatgagaattccaataattcttcacttcattatctgtacgtccaggcaatctcccagctattagtgaccacctgtacgaatcaattttaatcaatgattttttttcctttataagcacaatttatacaaccaaacaatgaattatgttagaaaacccttttagcaatgtacgttgaaaaaagttaacttaaatttccatttatattatttagtggtgataatatggttgctcagtacacatatctaccttataatcaaaattcttttcattcttttacacgcacaaatacacacatgtataggtcatcaaaagcacaacaaaaaagtgggtttatgttatgtttcgaattaaaaattcgcaccggttgcctagcagggcatgaagcttgatgatgagatcttcttcatcttcagcaaagttg

SEQ ID NO: 4569 - DNA, 995 bp, Glycine max
aagacagtaagattaaagcctttgttgatactccagccttggattggcaacggtgggtagagtatcctcctttccttagttgtgttgtttggtgcatgtagtcatcacagaatggaaataagtatgatgataataatcaatgaaacaaaaattactaattctttcccacctacaagaaaggatgttaccatctcttcaagaggaaatggggattcctgaactctgaaaaacctgtattggaatagatattccaagtttttttcctaccaaactaatactatgtcaggatatctagtgatgggtggaatggaatgaggtggggagtggatataatggaataaaattaccatatcaatgtttggatattataagatggaatggggaaagttttcattttattgtttaaggaatcagaagtgaatggaattgtaagattaggggagtgagggaagaggaacataaaggtatccaatggaatgggatggaataaaccccatcaggttccattccatttcaccttttttaaaaacaaatcaatggcaactaatgtctttccatttcccaccactccataaattcctacatagtccaaggcatccccatttctattgaagatttctttctatgcagccagatgtgttcttgttttggctttatgatatttatgttatttttttatttcaattttggcatgcagtcaaggttcagattttggcactggtagaggctttggaaggggtacagggggacggatgggtggtggacgtggttttggtgattctctgtctattctaatatctacatgttttcagttaattgctgtttttaattctaatatgttgatcgcacactgatgctgaggtctgtcagggatggagcgaaaaacacctccccaaggctatgtatgccacagatgcaaggtgcctggtatgttgatgtttgtgtactttctaatcactctctgcttgcatattgcttcatagcaatgagagttt

SEQ ID NO: 4570 - DNA, 369 bp, Glycine max
cattcctctcccttgatttttgacatactcaagaaagagagggatgagtcagagtttgatgcagccactgaaagggtcaataaggagcaaaacatggcaccacaagaggcagagatagtggcaaggacacttttccctgtgactgctgctgttgataaaggagttagagtgcctgatttcaaattggggctgtgggggaagactgaatgcttgaacttgtccttaccagagcctgatggacaaaatggactcagaaccttacagcagaaggtacctcctgtgaggaaaaataggagaggaccaaggtctcgcagctcgcagtaccggggtgtcaccttctaccgcaggactggtagatgggagtcacat

SEQ ID NO: 4571 - DNA, 546 bp, Glycine max
attgaacaggtctgagccttgggatttgccatgtaagttcaaaacaaaattaaaaaattcagccccactttggttttggtttatttggcttctaaatatatttttgtcttacaacgagaccatacagactcaaatatattaattgtgtaagtttattataacattatgttgtgtgcatgttttttattttttgggttacagggaaggccaaaatgggagagaaagagtggtactttttctgtgtgagggacagaaaatacccaactggtttgaggactaatagagccactgaatcaggatactggaaggctacagggaaagacaaagagattttcagagggaaatctcttgtgggtatgaagaaaactttggttttctacaaaggaagggctcccaagggagagaaaactgattgggtcatgcatgagtataggcttgatggtaaattctcttttcacaacctccccaaaactgcaaaggtaataataataataactaataacaactttgattttggcttgatcatgttgcttcctatgttccact

SEQ ID NO: 4572 - DNA, 1183 bp, Glycine max
  misc_feature (404)..(409): n is a, c, g, or t
  misc_feature (413)..(415): n is a, c, g, or t
  misc_feature (417)..(417): n is a, c, g, or t
  misc_feature (425)..(428): n is a, c, g, or t
  misc_feature (440)..(444): n is a, c, g, or t
  misc_feature (446)..(446): n is a, c, g, or t
  misc_feature (449)..(450): n is a, c, g, or t
  misc_feature (453)..(456): n is a, c, g, or t
  misc_feature (459)..(470): n is a, c, g, or t
  misc_feature (476)..(476): n is a, c, g, or t
  misc_feature (478)..(478): n is a, c, g, or t
  misc_feature (480)..(489): n is a, c, g, or t
  misc_feature (491)..(495): n is a, c, g, or t
  misc_feature (497)..(497): n is a, c, g, or t
  misc_feature (499)..(518): n is a, c, g, or t
  misc_feature (523)..(525): n is a, c, g, or t
  misc_feature (532)..(537): n is a, c, g, or t
  misc_feature (540)..(542): n is a, c, g, or t
  misc_feature (545)..(546): n is a, c, g, or t
  misc_feature (548)..(552): n is a, c, g, or t
  misc_feature (559)..(561): n is a, c, g, or t
  misc_feature (565)..(567): n is a, c, g, or t
  misc_feature (570)..(570): n is a, c, g, or t
  misc_feature (576)..(578): n is a, c, g, or t
  misc_feature (584)..(603): n is a, c, g, or t
  misc_feature (608)..(608): n is a, c, g, or t
  misc_feature (614)..(622): n is a, c, g, or t
  misc_feature (625)..(626): n is a, c, g, or t
  misc_feature (630)..(631): n is a, c, g, or t
  misc_feature (633)..(635): n is a, c, g, or t
  misc_feature (637)..(661): n is a, c, g, or t
  misc_feature (665)..(676): n is a, c, g, or t
  misc_feature (683)..(687): n is a, c, g, or t
  misc_feature (691)..(700): n is a, c, g, or t
  misc_feature (702)..(710): n is a, c, g, or t
  misc_feature (712)..(714): n is a, c, g, or t
  misc_feature (720)..(728): n is a, c, g, or t
  misc_feature (730)..(762): n is a, c, g, or t
  misc_feature (766)..(769): n is a, c, g, or t
  misc_feature (772)..(778): n is a, c, g, or t
  misc_feature (780)..(782): n is a, c, g, or t
  misc_feature (794)..(798): n is a, c, g, or t
  misc_feature (800)..(809): n is a, c, g, or t
  misc_feature (813)..(818): n is a, c, g, or t
  misc_feature (822)..(827): n is a, c, g, or t
  misc_feature (829)..(847): n is a, c, g, or t
  misc_feature (849)..(850): n is a, c, g, or t
  misc_feature (852)..(854): n is a, c, g, or t
  misc_feature (860)..(860): n is a, c, g, or t
  misc_feature (872)..(875): n is a, c, g, or t
  misc_feature (879)..(888): n is a, c, g, or t
  misc_feature (902)..(904): n is a, c, g, or t
  misc_feature (907)..(908): n is a, c, g, or t
  misc_feature (910)..(910): n is a, c, g, or t
  misc_feature (915)..(915): n is a, c, g, or t
  misc_feature (917)..(924): n is a, c, g, or t
  misc_feature (930)..(930): n is a, c, g, or t
  misc_feature (932)..(950): n is a, c, g, or t
  misc_feature (952)..(961): n is a, c, g, or t
  misc_feature (969)..(969): n is a, c, g, or t
  misc_feature (979)..(986): n is a, c, g, or t
  misc_feature (989)..(995): n is a, c, g, or t
  misc_feature (997)..(999): n is a, c, g, or t
  misc_feature (1002)..(1013): n is a, c, g, or t
  misc_feature (1015)..(1028): n is a, c, g, or t
  misc_feature (1034)..(1036): n is a, c, g, or t
  misc_feature (1038)..(1042): n is a, c, g, or t
  misc_feature (1048)..(1054): n is a, c, g, or t
  misc_feature (1056)..(1070): n is a, c, g, or t
  misc_feature (1073)..(1073): n is a, c, g, or t
  misc_feature (1075)..(1076): n is a, c, g, or t
  misc_feature (1083)..(1109): n is a, c, g, or t
  misc_feature (1116)..(1127): n is a, c, g, or t
  misc_feature (1134)..(1151): n is a, c, g, or t
  misc_feature (1153)..(1172): n is a, c, g, or t
  misc_feature (1174)..(1176): n is a, c, g, or t
tgccaatcttgaaaagaaacacaacaataaacgtgcacgggaattggaaagtggtggagcaatggacatgcttttaactgcagccaatactctgaattttgaagagaaagaggcggcaagccacatcaagttacagagaacatgaattttgtggtgggcttcgttaaccttccagttattgttagtagtgactttaacttcatatttgttgactgttaatacacagtattttgcatttgctgcattttttgaatgactgatattttggtaggctgtaaaactttcatagattttccgacattttgatacatcacatggaaagacatgactagagaggctaaagagcaaaaggcataatctgaagctgctctaagtgccatctgtcagagtaagcagattttttnnnnnncccnnntnttcctttnnnnttgggggggggnnnnncnctnnttnnnntcnnnnnnnnnnnntttttncntnnnnnnnnnnannnnnancnnnnnnnnnnnnnnnnnnnncaccnnncctcctnnnnnntcnnnctnntnnnnncccccannncacnnnccnattaannnccttannnnnnnnnnnnnnnnnnnnaatcntctatnnnnnnnnntanncccnncnnncnnnnnnnnnnnnnnnnnnnnnnnnntttnnnnnnnnnnnntttaatnnnnncttnnnnnnnnnncnnnnnnnnnannncccaannnnnnnnnannnnnnnnnnnnnnnnnnnnnnnnnnnnnnnnntttnnnnttnnnnnnnannnttaattaccatnnnnncnnnnnnnnnncccnnnnnncccnnnnnncnnnnnnnnnnnnnnnnnnnanntnnntcccancccaacacttcnnnncacnnnnnnnnnnctaatccctccccnnnctnntncctcncnnnnnnnncccccncnnnnnnnnnnnnnnnnnnncnnnnnnnnnnccaccctncaccaattcnnnnnnnntcnnnnnnnannntcnnnnnnnnnnnntnnnnnnnnnnnnnntttctnnncnnnnntctcannnnnnntnnnnnnnnnnnnnnntancnntacccannnnnnnnnnnnnnnnnnnnnnnnnnntacactnnnnnnnnnnnncaccttnnnnnnnnnnnnnnnnnncnnnnnnnnnnnnnnnnnnnnannncttccca

SEQ ID NO: 4573 - DNA, 537 bp, Glycine max
gagttcatcaagaaggattttgatcgaaaatgtgacctgctaaggcatcaatttgcaaaagatgaaggcaataaagtgattgacaaaacccgaacagtagtgaaggatctgcattcacggataatagtggctatttattctgttgatttaatatctaaacgaatcgagaggatgagagatgaagaattgttcccacaacttttggaattaactcaagggtaagagaaaattttgaaatttccacatttgtgctgctgaacctgaaacttcataagcagtttgctatacttgataattgaagtgttagtatgtagtagtattggcttatggaaatgttagcagtgcaggttgatgaggatgtggaaggctatgcttgaatgtcatcatgcacaatacattactatctctttggcttatcattcaaggaactcaatgagaactttggaaggagatacccgaagagagataatggctcagctactagaagaatttgagtgctttggtctaagcttttctaactgtatcgacagccacacc

SEQ ID NO: 4574 - DNA, 799 bp, Glycine max
tacagtgatggtgttctcacattgacacttaaatctaaggtttgtcattctaatttttcatcattgtaatgatgtttatgatttatgaccttctatatatcatagacaaaccagttttgttgggggcattgaaatcatttgttacataagcctagctgatgagaagagaaagttaactttgggctagaacattattcaaatattagattatttcttaggcatctacagtataaaaaaaatttatactctcaatcaatcaagaattatgttagggatgatttttgaagtaattataataaaaatcaataaaattctttccattatcgatgtatgtactatttaattttaaaatattctagcccatagcagtgagctatttggagtaattatagagagtcttacttggaagtcactttttataatactaatcgatttcttttaatcattagaaaagtttgaactctaaaagaacttttttctttttctcagtttcgaggagcagcaacagcaccaatgaggatgatcaaagaagcgctgtggaaagtatctggaaatatttgacatggctatatggatttcacaggatagtagtagtaatagtaaatacttatgattaaacaactttaacaaaatatgtatgtcttattgtatgaacctagattttggctattgtgcttaagtattgacttgttagagttaccagagctccattctgtaatttaatttcgtgctattgtaaatcacttcaatcaatatgttagcatgcatttgcatgattctgtttgttgttactgccagc

SEQ ID NO: 4575 - DNA, 360 bp, Glycine max
caccaaggccaagaccttaacctagcatatccaccagctgaagactacaacactgtgtccatgtcaaagctcattgaggttccttacaacactgaattaacaagggtggccttcatcaaaaccctacttcctcatcaacaccaacatctgcatcttctcaccatcagttgtctgccatggagcttctcaagactgggattgctgctgcttcctcaaggggtttgaactccttcatgccaatgtataattcaactcatcatggatttcccttgcaagactttaagccaccacatcatggccttaacttcagtcttgaggggtttgataatggtacttatgggggtcttcatcagggaattc

SEQ ID NO: 4576 - DNA, 408 bp, Glycine max
agctgatgatgcatacttgtgtagaaaatgtgataaaagggttcatgaagctaattttttggcccttaggcacattaggtgctttctgtgcaacacatgtcaaaaccttacgcgaagatatctcattggagcatcaatagaggtggttcttccagccaacattaactggaccattggaaatctccctagcaacagaggaatccacagaaagtgctcaagaatgcataacaacctttccctcttgttataacttccatctttctttttttctccttagaatatcttttgtaatagaaaaggttagtgagtaccatctcaggtacatagggaagtgctaaatgtttttaatgtcatgatttaaaaaaaatgattggtaatagaaccgtgttcaatagaaggagggcattt

SEQ ID NO: 4577 - DNA, 379 bp, Glycine max
gctgcaactgcaacaacagctgcagcagcagcagcagcagcagcaacagcaacaacaacagcagcagcaacagcaacaacaaacagcagcaacaggaacagtaacatcaacaaacgggggacatgaatagggaggggacacagatagcacctcatcaaatgtaaatccttctgcggaagaggattttagagactacaaattgctttctcttcatcacttttaattacccttttgtttagagtttgtttaggtcacagtcattatatttcttattcatgaaacactacagatagtcctagttagagattgagaattatgcattggatcttggctatgcaaaattctttgccacctttggttgtggatcagcggggcggat

SEQ ID NO: 4578 - DNA, 405 bp, Glycine max
tgttctctgcactagggttgttcgaaatgtcttcctggtcctcacgcgtgctctgagttcctccgccgccggacgtcgacggcaacgccagcgtcccccccaccgccgaacggagttgtccccccatgtgaaggtaccccgccggatgccggtagtaccccgaaaactgcggcggcggagggtggtggtggtggtgatgatggggaagaaagtacgggtccccgccggagagggagaccacggcggaggaatccgcctccttgcggtggaagttgcggtggcagctgcacgcggcgcatttcagcgcgtccagcgtaccctccatccccgccgccatgaactcgccgcagccgtcgagcgcgtggcctccgattccgacggcgtggttctttaaacactccctgt

SEQ ID NO: 4579 - DNA, 410 bp, Glycine max
ctcggccagttagagaagttggtgattcttcaagtgttcctgcaaatgactctgccgattctgactgtgtagaatgcaagcctggatcatccaacatcaaccccagctgtagcaactcagaacacgtgtcaagagctaattttggaacaacttttgggccaatatctgagaattctggactcaatggaaactcaacttttgagcattgtacaaacaatggtgacaggagcagtaccaggttaatcggaacatcttcacaagaaaatccaacctgtggttctttgtgttatgagccaccacagttagatggttcagttcccatagattctctttatttaaattatacttgccagcagaatgagtactgtccgagtccaacgatgtcacctactggtttcttcactccacca

SEQ ID NO: 4580 - DNA, 356 bp, Glycine max
aatattaatctcttaccaagagcaaatcttaatcatccttcattcttgggcttgctgaatactatgccacatggttaccaatgggaaccttctgctggtgatgtttctcatcagttgggaaacaatggatttgcaaaccaaacagatatgcacagcattaacgttgtacctttcccaacatcaacattgtcattatcaactgggaattctcaaattctgctatgtcctccaggaacagcacaaccatatttcccttcacatgttacgatggacatggatccgagacaaatcaaccactatcagatgttgagttcaggttctcaaaatccattggcgaattatctcaatcattcttt

SEQ ID NO: 4581 - DNA, 201 bp, Glycine max
gtgagcgcatgggattagcaacatcgagtgaaggaaagaaacaaaaaacaaaaaaaagagaataaaaaacggtgtcgtttcgagattcgaatcaagccaactgaacatgaatgatgaatgatgaatgatgatgaatcacagagtagagaaaagtgagaaccgagaaagagaaacggtggtgtttttttttttaaacttttt

SEQ ID NO: 4582 - DNA, 371 bp, Glycine max
ttatgcaacgtcgaagccgttaagttcatggcggacccagaaaccgaccaagtgttcgccaagctgagtttggttcctctaagaaactcggaactcggtcctgactcggactctgctgctggtgatgacgcggcggaaccttcttcttgtgaaaagcctgcgtctttcgccaagactctgactcagagcgacgccaataatggtggggggttttcggttccgcggtactgcgcggagacgattttcccgaggctcgactgcacggcggagccgccggtgcagacggttgtggcgaaggacgttcacggcgagacgtggcggttccggcacatttaccgggggacgccacgtagacacttgctgacaacaga

SEQ ID NO: 4583 - DNA, 383 bp, Glycine max
attcagtgaaaccccattacacatagcctctttgctaggacatttggaattctgtgaggcacttcttaaaagaaaaccaagtttagcaagtgaagttgactctgaaagacgttcccctcttcatttggcttgtgctgaagggcacactgaggttgtgaaagctcttttgcatacaaaccctgatgtttgcttggctatggacaaagatgaaatgcttcctctccacttggctgtgatgagaggacacattggagttattaaggagttgaccagagccagaccaggctcaattcaacagaacactattgatgatggttctgttttgcacttgtgtgttaggtataatcatttggaggccttgatattccttgtgcaatcagagg

SEQ ID NO: 4584 - DNA, 381 bp, Glycine max
ctcatcactcccattctcaggagtgccctgtttgcaaggcccttgtgcaggaagagaaattggttcctctttatggaaggggcaaaacacagaccgatcccaggaccaagttatatcctggaatggagatcccccaccgtccttccgggcagaggccgcaaaccatgccgcccccgccgcctcccgaggtcaacccatttgggagttatgggtttggactcatgggagggttcattcctatggcaactgcccgatttggaaacttcacgctttccactgcctttggtgggtttatcccgtccctgctcaacattcatttccatgggtttcaggatgccactgtctatgggacaacgtctggttatccctttgggtttaatg

SEQ ID NO: 4585 - DNA, 398 bp, Glycine max
  misc_feature (395)..(395): n is a, c, g, or t
ctttcattccttgaaagtagcggtggagggtatgaggaaaggtgatatatgtcatgcatggaattggaacattgcaattgtattctgcaatgaagaaataagttaataaccaactagaaatagttaggagggaaaaaggtggcacagaataaggagaaactgcttcatctgaaagctagtggtcagatacttcaactgaggaaaaaaaaggagggggtgaggggggcaacgtaaagaaaaaaacaaaatgatttggcttgtaactttgttttctttcttttattcttttgaaatttttgaatggtagctgttatcatgctttgtacagtgacacgaaaacatatctcaattgtccttacttgggtaaatactaaccatcaatctgtgccaacatnaaa

SEQ ID NO: 4586 - DNA, 574 bp, Glycine max
gtaagctagctagtgtgtgagtatgaccattgcagctaattttgtcggtggacatcgtgtaaattaaggatgcactttcataggcaccattagtaatcaataatcatcacttgaaagaagcaaagcaataaaattatggtgttaattaaataaacgaagataaatagtatcttatgaagataaaaacatttttttttagtttagtaattagaagaattggtgaagggggtttagaattattgaagtaaaaaatgtagcatagactagactacatgttgatctttgttttttatctttaggtaatatgggtggagcacttggaatgccagaagagtgcagtccattcaatgtatcgcaccattgtgaacagtggcctagcttttggggccaggcattggattgcgactctacaacttcaatgtgaacgtctagttttcttcatggcaacaaatgttcccatgaaggattcaaccggtgagtaataaattataataagttatttctactttgttattaaatacttaacttaggagcagctacaaaatggaagagtgttgcatgacaaaatgttagg

SEQ ID NO: 4587 - DNA, 357 bp, Glycine max
aagcagaaagagtctaaatctaaattatataaaatgaagtttacttgggttaaagaactacaaattactactttgaacaaataaagacaaacaaaagtctatataaacaaagaggattaagcacaaaagattgaaatcaaactcctcagcacttgcatacatttttttcttttatgtttatttgttcgatgtggggctttataattctctaacactgtttaagcaatatagatgcatgaggttcaataaaaatttgatttcaacctttgttcttcatccatgtaactataacctctgatgctgcctcctcctgttgcagcagcatttctgtaattgggcaagggcacgtgaccttct

SEQ ID NO: 4588 - DNA, 549 bp, Glycine max
  misc_feature (423)..(442): n is a, c, g, or t
  misc_feature (448)..(451): n is a, c, g, or t
  misc_feature (457)..(457): n is a, c, g, or t
  misc_feature (459)..(460): n is a, c, g, or t
  misc_feature (462)..(462): n is a, c, g, or t
  misc_feature (464)..(466): n is a, c, g, or t
  misc_feature (470)..(484): n is a, c, g, or t
  misc_feature (486)..(499): n is a, c, g, or t
  misc_feature (503)..(503): n is a, c, g, or t
  misc_feature (505)..(515): n is a, c, g, or t
  misc_feature (520)..(520): n is a, c, g, or t
  misc_feature (524)..(533): n is a, c, g, or t
  misc_feature (535)..(535): n is a, c, g, or t
  misc_feature (539)..(541): n is a, c, g, or t
tactcataaacctcaacataaaagcaaaaatgataactctaggaaaaccacgactaagcaccatcgaggaattttcttgcatagacagtgcctagtggtttaagcatgcaatcaggactgtttgggatccactgcaaggcacacatcataatgaatgtgcatttgtattgtctatgcaagaatacctacagcactaaaacctaaaacacgctctcgtaatagggaccaaatgcaacaacttactaaccaggaatagcattttcctcacagaatgtcagcgctgacatatccatagaggtgacacctcttgaacctagctctctgaaggatatgtgctcaaaagtgaaattgttgtctcgtgagttgcagtcgtatacaccatctacattagtaccctttagaactgcttcagcattaactgcnnnnnnnnnnnnnnnnnnnntgatgnnnncaaaancnnanannnaaannnnnnnnnnnnnnntnnnnnnnnnnnnnnactnannnnnnnnnnnggggnaaannnnnnnnnnanaaannntttaaaaa

SEQ ID NO: 4589 - DNA, 372 bp, Glycine max
ctggctgggcacattcgatactcccgaggaggccgccctcgcctacgatggcgccgcccgctccctccgcggtgccaaggccaagaccaacttccctccggcgccgcccctctgcctcgacctcaacgtcccttcctccgatcaccgctggccccaccacgtccccccccgcagcctcgtcctcagcgacttcctccacaccgccgttctcagagatatcgacccgccccaacaacctttcccacccgccgccgcagtagctcaccgaaatccccacggcggagctatgcccgttggcggcggggttcaggtgatggagggttctccaacggcgtcgtttttggggttcgttaggcgcggcatccccatcga

SEQ ID NO: 4590 - DNA, 381 bp, Glycine max
atgggagattgaatttacattttttgtctgattacataaaaagagatgagcaaaaatatacatgtagattgtgtgctatacatgtcaaaggtaagagttggccaaatattacaatttacaatctttgttaagccacttatcatgccatctcaggcacttgtacatgtgactatagcagaggggagagtttacatgaccacatcacaggcatggaagtatggttaaggccaaagaacttagaagaaggctttttgaattcttggaattatgcagcagaaattgccaagctttaacataaaggcaatccaaacaccattgcctgaagggggggggcactttgtgataacatcattatcacaagttggacatccttcacagtaa

SEQ ID NO: 4591 - DNA, 1548 bp, Glycine max
  misc_feature (1516)..(1518): n is a, c, g, or t
gagttccaaattatttcaggatgagcacaatatgaagtactcaacaattggtgatgacattgatattctatcaagaaatgtaagccatttctttttgcttaatggttttttatttttgccatgtgcgtttttgagcttgatgtattgcgagttaccaattctctgccacagaattgaaactagttcacttgtgttacttcaaatttacagttactggcatgttcaagaagttatagtatgctacttgtctctttttataaagtgagagtcattggattgcaaatgttggtatgaatgtgatgaaatggttttgaatgggtgatgctaaggtatattggttgtgtatcattgtttcgggctctctaaggatgtcaatggagtatgcgaatgctctatagttttctttgtcttccaatcattttgagaaatattgagattctgacacaccttaattataatgaacctgtggatttcttttttaaacgaaatcaatgttgaaaaagaaagttgcagtagaagtgggttagtagctttgaaatctgtacatactgacaaaactgtgggccttcatagctttgattaagtgtacagagtttcacatggggagggacaatagaggacggaaggatttaattgctaaagacgcacagagtcttccaactttaattgtctcaagtatatccatatcattctttaacagctgcatccatatcatttaaaagccgaagatgcaatcatgcttctcattctcaagtgagatggtgcagagagtatgtgataaccaccatggcaccatctctatgtttcacatgggtaatttttccacaatttattgtgttatgaactgttatgcaatgattgcagtaaagttcccatatgatttggctttctcattcattatttgtcagatatttctatttcatgtttgtgttttaactttaatctggagagaaaatgtgaacaatgaattattaatctttacaaaaattgcagaatcaatcggatcagtcatcatcaagccatgcaaagaagaaagaagagaacaacaaaaaagctaaaggtgggttatcatcagagtccaaactgtttgaatccataccgtacaatggcaccaacaatgtcgtagtcatggagcatcttgttggtgggaatgaaaatgttggcaccttaacagccagggttagtttggaagagttggctaagaatagaggggatgccatgttgcgttacaaggagaagaagaaaactcgaaggtatgtttagtttaatagaataaatagtctatacactgccagcataaaaaaaaattatactgttatccaatcataaattcacaaattaacatggataataaatttgttagttttataataactattttaagagttatatttatcatgatttcggattggttgataatataaaaagaaattgtggcaaatgcaagtgaatatgtatgcataaactcatctatctatacatgcaggcaatatgcacatcattttattttgagaannnattacattgcatctttatttgaagtatacg

SEQ ID NO: 4592 - DNA, 727 bp, Glycine max
  misc_feature (56)..(56): n is a, c, g, or t
  misc_feature (627)..(628): n is a, c, g, or t
  misc_feature (654)..(657): n is a, c, g, or t
  misc_feature (664)..(665): n is a, c, g, or t
  misc_feature (667)..(669): n is a, c, g, or t
  misc_feature (671)..(672): n is a, c, g, or t
  misc_feature (679)..(684): n is a, c, g, or t
  misc_feature (687)..(688): n is a, c, g, or t
  misc_feature (691)..(698): n is a, c, g, or t
  misc_feature (700)..(705): n is a, c, g, or t
  misc_feature (707)..(709): n is a, c, g, or t
  misc_feature (715)..(716): n is a, c, g, or t
  misc_feature (718)..(719): n is a, c, g, or t
  misc_feature (723)..(724): n is a, c, g, or t
gtactttgatcattttctttttattttgacttttgtttttgtttttatctcaattntatgataattggtattgttgttaattaattatttgttaattaccattaatcatctttcattgtcaccttgcgagtggttaattattattcattgatctgaatttgttattttttatgggtatgtgtgtgtagagaaagcaaagatgggggagaaagattggtacttcttttgccaaagggataggaagtacccaacaggcatgcgaaccaatagagcaacccaatctgggtattggaaggccactggcaaagataaagagattttcaaagggaagaacaaccttgttggcatgaagaagacccttgttttctatagaggaagagctccaaagggtgagaagacaaattgggttatgcatgaattcagattggatggcaaattcgcatgttacaaccttcccaaggctgcaaaggtaattaaatactaattactaattaactacctcactttctctctcttttgatttttttatgacattttttctatggattttgaggaagctgaaaaaaggttgagatttaattaataatcatggatttttttttctttctcatcaatctccctggcttnnaattaatcatcacttttttaaaaagnnnntttgtgnngnnngnnagctttnnnnnnctnnggnnnnnnnntnnnnnntnnntttgcnnanntagnncaa

SEQ ID NO: 4593 - DNA, 962 bp, Glycine max
ctttggtctctaccccatgtctccttttctcttttccctatctctgaccaaccttgttctcctgtctgggctttttctgatgccgaagatgagaggctaatcaggattgcagcttcagcaggtatctctttgttaattgccacagttttctattttgttgtatgtcttggtttgtttcagtttggatgttgaattggatattggagttttcttcaactttttaggacttgcttgatttcaagttgactataacttgaatagtaaccactgttgattgtgaaatttaacaaggtttatgaaaattgaaggaattttaacctttttttattattatttccatcactgttcttgaggctctaatttgttgagaatattgattataaggcaaatgaaaatgcatcaactttgcggcatgtatctgccaccttggattaaagatgaattttctttttatctccatcttataaattaaatagttaaactataaggcttcatttttgtgtaataatttctttatacctttcattttctttcaagctatctcatatttagaggccataatagctttgtcaataattcctactttcttgggatgttgactattgcctgcataagatgtattttggcatttgtagttgtttataaacttagaagtgttagatataatatgatattgagctgaaacataactgtacaaataattcatagtttattccaatgacatctgatgctaaacatgagctttatattttttgatgactgaagttactgctttcaggtaatacaaatacaacaactgaaaatctagttgaaaattatgacaacaaaaaaactgtgccaccccttgtagccatcccaacttcagaaaatccagatgcttattgtctaatcaaggaaagaatgacacaagcgcttcgccacttcaaagagttgactgaacaaaatgttctagctcaggtttg

SEQ ID NO: 4594 - DNA, 217 bp, Glycine max
catgttttctcttgatctcactttcccgtcacatgttctgatagtatagataaggtgtaaactattagtgtctctgggtcctgcggattatttgttcttcattttttttatatgtccatggcctcatcaagtggaaactcctccattagcacaaaatctcagagctctggctccgagggtgatttgcaggttgttgttgttgttgttgttttttttt

SEQ ID NO: 4595 - DNA, 1214 bp, Glycine max
  misc_feature (20)..(21): n is a, c, g, or t
tatctcgtattatccttttnngtgtaagcagtccttaatttggttaagataactttaagatctcacaaattcttttggtgcaaatgaagttaagttgtttctcatgaacgtgtactataaggctattgttattattgtgtgtgtgtgagtgtataattatatatatctcacctatatgtagagtactttggtttctttcttacctaattaattttacttatataaagtttggtggtggaagaaaatatgtccaatttgacgtctgcatccagtgaaataagtgcttcttcaggaatcaggaatgacaacggttcttctctctatgctcaatattcctctacttcaataagtcaagaaccacaacctaaaaagaagcgaagtcttccaggtcacccaggtcatacataaataatcaaccatatatactactattttctattttcttttaattgatagtggatttgctgcaaaaaccaacatttaatttatttcctacaactagtgccaatttaattcaccttattctgaaaaataataatttgcctttttcagttttaccagagaattttttttataggacattttgttttgcaatatacagcaaaactcaagtgcaatttgttaaatgtttttagtgttgttcttgactgagaatcggtgtttcatttcagtaatttatgtaataaaatattgtaataaatatatcatctacagtagttatgaaagtaaaattccacttctagttaaagaataatactataaaggtacctaagtaattgcatctagatttttcatttgatatgacaaatatcttctacagagtttaatccggataaaaattatatacaataaaactcttcctctgactattacaaagacgtacaatcctacatctagattttatcttatattatatatatctgcgaacaaacacttaattagttgtatatataataatatatgctgttttagaattaaatcatgttgtagtatgcctgatctgatggcatagctagatttgaatcttagaattgtgtcggtctaaatttttttcactaattaattgctggtttaatatggtacagaccctgaggcagaagtgatagcattgactccgcggacccttttggcaacaaacaggttcgtttgtgagatatgtcacaaagggtttcagagagaccagaacttgcagcttcatagaagagggcacaatt

SEQ ID NO: 4596 - DNA, 412 bp, Glycine max
tttgggtgtgtgattcaacaccagctatagctgggggagtgaaggtaaggttgtgaacattaatttgcttgaaggagggtttgtgaactgaattgctaaaaaagggtctcttttttttcgggaattattaattggtgtttactgggattaatgaaacctagctagaaaggaaaatgatgggagaacaagggagtgtattttatatatatatatgtaaaaatttgtgtattgttttgtagtggttaaatttgtgaaaaaggtaaaaggttttttctttctttctgggtatacatactaaagggtttttgagagttcagtctgctttgagatttgtgttttggatgatggaggaagctcagggcagttctagttccctgccacctttcctcaccaagatttatgagatggtgga

SEQ ID NO: 4597 - DNA, 781 bp, Glycine max
  misc_feature (772)..(775): n is a, c, g, or t
tttctttcatcagttcttctacacctatgaggctctggatccaccatactcccatgatcaaaacccaggaaactgtattctgtaaccaaaagaaatgaacaaaaattaaaaacaagctcatcattacctcacaattacataaacaaacacaaccttttagcataaaaaagatttgaatttaggcttacctttgaacatttcaaaatcacaaaatgaatccttacactaaattaaatccactagcaagcatttgcccaaatcttggaagttcgaaccaaacaaaacaaaacttatccaacaattaactccaaaagaaacaagtactaattcattccaagatagaatcaaacatgacactgactcatcctataataaaaattaaacaacaccacaacttagttttaaacaaacaaaaaaagtaaaactttattatacataaaaataaacatagaaaagggtatgatcagttgatcaaaggttatttattacaaacctgacatgttgctcgggaattgcacaaggtgataaggaggaggaagattatatgccaaatggttgaagatgaaaacttgatggtgaagctcacgcctctgagcttcagtgatcacatggtttatttcttgtggagcagaatgagaagcatcaaccccgagatgaagttcaacactgtaggaagaagtgttctctttctcttccttgaccacaacaaccctctttctttcatcaacaacaacaacaccaacatcacctaccatcttgtgtcccatgtcannnntcttct

SEQ ID NO: 4598 - DNA, 369 bp, Glycine max
gaggctgcagctatggcttatgatgctgctgcattgaggttcaaaggaaacaaagccaaactcaattttcctgaacgtgttgttatgccaatacaaccacaaacaaataacaataattccacttcttcatcagctcctactacacaatcatcttcttctcttccaccaccacaatctctacataataatagttctctttcagcagaagggtttccaaatcttgaggagtatgcaaggttgctgagttgtagcgatgatgatgattttcaacgtgttgcattggggctctaccagcatcacaataatgaggattttatttgtggttcatcacaaccaccaccagtgccgttttttgtgtcctcttcttct

SEQ ID NO: 4599 - DNA, 851 bp, Glycine max
agaagcgattaacaaataaccagatagagttattggagaggagttttcaggaggagataaagttggaccctgaaaggaagatgaagctttccagggagctaggccttcagcctcgccaaatcgctgtttggttccaaaatagacgaacaaggtggaagaccaagcagcttgagcacttgtacgatgtgcttaaacaccaatatgatgtcgtctccaacgaaaagcaaaagcttcaagaagaggtaccttcctatacttcacgcatgttttacacaaatacatatccttgtatctctccatgtacctctaactctaagctcttgaactatatattatatgggttttgccttacagaattcaaaggtctcttcattttaagttggaatatagtatgtttttggtcatgcctaaaaaactaataattaatatgtttttcatctttatgatttggttaacttttgattatgtcacatatgtgaaagaaatgtgaaattagcatttttataccaaattatttttttcaaatttgacctttgttattaacacattaatattttatattatcttaacatgattgttttttagttaaaagaaatgcagataaagaaaataatgtagaatgtgtttattttattttatgagtaaagaaagaagcataaaaagatataaaatttattagtcttttgcttttgcctgtgttagcatgaatatccaccaagttatatattgcctgaactggttgattaattgaattgtatagttatatatatatgtgtcttctgttatgagcatgcaggttatgaagttgaaggcaatgctaagtaaagagcaaggttttgggaagcaaacat

SEQ ID NO: 4600 - DNA, 393 bp, Glycine max
tgcatgtctctttcttatacttcagcggaggcttagagccttcttcctgcatgaccatgaacatacataatcagactcaagccatgttagaaaaaggaagaacaattacatagataaaataagtctatgtatatatagcccctaatgaggtgtgaaacatatttcttttcttatctttatttgtttgatgtgagattttgtaattctccaagactgcttaagcaatatatatgcaagcaagaggttcaataaggatttgatttcaacctttgttcttcctccatgtaactgtagcctctgatgctgcttcctcctgttgcagcaacatttctgtaattaggcaagggcacgtgaccttcttcaatttgcttcaaatcatcaacgagcatctca

SEQ ID NO: 4601 - DNA, 373 bp, Glycine max
acggttaccggctgttcagaagaaagcgcgcgttctcagccggttggttcccggttgccggaaggtttcgttcccgaaccttctggaagaagccacggactatatctccgccttggagatgcaagtgcgagccatgacggctctggccgaactactcgccggcgccgcgccggcaaatctcgccggctccgcgttgagttgacccgcgcgcctaggctatattgcgccaggtgttttttattttttattttttatttttaattattatatcgtttttattggttttttttttcagattcatgtattttatcgggaacactgtacatgccatttgcttattcctccttcctttgagttccactatcaccacctc

SEQ ID NO: 4602 - DNA, 898 bp, Glycine max
gtagatgaaggcatctgtcatgaatattattctgttaatagctgcttagattctgatgaatctggggaaatagcatgtggtcctaggcagcgtaaagctgttgactacaagaaactctatgatgtgagtacctaagttttcattcaacgtaagcatgtgttctcacagtaaagttgacaacttcagataatatagaattcacaagtcaccagccttaagttgatagttcaaaattcaaggcttctgttaagccactgcctgtcatttaatagtgttggtctttcttataaattgggtcggaaaatattagtttatactactgatttaaaaatgaatttccaattagatgtattatttgccattggttgttgtgtagatggaattttatgtgtttctttttttgcacggaaatactactaaaaaagtagtgctccctattttcttctctggccacatgtagtttcatttgattttccatatttttaggaaatgtatgggaaggatgctccaccttgtgaacaaatgagtgaagatgaagattggggtcctggcaaaagaaagagaagagaaaaggagtcagatgctgtcaatactcttatgactctgcatgaaagtgagaataaacattctgataatgagaaaaatgatagaacgagagaaggttcttcaggcatacaaataagaagatcttgtttcaggattccgcttgatgcagttgaggtattacttgtagagttgtagtaatttctgttgtcatctttctttgttgtcattacccccctcccctcctcttttgaaactccagttgacaacacatatataaatagttatacatgcattaatttgtttcttttaactgtttttttaatgaaatatgccagaaacttcgccaagtttt

SEQ ID NO: 4603 - DNA, 1190 bp, Glycine max
gattcaaaaggctgtaaaagattatggttttgtatgttagcaatgtaaggggaggaagagctgagaaaactaattgggttatgcatcaatatcacctaggaacagaagaagatgaaaaagatggagagtacattatctctaaagtgttttaccagcagcagcaagtcaaattgggtgataaagatgataaagatgttcctgaagccactgaaatcaatgaatcaacaattgtgaaagtggatccagtcactcccaaatttgtgactcctgaaactccttgtaatgaaaggtggtgtgcagatctagaccttggacaagaaacacataacagtccgcaggtaaaaccttcaaccatattttcttgttatcaaatatccattacctgttaatactctgccatgaatgctattttctgttttgctagttattggaaggggacaagtataagataataaagataatgttttaaaatgtaggtggcatatttgtacttggtagaaattctcattttcatccatgaaatctgaattcttttttccacatgaaagtattgttgattctacatagtgtaaaaggaagcaccacttgttctgcattgtaatgactaatatgttgttttacatctcattcaattgaagtttcacgtaggaagctttgaagtttgaacattgaacagtggttttgtaactaaatattcacttatttggtttcttcactcaaacattttaagcatttaatctgaatttgaaatgtcaattaacgaattggatataaacatacaatgactgggagatcgaagctgtattgaatagatacagttttctgtagtattatatctgtgaaatacatatcacttttatgtaggctaatgcgactaaaagatgccatatgttctgatattttgggagtatatgtatattagtggattctctctcagcaagtacatgctgggtggttccactgctgaaataattttacaatttttcacattttcctttattaatcccagaatgtaacttagccatttagctaaacttctaatacttgatgtgtgatgcagttattatattacttctgctaggtgctacatgtgatgatatagtttactgaaatttcaaaacaccacttactaaagttgattattcctgttctgtttgtgttctgctttgtactataccaaagcttcctca

SEQ ID NO: 4604 - DNA, 995 bp, Glycine max
ctttcagcaatcatgccagcaggctgaagaagctctttcccaagggatggatgcattgcagcaatcagtatctgagacattggctaatggttcgcccagctcatcaggctccccgggaaatgtggcaaataacatgggtcaaataactatggccatgggaaagcttggtacacttgaggggtttcttctccaggtacgctcattttccggtctaattctgttttctcaacttccatctttttgaaataaagagaactcaggaagctttgaattaactgagtttaatttatttgcactctcactgtaaaatattttacatcaacacccaatgggaatttattttgtgggcatatcatattaatgaatagaatgacatgccaaatcttattatatgttacattgaccaagtatgtaattgaacttgataacttgttaggtttacatggaatttccctttttttttaagcaatttcttttcaataaaagagagattatttttcagcttcgaaaagaattgtctattttgtaaaagactcagactataaaataaataggataatgattagcctatgactggagtggattgtggaggttgtgttgtcttgttgcacttgcatgcatgctgtgtcaaacaccactaattgacaaactccatgatataaaaaaaaagaataatgtgaatagaaatagagattagaatgatggaacatataaaactgtttattgcatagttgcctgccttaggtggaagatgctttaaatgagagcctaaaagcaactgatgatgtgcatgcacaaaaaactgaatctaaactattccagacatgatggattcactcatcaaaattattaatcttcagctcattctttcgtgttactaggctgacaatctgcggcagcggacattagaagtaatgcttcaaatattaacgaccaggcaatcggctcgtgctcttcttgccatcagtgattatttctcacggctgagagagctg

SEQ ID NO: 4605 - DNA, 969 bp, Glycine max
ctggaagcctaaaagatgctgccaagaatattggtggtaagccttgtgctcaaccatgtttcctctttcagtttttgtgtgcaaacattaggtgctgtttgacttgcagataggacagaactgaactgaaaggttctattctattctcgtttattccaacttttctagtagaaccaagacaagacactttttcaacctcattcatgtcttgtactgttttattcttataatgcaccaaacataaaattaaacttcatatccctattggattagtatttagcttatgggaacttttcaattataaaaccctactttaagacttttctaagtttataggtactataagaagaaggtaaacgagggagcttttctaaagaagttactgtataagttgattttaacttgtgtgaggagtttgattcatctcacttccttaattcatttcatcttcttctcttataagtatttattgagaagcttattcaaattggctctaaatttcatatagttcagttctctgacatattatttttaaattagtaatttttattagctttgcccacatggccaaaacagaaaaagctctgattacattcatgtataatagtgttttacctgttaattttttgtgcatatctattagttgtcttccattataaccaaccatcttttaaattaaacaatttccagtttgtactacaactttgaaaaggatctgccggcaacatgggataaagcgttggccttctcgaaagatcaaaaaggttggtcactctctacaaaaacttcaacttgtcatcaactcagttcaaggtgcctctggtgcatttcaaatcggttccttctattcaaacttcccggatctagcttctccaaatttatcaggaactggcttcttctcaactttgaatcaaagtgattatccaaactcaacaagcacacagccagatcaggctcatgagcccagaa

SEQ ID NO: 4606 - DNA, 387 bp, Glycine max
agctgttatggagagggtggaatctggacgaagcataagggcgaggatgtttgaaaaactgagcaaagagaatcatctggacgggtcgggttccggatcgagtcaaatcggggttcccgatgttgggtgggtttcggagcttgtcagtcgctgatttcattttgttgcacttccctcggtgtgtatagaatgcgggggagaagaaaagtaagatttattttggaagaaggagcatcaactcaacttgtggtttctgtaaatagcttattctcaaggtaaggtatggtatgggtgaagaagttaattaagagaaagagtagaatctttttttggggttattttcttggtcgatcaagaagtgatttgcaagaatcaggatcgtaagct

SEQ ID NO: 4607 - DNA, 693 bp, Glycine max
gtagaaagataggcacagcaaggtttacactgcaaagggtcctcgtgatcgaagggttaggctctcagcacacactgctattgagttctatgatgttcaagatcgtttaggctatgacagaccaagcaaagccgtggactggctcatcaagaaggccaagaatgctattgataagcttgctgagcttcctccatggcaccctactcctaacactactgctgcagatgccgagaacaacaacaacaacaacaatgcagggtcaagtgacatggccattgcagcagaacaatctgagtcttctggttacaattttcagctgcaaaggcaattaggtgaggaccatgataaccaccaccattcagctttcattccttcacctattgacactgatgcaatagccttctttccaacaaccactgcaacctcctccatcaatttccaaacctaccctcctgacataatctcaagaaccaacaactccactgaggatcttggcctttcccttcactccttccaagaccctggtttgattcatggccagacccaagcaggtgcaaaccagacacaaacaccttccaatgaccaaagcctcttctctggctcaactcaagtggggtttgaggccaattaccccaggattgtcacttggaacagtgatgcaagcatagatatgaacagaaccgggttcatggt

SEQ ID NO: 4608 - DNA, 880 bp, Glycine max
  misc_feature (873)..(877): n is a, c, g, or t
ggcattggaaacactcagcaacacatgtttatcaatgagttcatcccaacactggaaggagaccaaggaatttgctacacacatccggaaaatcttccaggtgagatttctctgacctttttgctttcaattcaaatatgtaaacttttaccactctttttattatacttgattgatcaatgaacctgtaaaatgaagtcattaatcaaaccacacaaacatctggaaggaagactgatcaatgtaagtgactagagatgtcccttgtggaactggttatggaaaagtgccatgaatgacacatcaatgtaatttgactgccttttgcaccttagaattcaatgcatgtttttaaattgatgtttgaaaaaataaaacaggacacaatataatctaaaaacacattgaaagtttaagttcattgaatctcaatttccctgttagatagacctgaacctaatcaagattctaatcatgctgatagttatgtttaatgcttcactgatgggggttgagggaaggaagaatattttattgccagaaaaacttagtggcttctaattatgattatcttataattaactctacatgtttaggctattggcccttttctggaactgtgtaaccaaattacgtctattttgtttttcaggtgctaagaaagatgggagttatgtccatttctttcacagaacaaccaatgcatatgctactggtcaacgaaagcgtcgaaagattcatcatcaacagggtttgactgaagagcatgtgcgctggcataagactggcaagacgaaagctataatagaagatggagcacataagggctttaagaagatcatggttctctatgtaagatccagtgagaatggnnnnnagg

SEQ ID NO: 4609 - DNA, 669 bp, Glycine max
  misc_feature (434)..(434): n is a, c, g, or t
  misc_feature (438)..(438): n is a, c, g, or t
  misc_feature (449)..(449): n is a, c, g, or t
  misc_feature (495)..(495): n is a, c, g, or t
  misc_feature (511)..(512): n is a, c, g, or t
  misc_feature (549)..(549): n is a, c, g, or t
  misc_feature (622)..(622): n is a, c, g, or t
  misc_feature (627)..(629): n is a, c, g, or t
  misc_feature (638)..(639): n is a, c, g, or t
atgaatgacatgcctgtatcattcactgcaggataagttacattgaagcaaccaggtttgttcacttcataatcattaaggaagatatcattgatggtatcactagtttcttccataaattcatcctgatcagaagcctttttcgcctgaataacctgtgcagaaatgtaatgtgcagacgatacaaaattagaaagttagcgcaataaaaaacacttataagttagttctattaaaaaggcttaatagaatgtacggaaaaatgagcataactatattttgaaattaatacagaaatcgttctaaaaatgaactttctggcggggcatacataattgttgttttcactatcttggtaaaccaaaatggaatctccaaagcgaaggccatgtgtgttgacaaaatctcctgaaaacattcagcataagaatatntcanaaccaaaatanaacctttcccaatagttagaccattccttttagcaaatgaaggagntagttaccagtatttnnaagtacatacatccgactgttgttgttaggccaaacnctgcattattcaaatacaaacacaataacctataaatttgaattgttagtatcaattaactaaaaataaactncaaannnatattctcnntctagtatcaattttcgtcgtggtaaaata

SEQ ID NO: 4610 - DNA, 376 bp, Glycine max
ttctccacagggttctcagtcatgctattcagatcaccagcagtcctctgacaacacctacggttcgccaataagcggcttgtccagtgttgatgacgggcatgaactgaagcacaagcttagagaactggagatttcattgttggggcctgaacaatcagacagttgcggctgctgcgtcgtcaagggtggcctccagggatcatctcagttggctaaacataactgggatcagattgcagagaacgttgcacaatttgacttgaaaggagtcctcagggtatgtgcacaggctgtgtctgatgatgatgttccaacagcaagaggctggatggataatgtattggggaaaatggtatcagtctctggtgatcca

SEQ ID NO: 4611 - DNA, 226 bp, Glycine max
ttttttggttattatagtttgattccttcacttcaccaagttatataaacatgctgtatgtgttttggagtttcagctagagacttggacaattttggttgctattgtgtgcatcttggtctttgttctgaaggagattgttatgggagggaagagctcaaaagggagtggtaggaggtatgattttggtgcttcttcatcttcaagggataatagctatggtgga

SEQ ID NO: 4612 - DNA, 383 bp, Glycine max
cagcttggttggaaggatttgtctctgttgatcgcctccgcttggcaaccgtcagatttgatgattacttatcctgattgaaacttttatgaatcattgcaactatcaactatgcttttggaatttatttattattaattgtttaattgattcagactcaaattgttagggttttctcccattagatgggagaggttatgcaatatggtatgagatgatggggggttgtgtatagtaataaattaataataccgataatgatgtggttgtggataccaaacaccagtcctcataggttcaataaataatgatagtagtagtagaattaagaagggaatgacgttagatccacgtccactggttccactacgctacacacaaag

SEQ ID NO: 4613 - DNA, 412 bp, Glycine max
caggtccaaattcaaacgcacgcgttcctcttccttgttccgttgttgttgatgactctggcggaaaggctttgcgtcctccaccaggagaatgtcctccggatccacgcggtagcggcagagaggacacgtggaatgcgcgtccagccacgtgtccacgcactccacgtggaacgcgtgcttgcatttcggcaacagccggagaacctccgcggcctcgaacttgttcaggcacaccgcgcaatcgagtccttccttttgcccccgcagcgctccgaatctgaagaccggcaacgattccaccacggaccggtcaatgccggagtttttccttccggagaagggcgccaccgtccacggagccgagtttccgcctccgccgtctgggatgccgccgttgcagtgtttgatg

SEQ ID NO: 4614 - DNA, 395 bp, Glycine max
acccactcgccaacgatccaagcgcaaccggaaatccaccatgccgaagctcacaccgccaccccaccccgaacccgagcctctcagctccgtctccgacacctcccccgaagaagacgtcgccatgtgcctcatgatgctctcccgcgacacgtggcagcaacacaaacacgccaatgcagctacacctaagaggcgctgcagtagcggatcagagatcaagaaaaatgtccgcgggaaccacctctgccacaaatgtcacaaatcctttcgatcttctcgcgcgttcggaagccacagaaatgtgtgctgtccccgcgaggaaggccaaaataattacaacaacaaccgtagcactaaggttttcgaatgtccgttctgttacaaggtgttta

SEQ ID NO: 4615 - DNA, 317 bp, Glycine max
  misc_feature (261)..(262): n is a, c, g, or t
  misc_feature (264)..(265): n is a, c, g, or t
  misc_feature (308)..(308): n is a, c, g, or t
  misc_feature (310)..(310): n is a, c, g, or t
agttttctgaccaaagtggttttgtttgtgctgaggtttctgtaggataaaaagtttgggtttttatttctctaatgtacagtggtgataatgatggaaatgacatgcatgatgattattatttgatggcttttatcttttgctttgctctcaagtgccatcctatgttggtgtgtggagcatctattctgtattactttgattcccttgaaatctgatctggcttatctttttttttttcttcttttgggaccaattttnncnncactatttccaccctccacttcaaatttacttgctttgtgttngngagtgcc

SEQ ID NO: 4616 - DNA, 344 bp, Glycine max
catggaatttcaagatggccatcccgaaagataaataaagtgaatcgttcgttaaagaagatacagactgtgcttgattctgtccagggagtggaaggagggctaaagtttgatccttataccggggggtttatagccggaggatcaatcatgcaggaaacggaagcacataaatatcttgtgtttcctgagaaaagttctgtgaaagatcctaagcctgcaacacaaaaaaaagtctcagtagctccagcacctgccagcactattgagaattcaacaattaagttgaatgatgatgaaggtgtttgtctggtgggaaacaagcttgtgcactcaagaagtat

SEQ ID NO: 4617 - DNA, 407 bp, Glycine max
attactattattattattcccttccacttgcaacccttgtagcggtgccaagccatggaaagtgttgccaccttgatcatgatcactactacccttcaccccaccaccaccaccaccactcattaacttttgctgcagaagagttgaactcagcaaggaagccataacaggagttgaaggtgcacaagttgaggaagaagaagaaccaaacatagagttataagcagaaaaaaagctgttgttatttgaagtactaaacccattctcactaaccccagttgaaaaacctaacccaagagcattcaattgagaatgaagattaaaccttgggaaaggaacactactcatcacatcaccaccataaaagaaagggctgatattatttatatggttcgtggtggagctaa

SEQ ID NO: 4618 - DNA, 561 bp, Glycine max
gatgtggagacagataaaggtgcaatttctcaatcacgtgttgctcggccacctgcagatggcaggggcaagaatcagttacttccccgatattggccgaggattactgatcaagagctggagcgattggctggagagtatcctttatatttttttttgggttgtcttgaacatatataattgactctgattgtataaagttggtttatcagtagtttcccttaatgtgtgataacagtttgaaatccactgtagtgccattatttgagaaggtgttgagtgccagtgacgcaggtcgaattggccgtcttgttctcccaaaagcctgtgctgaggtattttttggagtttgattttctttgaatttgtaataaaatctcttcaccatgtaattgctgaacatcatacaaactggcatgtgaattgcaggcatattttcctcctatttcacaatctgaaggtgttcctttgcgaatgcaagatgtgaaggggaatgagtggacatttcagttcagattttggcctaataacaacagcaggatgtatgtattggagggtgtg

SEQ ID NO: 4619 - DNA, 980 bp, Glycine max
tcttcctccgagagttgccatttcggctttgagggttttgaggtgaagcgagttgaggatttctatgaggtccgggatgaggtcagagcggtcctcgcagcacagcgaggccttgaagatgagcctcccgtcgtcaccaccggaggcgtaatcccctccggtggtggcgagcaccgtgatctcgtcagtctccgacgggacggtttcgagctcggtgatctcggatgtttgttgcttcaactccttcacccgctgaacaaccttcgccaaaagcgaagccttgtctgtctgaaccaaaatcaaacaacaacaacaaccatggaaaaatttaatacacatatcatatagtactgtataatatgatattaatagtataacttatcattgtaaaagcaaactcactttcccaaactcaattatgtgtcaatgtctttacgaatcaagctggggtttctttttggaaacatgaaatgaatacgaatctcttttgaaactttggattttatgagttcttcctagaaattaatctagctcatcctgctgtatgtacatattccatgaaattaaagtctagtcaactagaagacatagatttaactttgttggtcaaaaagtatgcaacctttgagatcaaaagaaggaacaaaccactctctatctttcaaaaacaactggctagctagaaagaaaaggtgacaattacactcatcaaaaccaaaggaagaattaacaatgaaataaataaataatgcacatatacatatgtgtgagtgtacaactctatgtgtgtctttttattttttaatttcctaactggaaattaattgatttccagttatatatgtttaagggagaaattaaagttatatatgtagcaactaggtcacacccacagcatattagttagttagttgtgtgtatcgttagagtataagtataaggtgaaatctcagcacgtatatataccttggaattgcatg

SEQ ID NO: 4620 - DNA, 381 bp, Glycine max
gtggcaatcacaacaagaaggtgcaaatcaaacacctcctttttatgaacaccaaatccagcaaaccccttttgccggatcaaccccagttgggtttgagaaccattatcaaagaagtgtgacttggaacaatgaagcaacaaccacagatcatgtcaacaggttggggttcttattcaactcacagccttatgcttcagcttatgctcaaagtggggggacccttcagtccagtttttcatttccaatgacttcttcctctgagcttcacaggcctcagccagtgaaccaaccttcttcaatctttggcagcaggtttgtgtctgatggattagctggtttctgcattccagatagaattcaaggtgtggaaggtgtgga

SEQ ID NO: 4621 - DNA, 376 bp, Glycine max
gtggaggtggtggccatatgctgaggcatttcttcgatgattggccacgatcactccaagactctgacaacgttgaaaacaatgctgctgctggccgtagcctctctatttcaatgcccggtgcttcctcggatgtgtcattgaaattgtccacgggctatggagaggactcgggcccaggaaatgagaatgtaagcctcgagccagagcagctgcagttgaattgggccggaggatgggcctcgtctaatcaagtggcttcgatgggaggtccacttgctgaggcactcagatcatctacttcaacctcatctcccactagtgttttgcatcgtcacttgcctcgtggatctgagaccagctttattagcacctg

SEQ ID NO: 4622 - DNA, 554 bp, Glycine max
ctttaatgtattcaacagccaagtccaacatgtctgctgtgttggtttgctgccaattaagagcatcaagaatgttaactttccaaccacaactacaccatatgtaacataatttacatattccagaaatcaaatgtgcttatgtgtctcttaccttatccatgtgtgggacaagctcttgtaatttcctcattctttcactgatccgagttcttctcacctgaaaaaagacttacatctcagaatcatctcttacaaattacttcatgaattcaacatagtctaaataatatcttcttatttattgttttggtataggaagggtctcataattactataatccatttataaaagacaataaaactacttcctccaaatgagtttcattttgatactgttagtataagatttttacattgtaaatcaattagaaatcatcttcagtatgacttttaacttttaaagtcactaatacaaaaatcaataattttaacatacataaaaatttatgattagacaacagtatataaaacttttaacattgtcagaacat

SEQ ID NO: 4623 - DNA, 384 bp, Glycine max
cttcaagatccacttcttcaccaatcaatgaactcagccaactccccagatgccatgagttacaacacaacagactcatacttcaaaggtcgcgacttcgatgcaaatgttgtcatgatactctcggtcctgttatgtgctgttatttgctcactcgggttgaactccatcataaagtgtgtcctaagatgttcaaacatagtcatcaataacaatgacccttcttcttcaagtgtgagctacaacaacccttcaccgagattggccaacacaggaatcaagaagaaagccctcaagacttttcctactgtgagctactcaacagagatgaaacttcccggtttggacacagagtgtgtgatttgcctctcggagtttgccaat

SEQ ID NO: 4624 - DNA, 371 bp, Glycine max
aaacctttaaactgaccacaaccattacgaatattctaattaccaagcaaccactctcccaaataataataaataaataaaattatatactcatgttatcacaaattttaagtttattgattttttttataattactttaaaaataatattaacgataattataattaaacgataatataaaaatattttactctatcaatatattaccattaaactctaataaaaaaataatttcacattccaaatcaaaggaagacaccaaaatctaaccatgtgaacaccttgcctatatataatccccttagacaaccaaccacaagaagctctaataactcattattcattaacacacacctcaaactaaaaaaaa

SEQ ID NO: 4625 - DNA, 371 bp, Glycine max
tgatgatggctacaattggaggaagtatgggcaaaaacatgtgaaaggtagagacttctcaagaagttattacaaatgcacacatccaaattgtcctgtcaagaaaaaacttgagcgttctcttgaaggtcatgtgactgcaattatctataaaggagagcacaatcatcaacgtcctcatcccaataagatcacgaaagaaacacagacttcgaatataaattcagtgtctaagatggatctagaatctagtcaggcaacaggtgaacatgggtcaggaacaagtgatagtgaggaagtaggtgatcatgaaagtgaagaagatgagaaaaatgatgaacctgatgccaagagaagaaacacagaaaata

SEQ ID NO: 4626 - DNA, 311 bp, Glycine max
gagaggagaagggttttggtgttggagttagggatttcggggagggcccttcgaataccaaaacggtgccgttgcagcaggtgagtagcagcgaggggagctccaagacggtgaggtttcacgacggcagcgataacggctccgtcgagaaagagatcaacagcagccccgacactgttgcttccgaagagcgcggtgcgaagaaaggggttagtttcgagattgacgaagcgaccgttacgacggtggacggtgactcttccgttttgagcagcgccaccactttgtccgcacatggcaccagggatcta

SEQ ID NO: 4627 - DNA, 329 bp, Glycine max
ccccggccggcctcggctgtttgccggactcgtcggagtcgacggacatcggaaccacgccggcggagaccggagatggcagagggagcggcgacgggaggccggagatgtcgaagtcggaggggtcgaagaggagaaggtcgtcgaagttcgcggcgaagcggaaggaggtgtcggagtgggaacgccggtggtgggacccacgctccggcatccgatccaggtccaccgtcgccggcggctttccgatgaacttctggttcatcgaaaaaacaaaaaactttatttccttttctttctttttttataaaaaaaaaggtttatttgtt

SEQ ID NO: 4628 - DNA, 744 bp, Glycine max
aacatgggtacggcaattggagagtactcccaaagaatgctggtatgtcataaatttatcttcatcttttgtaccaaaaatgaacattattaaacacacaaataaagtaagtttttgttttttctatttgtacttgaactaatatgaatgtatgtgttttgcttattttgcattgagtaggtttgcaaaggtgtggaaagagttgccgtctccgttggacaaactatctccgaccagatataaagcgaggtcaattcacttttgaagaggaagagactataatacagctacatagcattcttggcaacaagtaagccacttgtttaataagtattttttttctcgtaagaatccaaaacagatataaagagatttacaataatttatgtattttactcgatcaattaaactagatttctttagttagttcttatttaataagtttttgcttttggacatgagtccaatattattattgattaaagtactaataataataacgaaagagggttttgtaattaacttggtattatgggattactgtgtaggtggtcagctattgcttctcgcttacccggaagaacagacaatgaaatcaagaattactggaacacccacattagaaaaaggcttctaaggatgggaattgaccctgtgacacataggccaaggcttgatcttttggacctatcttccatcttaagttcaaccctctacggttcaacacaaatgaacatccaaaga

SEQ ID NO: 4629 - DNA, 231 bp, Glycine max
  misc_feature (119)..(120): n is a, c, g, or t
  misc_feature (123)..(124): n is a, c, g, or t
  misc_feature (147)..(147): n is a, c, g, or t
  misc_feature (174)..(174): n is a, c, g, or t
  misc_feature (205)..(205): n is a, c, g, or t
  misc_feature (207)..(208): n is a, c, g, or t
  misc_feature (215)..(217): n is a, c, g, or t
  misc_feature (221)..(223): n is a, c, g, or t
  misc_feature (227)..(228): n is a, c, g, or t
gcacttgtggctcagacttcaagcacaagagatccctaaaggatcatattaggtcttttggaaagggacataaccctcatcctccctttgaagcttttgaggatgagaaggaatgcatnnctnnctctgatgaagatgaagttaatnctcatcatacatgatctaacgacattntatagcttattttctttattatgaagatatngnnagtagcnnnggtnnnaaanngcg

SEQ ID NO: 4630 - DNA, 551 bp, Glycine max
ttgggaggatagcaagaaagcatcagtagaggcacaactcaagaaaatcgaggtgatcattttctgcatgaacactgtgattgttagctaaccgtgacaattggcaagagaattagatcttctttgtaactagatttgtgttcaattaatgcatctatatgactggtcttataaattatcacttatttgacctgtatgttgctttaaaaaaattgcttttatcaggaaaacttggaaaaaaagaaggccgaatatgttgagaaaatgaagaataaagttgctaaaatccacctgttagcagaagagaaaagagcagttgttgaggctcagaagagggaagaatttatcgacttagaggagacagcttcaaagtttcgtagccgtggagatacgccaaggagattctttgcatgctttagtggctaggcttttactatccaaattctcactggattggttatatgttttcacatatacaattaaattttgcttggtgtgttgttttttcctatatactatttaaatcaaatctcagcagttgatttgaagtg

SEQ ID NO: 4631 - DNA, 1027 bp, Glycine max
ctcttctctcttctacactttgctctaccctctttcccttccctcaagtactatcatacacatcacacacacaagcaaaaactcttgctttccttttcaagttcttaaactcatcacttacctcaggagtttgcatattttctttgtatggatggatccttccagtggacaacaccaggtaaatatcattgcatacatgatatatatcataacatgcatgcgtgcttttttttgtgttttatatcaacgtgtcttaattttgtcttttcttttgtctttcatggcttttttaatacttggttttggttttaattcttccttaagatgaatttggatgagtgaagaaggaaattaatggtcttaattcacacagaattattgattttatattatttaacatttttatataggaaacttctgtccatccctcgttattctaaaccatatactatactattcatggcgttttctatgaaactcatacttatatatagccggggtatgtaattgatttgtctctcgaagtagaaagtaaaggcaaatccctttgagttaattggaaattcaattatacgtatatatatacctgatgtatgtactgtaattttttaattcttaaaattaacctttcatttctatatgtatataacttgtaagcatacactcaaatgggatgttaaaaggaatctaattcagttggttaaatataattaataagttattgtaaattttcttgacattgtttttaatttccacaaataaaaaaatatatattcgaattgggttgaggattaattggttaattcctatgtttcatttcacatgtgatcaattagttaatttggatgtattgtttgttgcagcaaatgtctagccagtcattggagaacatgttggcatgttcaaaagcacagcaagagaggaagccaaggcctcagccagaacaggctctgaagtgtcccagatgtgactccaacaacaccaaattctgctactacaataattacagcctctcccaaccaaggta

SEQ ID NO: 4632 - DNA, 1023 bp, Glycine max
tgctagacgcctgcgacaactgcgcttaccatcatcgaactcagctagcaaatgaaacctaatttaaaaacaaaacaaatggtgtaattcaatccataagtaacaatcaggttcaattcacaaacattaaaatcaaaatcaagaagatatttcacctgaactacaacagtcaatctgtgcttatataaattgattgattggaatttgatcaataatgtattgtcatttgtcacatccatttaaactacatttgttgtaggcaaagaaaactcttaaattattgtattaataggatccactagaagaaccatatgacagtaaaaataagagaagcactgcgagtctttgatttaagaaaaaggttctgtttttattttctttttttactaataattataaaaaaaaaataccttgtttgttttcatcttgtttcttgctctttaccttgtttatgttttcaataacaacatttcatttcatagacaattttttaaaacaaacaaagtaacacttttgtaagtaacagcaaaaagaaataacaccagagatgaaaaagatatttctttaaaccaaacaaaccctgatatttttaattgatttttttttatagcaaataatttgctcaacttttatttgtttctaaccaacaggattggagtacctcaccaactaaacaaaatataaggagcttacataaatgttgtgagttgaccacctgattgtatgaaaattgagaagtaatatatctatcaaataaaccaaaaatacctgctgcactgctgacaaaacctctgttcaattccatttacaataactttagctgttttggagtgagcatcacaaactttatgccttttgtggtaatcttttgaggagctaagatccatgttacaaccataaacttgacatacaggagcctgtgcaggcaagctggaagtgcgagctctcttccaaagtgtggtcggatgtatagatgttaaagtgaacccttcttttgcaactttatcactacttgcaccttac

SEQ ID NO: 4633 - DNA, 391 bp, Glycine max
atgataaaggcaagagggtggcatctgtttccaattcaagctcctctgcggtggtcgttgaagatggatcggaagaagaagacagtgaaagaggtggaagcagaacattggataacaagaaaaccaacaaaatattcggcttctctgtagctcatgatgacagtgaccacccacccgtcactcatcagttttttccggttgaggactccgaacttccagtcaccgctgccgccgccgcggccggaagctccttcccacgtgctcactgggtaggcgtcaaattttgtcaatcggaaacacccggcgccggaaaagcagtgaaagtgtcggagccgatgaagaaaagccgccgaggaccacgctcgcgcagctcacagtatcgaggagttaa

SEQ ID NO: 4634 - DNA, 370 bp, Glycine max
ggaaggtgcccatttagtagctaaggcattggggaggattgaaacagatgccaataaggaagggggaagcactggaaatttctatgattgcaatatatgtttagacagggcaagagatcctgtgttgacctgctgtggtcatttgttttgttggccatgcttctatcaggtgcaaattgtctattcaaatgcaagggaatgccctgtttgtaaaggagaggtcactgaaactggcatttttccgatttatggcaattcaagtgccgatggcagttgtgagtcaggattgaaaggagctggtttgagaattcctcctcgacccgctgcacccagaattgagagttttaggcagcagctaataagtcaggga

SEQ ID NO: 4635 - DNA, 988 bp, Glycine max
  misc_feature (977)..(977): n is a, c, g, or t
  misc_feature (979)..(979): n is a, c, g, or t
ctatgtgaatctgcacaaaggatttcaaagagaccaaaaccttcagttgcaccggcgaggccacaacttgccatggaagctcaagcagagaaccagcacagaaattcgaaagagggtttacgtgtgtccagaaccttcgtgcgtccaccacaacccagcaagagcactcggtgatctcactggtatcaaaaagcacttctgcagaaagcacggcgagaagaagtggaaatgtgataagtgctcaaagaaatacgctgttcagtctgactggaaagcccactcaaaaatatgtggtacaagggaatacaaatgtgactgtggtaccatcttttccaggttgatgcatacacacatgtatcaaatttctacgtcatatatatatatatatatatatatgaaatttgactcatcaatattcatccatggtttcagtgcataagttgcatgcagcacttgtccttttataaataaaatgttacatgggatctttccttgaccacacacacccttgttgacttaaaaaaatggaattacttactttccatctttgaatttattttcgtatacctttaagttagtttatctgttttgaaaatttttctctagttttgataaacctttctttatcatatacgaaaataagcaagggtatacgcagcccttgattaataatcaacacaattaagcaagtggcatctatataaaatatttttgcatatatacaacggaagtcattttggtctacaagcataagtcactataaatacatagatatatattaaatttatttgactcagtcaaagatttcaccactttttatttgataataataataaacatgcatgatcctcatgaacaactatatatatttatatatatctacttggcattatttatatgcagctcgcgaaactcatatctctttttttacttaatgcatgcatcattattacttactgagtgcttcacattcatcnanctttgcaga

SEQ ID NO: 4636 - DNA, 355 bp, Glycine max
cttgggaatcagcacaagcactcactccacagtacaaaaaaccgaagcaaacgttgcaacggaaaacgaccacggttacaaacgtaggtacttgttcctttttcacggaggtgacaagaaaacagtgtgatacacacctttagaatttttttttcttaaaaaaaaaccgggtctgttctttttttctttttttctaagcagccataagggaaaatgggtagcagtttcggcggcgactatggtcgtgctactgttgcttttctctttctatgcttgagcgaatgaagacagaaccgccattgtttttgggtgttttttaaggaggaaaaaaaaactgtgtccctgtgtcaaaaaa

SEQ ID NO: 4637 - DNA, 414 bp, Glycine max
  misc_feature (40)..(40): n is a, c, g, or t
gaagtacagaggcgtgaggcagaggccctggggaaagtgngccgcggagattcgtgaccctcgtcgtgctgcccgggtctggctcggcacgttcggaaccgccgaggatgccgcccgggcctacgacaaggccgcgattgagttccgcggcccacgggccaagctcaatttccccttggtggacgagtcgctcactttgcagcagagcgagccagagagggttcaaacagaagaagagcaaataaagacagagaatctcaatcaaggtatggaaatggattcattcgggaacaaggataccgaattctgggacaggattaacgaagctgattttcatcagctcatgatgatgatggattttgctggagattcttccgactctgccactgggaacgctcttagttcttgaaataa

SEQ ID NO: 4638 - DNA, 562 bp, Glycine max
acataaattctgccaatagctgaggataacataaacattgcttccatcaattcagtttaagatacttcagaagcctgggataaccaaataataattaaaataaaatcaaacatgcgtgtataagaaaatatcaaactaacaagaacaccaaattgtgacaaaaatgcagactacaagagaagacgtttggtatgactgagtcaatttgttgtcaccaaatgatcacgtgatttatccaagtgagagggacttatctgtctgattgtgatagaagttttaggtccttgtttttgttctggtcattaggctagaataagttaatttttgtttatggtaagtgattcattaggtcccagttaagatcatatgttttgtcatgctcctgatcatttggattgctattgcaatgtgacataataatctccagctaaagaaaagtaaaataattgctacataatcttgagttataactttcgactgttgaaatatttgaacttcaatcatatttcaacataatccacttatgcagtgcaacaatatttttgttacttgacttcaatca

SEQ ID NO: 4639 - DNA, 375 bp, Glycine max
ccaaatgggtgagcttagccaacggctccaatcgctcaacgacatcgtccacgacatcatcatcaacacaaccaccacctacgaaagggactgttatctaacaagcgcacaaaatttcaccaccaccacctacacgctctgtcttaaccaacccgtttttcagtggtgaattgtcaccctcgtcctctgtggatcttgaccataaaagaaaggaaaagtgtgcgtctgggtgaatcttctcttggaggaatcaatgtcaatcagtgaaaaaaaattaagttcatattagtacagtacttagggtggggctatgttaattgttaaacagaatttgcgcaaagtgcttattgaaaatgacatagtggcctgcaacta

SEQ ID NO: 4640 - DNA, 99 bp, Glycine max
  misc_feature (36)..(36): n is a, c, g, or t
actagaagccgagggctatgcttggtgcctgtttcnagtacatttcccgtgactcatgaaaccacagttgatttttggacaccaacattcggaggaact

SEQ ID NO: 4641 - DNA, 376 bp, Glycine max
gattggagcctctgaccctgacattggatgggtttcggaactcgtcaaatgaccgcatgtttgtttctcccttgttagattattatgttcgagacaaagtcattttatcttttctaactctaaaccaaatatgcactgaatggattccgttgcttttcatttgggtctgtatgtatagttaagttgtataatgcaatttgaataaaataaaataaaactctatgtacatagttgagaccgtttgggtctctgtttttgtaatttcttgtctgacattttttttacccttgttcctggctgccgaagattgggtagcacattgttagattttctgttacgatgtatgtgtacgagggacatcacaagatgacagaag

SEQ ID NO: 4642 - DNA, 605 bp, Glycine max
attggtggattctgtgcctttggaggggatgagattttctcttttaggttgctttcaataggaatgagatttaactttagccagctgttaagagctttgatgtaatgtttctgttgagttacaagcttctcaaattgtaaatgccattcctggatgactttctcaagttgcacagtgcgatcgtaatgatgcttggttgtttccttaggagcttgagaaatatcaagagatttgaggtctgttactattttcagctggctgtcatgatgtatgcacatattttcccacatatttgccatcctgaagagaaataaagtagattcatgattaggatccaatcatgatgcaaatagttattttacactactgttcaattccttacactacccttttattagaataaaaatccaaaacacagtggatgtagtagcaaagataaaacaatcacagaaaattttggatccagtagtagtcagtatcagaacaaattgaaaactaggaaagtatacatgtcatatcattcttattcttataataataaattgatatttttaataatattgaaatgtacatcagtgtataccctcagaaatagaaaaaaaaaa

SEQ ID NO: 4643 - DNA, 489 bp, Glycine max
attttaaataacatctttttcgctctattttgtgaaagtttgaatttttgagttctgggtatttttttttcagtggggtattatgggaagaagatagaccctgaaccgggtcggtgcaggagaaccgatgggaaaaagtggaggtgttcgagggatgcacaccctgactccaagtactgcgaccgccatatgatacgacgtcgttaccgttcaagaaagcctgtggaatcatctcaaactcactcttcttcttctgcttctgctgcttcttcaaattcaaaccctgttgctgctgctggtggtggtggttctgttgctaatgtttctgcaactgctgcaaaaaaccttcacacacttcccttgcacatcaatggcgcaagggaaggtttcactttcacccttgggaacaacaccagcaccaacaccaacaccaacaccaacaccctccctcaccttcacatgaaccccctcactctttcagctgacaat

SEQ ID NO: 4644 - DNA, 364 bp, Glycine max
ccagcacttgtggtctcaatttgatcaccgcccaaaaatctggtttgagcggtgatcaaaataatgagaccacaagtgaaataatgcggcgccctagaggacgcccatccggttccaaaaacaggcccaagccgcctctcataataacgtgcgagcccgagcccgtcatgagcccgttcattctagaaatcccgggcggaagcggcgtcgttgaggccctagcccgcttcagccgcagaaagaacaccggcctttgcgttttaaccggttccggaaccgtggccaacgtcactctccgtcaaccttctttcactcctgccggcgcctctgtcgccaccgtcactttccatggccgcttcaatat

SEQ ID NO: 4645 - DNA, 371 bp, Glycine max
gaggtaggacactgtttttcgtcatcgtactcttctccattattcttcttgtcaccgttctcttcatctacacgcgctgggtttgccgctaccagggacgactccccaccaccgcgttctccgccgcagccgtccacgcgccgccgctagcgccgcctcagggactggaccccgcctccatcaagaaacttcccataatcctccaccacgcgcctgcggaccgcgacgaaagcgcgtgggacgaaacggagtgctgcatctgtctcggcgagttcagagacggtgagaaagttaaggttttgccggcgtgtgaccattattttcactgtgattgtgttgataagtggctcactcatcactctagttgccct

SEQ ID NO: 4646 - DNA, 819 bp, Glycine max
  misc_feature (750)..(750): n is a, c, g, or t
  misc_feature (765)..(767): n is a, c, g, or t
gtctctgttacttctcttggctgcacctcttcacaaactagatggaatgttattttataatccttctccatcttttctcttgagccttccttcccacaccaatcttctccaccacttcacacaaccttaaatccaacccaaaaccaaaagaaacacacacactcagaaacaccaagagaaggtacttgtttttttttcttttcttttcttttctctgttctgttctgtcacaacttagtacttcacatcctttgctttgttatcttcttcacatgttgcttttgttgcttgtcttgtcctttgagctgagtgatgattgattccctttcagtagcagaaagatgggttgccgttagtttctatgactttcgatgttatgtatgtgtgagtgtgatagaaagttagaaactacaacaactcatgtttttcttttaaacctttttatttggtatgttttttttcttcttcctagctagttaatttgatctcttcctgattctgaggcaacccaattcacagttgcaagttaaattattaatcatctagatttggggtgtgcttgtttagtcttagatctctggaattgatatgctgaaggcttggacaaagaattttctttttttcaggattccgagaagttggtgtgatctgatgctagtgtttcgaagataatctgagaagaacaaaaagagaaaaaagtttgattgttttctttttccaatggagtcagatcttcggcagcaccctcancatgtttttggatcnnnaccaccagcagcagcagatgaattctgggttgacacggtaccgatcggcgcc

SEQ ID NO: 4647 - DNA, 404 bp, Glycine max
gtaagttccggcgaggatcttctgcgagtcggaccaggctagcttatgctgggactgcgacgctaaggttcacagcgccaacttcttggtcgcgaggcacgtgcgaaccctactctgccgcacgtgtcgttctcccacgccctggaaggcctccggcgcctcactcgcccacgccgcctccgtctgcgaccgctgcgccgccgcggaagagacggaagagagcgaagccggcaatgacgacgaaccagacaccgaggacgacgacgatgtcgacaaccaggtcgtgccgtggtcctccacgccgccgccgccgccgccgtcgagctcctccggcagcgaatgctcggagtgcaaaaacaacgttgcttctttttccgcctcggaacaggaaacgacaacatcct

SEQ ID NO: 4648 - DNA, 359 bp, Glycine max
agctgtagttccaaatgtatccaagatggacaaggcatcgctgttgggggacgccatattgtacattaacgagttgaaatcgaagctcaacgtgctggattcagagaaaacggaattggagaagcaattggattcaaccaagaaggaactcgagctcgcaactaaaaaccctcctccaccgccaccgccgccaccaccaccaggaccgcctccatctaatagcgtagaaccaaagaagacaacaagcaagctcgctgatttggagttagaggtgaagatcattggttgggatgcaatggtaagaatccaatgcagcaagaagaaccaccctgcagccaggttgatggcagcattgaaag

SEQ ID NO: 4649 - DNA, 474 bp, Glycine max
  misc_feature (61)..(63): n is a, c, g, or t
  misc_feature (342)..(354): n is a, c, g, or t
  misc_feature (356)..(357): n is a, c, g, or t
  misc_feature (360)..(365): n is a, c, g, or t
  misc_feature (367)..(371): n is a, c, g, or t
  misc_feature (373)..(373): n is a, c, g, or t
  misc_feature (381)..(388): n is a, c, g, or t
  misc_feature (390)..(390): n is a, c, g, or t
  misc_feature (407)..(410): n is a, c, g, or t
  misc_feature (421)..(425): n is a, c, g, or t
  misc_feature (429)..(429): n is a, c, g, or t
  misc_feature (431)..(436): n is a, c, g, or t
  misc_feature (447)..(447): n is a, c, g, or t
  misc_feature (449)..(458): n is a, c, g, or t
cacttcctctttcattgttctctccccccactttcactatacccccccttgctttactttnnnattttgcacccttttaacttctattatcactcacaattcttgttcttggtcttcttccttttctcatccttatacacttctttcttagattgttcttgtttggattatttcatggagggtcaaccagctaaaaggagacgtgtatactcacttgaaccaactaaagtggaacaagcaggggttgcaaaaaactagatgaaataatccaaacaagagcaatctaagaaagaagtgtgtgaggatgagaaaaggaagaagaccaagaacaggagttgtgtnnnnnnnnnnnnntnntannnnnntnnnnnanatgcagtnnnnnnnntngggggggtatggtgaannnngggggagaaannnnngaangnnnnnntgattgttttngnnnnnnnnnntaaggagaaggaagaa

SEQ ID NO: 4650 - DNA, 1305 bp, Glycine max
  misc_feature (1297)..(1297): n is a, c, g, or t
  misc_feature (1299)..(1300): n is a, c, g, or t
tgacttgaagagagggctcctcacacaggctgaagagcagcttgttatcgatctccatgcccgtcttggcaacaggttttccattttttacttgctcggcttccaagcattgccttgtgtttgttcaccagaaattattacacagtttatgacaatgtgatttcggttaactctacgcggttcttaatcatatttttcaatttacaaacaagaattaacaacttgatttataaaaattagtttaagtcgcttaattattggctatgtaataatttctagttaatttagagtttagcaatgaaccatgtgttttttctccttcaatcatgtttaaagtaattgccatcacatacatgtataaaccacatataatgttcaaaaaggtcctaaatttgaaatcatgtttaaactggacaacttaagcaaattgattgaaggtttattattattatcggcataatacatataacgatcgtataaacatatgttcgaatgttcatatttgccttattatatctcagggaaaagagatctattttatttttctttataatttttaaaagtagcaataaaataaaacaagagagaaagaaaaataaaatgagagtgaaaagttaattttgtagaagttacttaataaaaaattaataaaagtaaacatgtctatcaaaaagtatagactaaaatgagatatctttcttataatagttatagattatggataagttagtttatggtttataattgtctatcgttcttttcgtacaatgcaaaagtcattaaactggagatgattgatgaggtgaagaataatgacatatacttatcagttaggagataaatggcactaattcaatcgaagatcttactttgagcgatctatacggtttgtttgatatcggtacttacctttgggactaagaaagaccctcacatcaagcttatccgtaaatgttgcaacttaacttaattatgaggtaataagttttgtttgacatatgagtgattgtcgtagtttgtctgtctcaggtggtccaagattgctgccaggttaccaggtaggacagacaacgaaattaaaaatcactggaacacccacatcaagaaaaagctccttaagatgggtattgatcctgttactcacgaacctcttaacaaacaagtctcatccaaagatagttcatcccctgcagagcatttctcacaagtgaataacattaacattcatcaggttgagcaaaatgatggggttctcaactcagaagagaattcaacctcatcaccggctgaaaatctncnnggaag

SEQ ID NO: 4651 - DNA, 729 bp, Glycine max
  misc_feature (381)..(390): n is a, c, g, or t
  misc_feature (396)..(398): n is a, c, g, or t
  misc_feature (401)..(401): n is a, c, g, or t
  misc_feature (403)..(404): n is a, c, g, or t
  misc_feature (407)..(408): n is a, c, g, or t
  misc_feature (410)..(420): n is a, c, g, or t
  misc_feature (425)..(431): n is a, c, g, or t
  misc_feature (437)..(442): n is a, c, g, or t
  misc_feature (448)..(451): n is a, c, g, or t
  misc_feature (454)..(455): n is a, c, g, or t
  misc_feature (457)..(458): n is a, c, g, or t
  misc_feature (471)..(474): n is a, c, g, or t
  misc_feature (478)..(480): n is a, c, g, or t
  misc_feature (482)..(486): n is a, c, g, or t
  misc_feature (492)..(499): n is a, c, g, or t
  misc_feature (501)..(504): n is a, c, g, or t
  misc_feature (510)..(512): n is a, c, g, or t
  misc_feature (517)..(519): n is a, c, g, or t
  misc_feature (522)..(524): n is a, c, g, or t
  misc_feature (528)..(529): n is a, c, g, or t
  misc_feature (539)..(539): n is a, c, g, or t
  misc_feature (552)..(558): n is a, c, g, or t
  misc_feature (562)..(565): n is a, c, g, or t
  misc_feature (567)..(578): n is a, c, g, or t
  misc_feature (581)..(602): n is a, c, g, or t
  misc_feature (604)..(604): n is a, c, g, or t
  misc_feature (606)..(608): n is a, c, g, or t
  misc_feature (614)..(619): n is a, c, g, or t
  misc_feature (623)..(628): n is a, c, g, or t
  misc_feature (630)..(631): n is a, c, g, or t
  misc_feature (636)..(645): n is a, c, g, or t
  misc_feature (650)..(653): n is a, c, g, or t
  misc_feature (655)..(659): n is a, c, g, or t
  misc_feature (666)..(673): n is a, c, g, or t
  misc_feature (677)..(679): n is a, c, g, or t
  misc_feature (702)..(707): n is a, c, g, or t
  misc_feature (718)..(721): n is a, c, g, or t
  misc_feature (723)..(725): n is a, c, g, or t
cgtttcttttttcttttttcgggtttacattataagcaattagcttatgattagctcttggatttattggtttgctttttgggcttagggaaatgagagttttggtgaggttctgaaaccatcgactaaatactctgtttcctgtcgtgaacgtaatatgctctgccttaccttattttgttgaaatctttgaatatatcatggtatcatggtcctgctgttcggatggatggttgtgtatataaaaaaaaacttatcatactggctagtgagggaatctctcagatttgaataaagaccatagagtgaatactggcgaaggtttttcacttcataccaagagttgagaactgcaaggtgtctatctgtgccagacaatgnnnnnnnnnncctatnnnttntnngtnnannnnnnnnnnnttatnnnnnnnttcccnnnnnncttctnnnncanncnncccttttttcttnnnntttnnnannnnncccttnnnnnnnntnnnncttccnnnccccnnnacnnncccnnatttcttccncccttttttattnnnnnnnattnnnnannnnnnnnnnnnttnnnnnnnnnnnnnnnnnnnnnntntnnnttttcnnnnnnctcnnnnnncnnatacnnnnnnnnnntctcnnnncnnnnnttctttnnnnnnnntttnnntttttctttccctttttcccccnnnnnntcctttctttnnnncnnncctt

SEQ ID NO: 4652 - DNA, 370 bp, Glycine max
cttcctcccgggatagtgccacgtggcggaggcgtgaagagggagcgtgagagggacgcggtggcggagatggtggaggcgattaaggtccttcgcgacgggttcgtgaggatggagcagatgaagatggagatggcgagggagatcgagagcatgcggatggagatggagatgaagcgcaccgagatgatcctggactcgcagcagaggattgttgaggcttttgctatggccgtttcgcagaagaggagcaagggcaagtccacgccctcaccttcatcgcaaccgtagaataatcgaaatcgaatttgaaatcggacggtgagggtgattgattaattgtgtttagtggttcggtttcttgattagc

SEQ ID NO: 4653 - DNA, 497 bp, Glycine max
ctctctcctcatttttgggatcagagaagaaagccctcagattacaacacaccatcaaccctccacagtttctccaaccacagcgcctcaaaagaaacggaggaatcaacctggaacaccatgcaagtagcttagttgaatttcattacttattaaaccacacacacacatatacacaccctttgccaatttttttttactttttgcattttctcaagaacaaactcaatgaaaccctaaatcatgaattatatgagttagggctcttgacttctttaatggttggattgctttcctccaagtttctcaaaagcagcgcatgagatgagacttctagtttaaacttttttaatgattttttcttttaaacttgcatttttttattactattaaaatgcctacgtggttccaaaagaaggttaaaaagggaagattagttcttatgttcctttgtgcatatatgtgcaattgattgaagcaaagagtttttttttttt

SEQ ID NO: 4654 - DNA, 391 bp, Glycine max
ctcacattagaaaaaggcttctgaggatgggaattgacccagtgacacacagtcctcgacttgatctattggacatcaattccattctaaacgcatctttctatggttcatcacaaatcaacatccaaaggctccttggcatgcaccagtacgtggtgaaccctgagcttttaaaattggcttcttcactcttctccacctcgcagcaacacaatcatgaccctgatgacatgtgtgctcaaaaaggtcaacagaatcagctttgcgatcctcaaattcagaaccatgttccacactttgtccaatatcaagatccaattcaagaagtgcctgcatgcagcaccatgttcagcaccccttgtttttcaatgcctctaactcaaccacagtt

SEQ ID NO: 4655 - DNA, 639 bp, Glycine max
  misc_feature (631)..(631): n is a, c, g, or t
cgacgccaaatgaatgaccacctcagtgtccttagatccctcatgccaccttcatatattcaaagggtatgtgcattatatgcaatcattttttttttaaatatatatgaagtccaattctgaaccccattttctcaaaggacaatttttttaagtacttttgatgttgtttaccattttggaattaaaattttacttgggtaatttgcataaacagtaccaaaaatatccaagaaagtgcatgtaacaaagttttctccttctcaaagtcccttctcttgctttatccgtgctaaaaatccaatctttttcagtgtcgggtgctcaaaaattatgtttttgtttttttatcctttttattgatattgatgtattgaattcttgttcatggggtatagggtgaccaagcctcaataattgggggagcaatagattttgtgaaggagttggagcagttgcttcagtcccttgaggcacaaaaaaggatgagaaagaatgaagagggtggtggtggttcttcttcttccaccatgttgtgtaagcccccaccaccatcgtcattatcatcaccacatggctatggaatgaggtcatcaactagtgatgaagtgaactgtggggatgaagtganggcagaaa

SEQ ID NO: 4656 - DNA, 350 bp, Glycine max
cgtgcacgccgccaacgccctctccctcaagcacgtgcgcttccagatttgcgactcctgcaagaccgacaccgctgtcctccgctgctccaccgacaacctcgtcctctgccaccactgcgatgtggaaacccacggtgctgccgcttcctcccaccaccaacgtcaccgcctccacggcctctccggctgcccctccgtcacggagatcgcctccgcgctgtgcctcgatttccgggcccaggatcccgtggtccccaccgccgcctccggcggtcgcgatgaggtgtacgagcaggtgctggaaatcgcgcggcagaggaacgacgacctcggcgccgaacaactca

SEQ ID NO: 4657 - DNA, 359 bp, Glycine max
ggctagggctgatgtcagaaagcgtgtgaagggccgatttgtcaaagctggtgatgtctatgactatgaccctttgaaccaaaccagaagctactgagtgtacaacttttaaccatgttctgtaaaaaggaaagaatcactctatagttgcaaaagaaaagtaactcttacctgaaaaaatggatgaaatttgatgcattctttctccatgcaatgacaagctgtctgattttatgacaggggcataaattttcttcacggggaagaaggttgtaagcaggcccttgtccaatgaaattgacagtgtaaaagctcaggagcaaagattgtgtgtccttcactgcaatggacattctcag

SEQ ID NO: 4658 - DNA, 421 bp, Glycine max
tgtgtccaacaacaaagcaataagcctcttctcaaaaccttttctccaacggagttcgagtgcaaaacctgtaaccgcaagttttcatcttttcaagctcttggtggccacagggctagccacaagaagcccaagttcgaagctgaagaactcaaagaagaagccaagaagactaaacccaaaatgcacgagtgttcaatttgtggcatggaattctctctgggccaggcactggggggtcacatgagaaaacacagaggtgccattagtgagaacgacaataataataataataatgaagcgttgtcttctataaagcaagcaattgcaaaagctccggttttgaaacgatcgaatagcaagagggtcatgtgcttggagatggacctgaatttgacgcctttggagaatgacttgaagt

SEQ ID NO: 4659 - DNA, 399 bp, Glycine max
tattggactgaaggtggaactctcagaaacatccctgtaggaggtggctctaggaagaacaagagatcttcagcttcttgttccacacctaataatagtcacaataacaataattcaaccaataagaagcttctttctgatctggtcatcacacctccaactctgtcacacactcaaaaccctaatagcaataatactattcatcaaggccaagatctcaatttggcttttccatcctccaccccagatttcagaaaaatctctgaattggtccaacaaaacaacaacaacaacaatagtagcaacaacagcatgtcagcttcagcttcttcttcttcaaccacaactacaacttccacttctcacctttctgcattggagcttcttactgggatcaca

SEQ ID NO: 4660 - DNA, 852 bp, Glycine max
tggggatgagttaggagagatgaaagagaatgatgatgatgaggtgaaaaggaagaaggtatcgttgcagcttgattatgaggcgataatcatcgcctgggctagccaaaagtctccgtggaccactgctgacaaacaaaacttggaccctgatgagtgctggcaccaatgcatggtataattttgctatttattctccattttttatgtctcaattttcttataaattcccattcccattgccattgccaccaatcttttagattcgtcattactagtttaatttccttaatattgttgtttggtccaactaaagttgtttaattaaatataacgtacaaagttaggtggatttttataagtatttttttaacttgcatttttttttaaagcatagatgcttaaataaaaaagtgattatcatcagagaatcctaaaagcacctagtctaagttttatccttaaattaaccaaattggttccctgaaatgacaaaggcacaaactaagaaaagatttataaatgcaaatactaaattgattagtatttgtctgatttgaaacataggaataagctaagttttggttaggtgggattgtgggaaggctgatgatgaatggtggttttttattatgttaaattgaacattgaatgtttaggtgatttttgtttgactaatgaagttttgtgctgtttttaatcaagcagggaagttgcggaacggcatttcatcacccttacggtgaactgggtggatttgggattcattcagtgatagtagacgggggcagagaggcaagggtgtcaagatacagagagaagcgccgaactaggtgtctcgaagaaaataag

SEQ ID NO: 4661 - DNA, 282 bp, Glycine max
tgtaaagaaaagttggaaaagggcccatatggaaaggttaagtaataaatactatgcaattcagaaaaaaaaaaggagaaaatatatattaaaaaaaaatactgattgcagaaaattgagtcgataatgagagactaatttctcaatgtattgatgttcattcaagagattgatatcggcaaataaatgttatttcatatatacggacatgaaaatccaatccctaatcgcatacttaaaaacagaaacatgattatctgtctcacgcaaaaaaaaaaaaaa

SEQ ID NO: 4662 - DNA, 680 bp, Glycine max
  misc_feature (625)..(629): n is a, c, g, or t
atatgagtccttttcacacctgaactcttctgaaaaaccctgcaaatcacccactcattctgcaacacaataataaacacagcactgaaaatcaaacaaagcaaacaaagtactaatactaataagagaataaaaagtggaacataggaagcaacatgatcaagccaaaatcaaagttgttattagttattattattattacctttgcagttttggggaggttgtgaaaagagaatttaccatcaagcctatactcatgcatgacccaatcagttttctctcccttgggagcccttcctttgtagaaaaccaaagttttcttcatacccacaagagatttccctctgaaaatctctttgtctttccctgtagccttccagtatcctgattcagtggctctattagtcctcaaaccagttgggtattttctgtccctcacacagaaaaagtaccactctttctctcccattttggccttccctgtaacccaaaaaataaaaaacatgcacacaacataatgttataataaacttacacaattaatatatttgagtctgtatggtctcgttgtaagacaaaaatatatttagaagccaaataaaccaaaaccaaagtggggctgaannnnnaattttgttttgaacttacatggcaaatcccaaggctcagacctgtcaatc

SEQ ID NO: 4663 - DNA, 369 bp, Glycine max
gtcccaccaaggaagctcctcacccgccgctccgccgccgtccacgacggctccggcgacacttatctgcctcacagtggctccactgactcctccaccgacgatgactccgatggcgacccctacgcctccgaccaattccgcatgttcgagttcaaggtccgacgatgtagtcgcagccggagccatgattggacagactgtccctttgtgcatcccggtgagaaggcccgtcgtcgggaccctcgccggttttattactctggaacagtctgtccagagtttcgccgccgtcagtgtgaccgcggcgatgcatgtgagttttcacatggggtgtttgagtgctggctgcacccttctaggtatagg

SEQ ID NO: 4664 - DNA, 354 bp, Glycine max
ccttgtagataacaaaaagaaggagcatttttttttcttttcatgtatttatcctttggtgtaccaaaatttttggtcagtgtgattatgtagagtagcgctgatatttgctagtatctaagaatttaggtccaggtccgtgtgagtctcttcagttttgtttttcattttccctcatttgttttttctttctttcctttgcttgatttaagtatcacaatgtaataaaaagtttagaaagagccaattgtaactgttcattttactcataagaggtttgatggcatcacaaaataaaattgagtctcaactgtcacacgctaaagattgagttctatatggaagaaattaccg

SEQ ID NO: 4665 - DNA, 297 bp, Glycine max
tcttcctttgatttctcggtggctcaacctgctgctgcttcagggaggaataatgctttctcttcttcttattctgggaaagtggaacaagaacccataatctcctcttccacacatcatggcctccaccatgaggagcttgatctagagctccgcttgggaaataaatcaacatcaacctgatgtgaaaatatgatttgtttattgtttttgtgaaaaccaccatatatatgggttgcctgggaggaaagatcaaagtccaaactccaaaaagaaagatcaaagtccaaactccaa

SEQ ID NO: 4666 - DNA, 701 bp, Glycine max
  misc_feature (227)..(229): n is a, c, g, or t
  misc_feature (342)..(343): n is a, c, g, or t
  misc_feature (347)..(348): n is a, c, g, or t
  misc_feature (359)..(360): n is a, c, g, or t
  misc_feature (376)..(379): n is a, c, g, or t
  misc_feature (387)..(392): n is a, c, g, or t
  misc_feature (441)..(441): n is a, c, g, or t
  misc_feature (443)..(443): n is a, c, g, or t
  misc_feature (447)..(447): n is a, c, g, or t
  misc_feature (449)..(453): n is a, c, g, or t
  misc_feature (461)..(461): n is a, c, g, or t
  misc_feature (483)..(485): n is a, c, g, or t
  misc_feature (491)..(493): n is a, c, g, or t
  misc_feature (507)..(508): n is a, c, g, or t
  misc_feature (510)..(510): n is a, c, g, or t
  misc_feature (526)..(527): n is a, c, g, or t
  misc_feature (531)..(539): n is a, c, g, or t
  misc_feature (541)..(548): n is a, c, g, or t
  misc_feature (558)..(559): n is a, c, g, or t
  misc_feature (585)..(585): n is a, c, g, or t
  misc_feature (587)..(591): n is a, c, g, or t
  misc_feature (593)..(606): n is a, c, g, or t
  misc_feature (608)..(609): n is a, c, g, or t
  misc_feature (611)..(620): n is a, c, g, or t
  misc_feature (623)..(642): n is a, c, g, or t
  misc_feature (652)..(656): n is a, c, g, or t
  misc_feature (662)..(671): n is a, c, g, or t
  misc_feature (673)..(689): n is a, c, g, or t
  misc_feature (691)..(691): n is a, c, g, or t
ttgttatcaaaccctaacttgagagtatcttccatcacacatgacacgcgggctgagactcctccaatccgcggcagcgccaccgccggaggccgtggcggccgctgtcgagtccgactttgtcgtgatcttggcggcgctcctctgcgccctcatatgcgtggtaggcctcgtcgccatcgcgcgctgcgcctggctccgccggggaactgctggaagctccgcannngagattcgtttatttttgaattttctctcctattttttcttttttttcttctcttatttgtataaataattaatcgctgatatgcataatatatattaacggtacagttgaanngatnngaccaaaattnnaacttaagattttatnnnnttttttcnnnnnncttactactaacctgttgtgagttgaatggtttcatgatacgagagagntnggantnnnnngcaacctnccccccctagaagaatgatcgnnntttgtnnnagataagtgttgtnnancttgcaggtgaggtgnnctcnnnnnnnnngnnnnnnnnaatgcttgtnncatataatgatccttttctttaaccntnnnnncnnnnnnnnnnnnnngnnannnnnnnnnnctnnnnnnnnnnnnnnnnnnnnctcttctttnnnnnaacttnnnnnnnnnntnnnnnnnnnnnnnnnnntntttttattta

SEQ ID NO: 4667 - DNA, 361 bp, Glycine max
cttccctgggctcattcaacctacccgggaggcagcaactaggaccttcccatggcttctccttcggtatgaaccaatccatgctatcaaatctggtgatgtcagggttgggccatgcgcaagcaaagcttcctgtcatgcctgttcattcattcttggcagcgcatcaacaacaacagcaacatcaacaacaacaaaaccaacaacaacgtgcggcaaatgatttgggtttcatgttgccaaagggagagccaaatgtggaggctattcctgaacgtggtggccttaacctgtcaaatggctcatcagtgtaccaagaaattatgagccgcatgcctcttggacctcatatgtaaaaaac

SEQ ID NO: 4668 - DNA, 404 bp, Glycine max
acgaaaggaaagcgttctaagcgtagccgcacggagcaacaactgcaacacccttcatgcaccgaggaagagtacctcgctctttgtctcatcatgctcgctcgcggcggcgccggcagtgtctccaccgccaaacccgctgtctccgacaacaattctgcgccgctatccgccgccaaactgagctacaaatgttcggtttgcaacaaagccttctcctcttaccaagcactcggaggacacaaggccagccaccggaagctcgccggagaaaaccacccgacctcctccgcagtgacgacgagttcggcgtcgaacggtggtggtaggacccacgagtgctccatctgccacaagacgttttcgacaggacaggccttgggaggacacaaacgttgtcacta

SEQ ID NO: 4669 - DNA, 661 bp, Glycine max
ttgtagtactgctgttgataactcattagcctattcagatcatccatattcaccactccactgttgttggaactggaaggcccagcagagaagattgttggaacatgtgctgcagcttgcttagattgctgctgcatcatcatcaagccttcctcatgatccattggaacaactggaagtgccattgtggtgctgagtgctcccattgcagcacggtaagcagcattgtatttggaaagtccaagagctgtgttgacatcactgcttgcttccgtttcattaattttgtcaactatgtgttcagttgttggcggctttaattgtcccacgaatcccatgttgatgttgtgctgaaccatttcattgtgcttcttattattgtcatgagaagcccttgacgaggatggcctcgttgggaggcagcgagggagggaaggatggtcctccactccagctctcttgtacacacggcaaagcgatatctcagcctgcaaatgttaagagattcattttggtgaaaacggagccatgaaaatgaatttatgatgagacttcaaaattcatgcatgcagtctcataaatgtgtgtgagagaaagtgaattaattaataatgacaaacggtgctggttgttttgattttctgccaactctttttttttt

SEQ ID NO: 4670 - DNA, 684 bp, Glycine max
acaatgtctgatgacgaagatgagcaagtagatagtgatgccaatctgtttgatggtgctttggatggtcctgatagcatgggattcggtcctcttattcccacagagaatgagaggtccctcatggaacgtgtaagacatgaattgaagcacgaattgaaacaggttagagattaaatgttactaatagcttttaaaagtctgcgttcgagtcccatcattttgaatgtcttcccatgtgattgacctcaatgttttttatcttttaatttattatgtagggttataaagataaaatcgtggacataagagaggaaattttacgtaagagacgagctgggaaacttcctggtgacacgacctctgtccttaaagcttggtggcaatcacattccaagtggccttatcctacggtaagaactcaagactttactatgtttttttaggaaatccctttcaaacaaatttgaacgaatttaatgaataacaacaaagatgtccttgtacatatttgtgctacaaattcaaagagaagaaataaggattaatgattttacacaatttgtctatgcacttagacagtccacatgtttgcacttattgaccattgaccaaatgaacatagtaagctactacagaagaatttaacaattgactttttcaaaattaatattaaatgatttc

SEQ ID NO: 4671 - DNA, 407 bp, Glycine max
  misc_feature (61)..(63): n is a, c, g, or t
gagagagggggagctatggagctttctcaacttggtttcctagaagagttggtagctcctnnnagagactcatggaatgctttgtccactggattctgtgagctattgtctaatggctgttgttggagttttgacacttttcttgagaacccaacatttggtgcattttcagctccaagatttgacagcccttacagcagtgaagtatcagcagcatacccttttgctgctgatgggttcacaatgccattgtcagagcttgaccctgggagtgatgagccgccaccaccaccaccacttccaccatcattggaggatgcagagattggctttcatgacaacaacaacaagaagaagaacaactttgaagaaaccaaggttgtgtgcaaagttgaggagaaagacag

SEQ ID NO: 4672 - DNA, 1115 bp, Glycine max
  misc_feature (1048)..(1052): n is a, c, g, or t
  misc_feature (1101)..(1103): n is a, c, g, or t
  misc_feature (1109)..(1112): n is a, c, g, or t
cattgggactaagaagactcttgttttccaccaaggccgtgttccccgtggtgccaagaccaactgggttattcatgaataccatgctgttacctcccatgaaagccaggttggtttgcaattatgtttatgaaactttgtagctgaatgactcgtgtgatccatatagccatcctcgtttggtaggataagaatttgttggaaattggaaattgtctttctaatagattttttgtcactatagtttgtaatttttaggctttgattttatttcctatcccattggttgttctgactttagaaggttatatggatcctttgtttgaatttgaatcccatgtttttattttgtctgtctctattcatgacccaattttgtccatctggccttggttgatgatgacaaaggaggcatttgggagagtttatttcaataagctttgtgtggaagcttatcataatgagttctttttatttcattccaatgagctcctagataaagcttatgcataagctctcatatgacttaggataagtctttaattaaatcttttatgtaaatgcggtcgaaattcatcatcagttttcatcaaagactgccaaattgccaattaatttctgctgtataataactcttttggagaaaattaaggctgttttgctgcatgccctaccaagtcattcatttttagtttttgctgtgaatagaactgttcaggaaataaatttcggtttttgaagtgttagcttgattttccttggctttttatttgtgcgaattgtatcaaataaatgctgattatcctccaagtttgcagagggcttttgttttgtgccgcttgatgaagaaagctgagaaaaaaaatgaagggggaattgaggcaccgtcttttgatgaaggggagcccagtatacacatggtttctgactatggaaatccggcaagagcagaaggcattgcatctgtaagctgaagtattcttcatggacatattacactctgcatgtgaaaatgctgaaactgatgcttgttttttaaatatattcnnnnnaggtagatattattcctggagtagatatggatgaaatctttcgggcagnnnatcaannnnaga

SEQ ID NO: 4673 - DNA, 694 bp, Glycine max
aagcagcagcagcattcctcaacaccatcatcatcaaccactccagctgcaccaccaccccagaagaaaagaagaaaccaaccaggaacaccatgcaagtatcttaaattttttgtacaaaaatgtctaattatctttgattcatttctcatcaattaaatgaattgattttctctctttttttggtttcatgtctacaaacattttattcggccacccattattcttataatttttttccaatgatgtaattccctatctggggtgggggaaccctaattcctaatcctgactttgaaacataaatgtgaaatggaacatagaaattaattaaaagggtatgtcttggaaacctttggctttgtcttcaagctttcaaaaaaattaattgctttctttaataatttgtttaatcatgtgaattttctaataatttgttgtttggcattattttaaataattattttttctcttgcttggaatggaaacatgtgtgtatgcagatccagatgctgaggtgatagcactatctcccaagactctaatggcaacaaacaggtttatatgtgaagtgtgcaataaagggttccaaagagagcaaaacctacagctacacagaagaggacacaacttgccttggaagctaaagcaaaagaccaacaaagagccaaagagaaaggtttatctgtgtccc

SEQ ID NO: 4674 - DNA, 365 bp, Glycine max
gtcgcacgcatggtcgccaacatcgcaatactcgaatccgcattaaccgagagcgggaagctctgcgtggtggatttcgatatctgcgacgagaaccaatacgtgagtcttcttcacgagctttcggcccggcggaagggcgctccggctgccgtgaagatcgtcgtggtgacggagaattgcgccgacgacgagaggctgaatattgtgggcgtgttgctggggagacacgcggagaagcttgggattggcttcgaattcaaagtgctgactcggagaatcgccgagttgactcgcgagtcgctgggttgcgacgcggacgagccgctggcggtgaactttgcgtacaagctttatagaatgcc

SEQ ID NO: 4675 - DNA, 354 bp, Glycine max
gatttcttcgaatccgacattgcggggccggagagggcggtgtcggcggtgctgatgagggaaatcctgccggtggtgaagttctcggagatggagatggcggtggaggcggcggagagctgcgcggtgtgcctgtacgagttcgagggagaggacgagatcagacggctgacgaactgtcgccacatattccacagagggtgtctggaccgttggatggggtacgatcaaagaacgtgccccctgtgtcggacacccttcataccccaccatatgcaagctgcattctattacaatcatcactagattggcctctttttcttttttctggatcttctgttaaggttgttgagt

SEQ ID NO: 4676 - DNA, 406 bp, Glycine max
caaatgttctgtgaaagcttaacaacaacaacaactaacaataattcggtgcatgacactactccttgtgctctctctcttctgtcatcatcacagacgcacacaccagggaatggcttgaaccaaatggtgcagcctcctccctcaatgtccctcatgcagcccttaggcctgagcttgcaggataataacagcttagagtctgtggatcattgttcctccatgtatagcttggcttctgatcatggatcccagtgcaatgaagcagcccctcaactgtttccctttcaatgggaatagatattaattactttatctcaaggattattcaccactttgtttgttcattcctaatgaattctttccccccaaggactagttaattcattctgatttcaccctccca

SEQ ID NO: 4677 - DNA, 381 bp, Glycine max
tgatgatggcacgggagaggatcatgtagaaaaccatgatggtggtgtgtctgaagatgatgaagaaaatcaagttgttccatggacatctacaccaccacccccagcttccacttcttcaaatagtgttacaagttacaactagttctaccaggttctctaatgttgaagaaggtggctccgattaatgcttccaatatcgtgatcgataaaaacttagatacagttttttaggtgttttttgtgctgttttctaatcagaattagagttttatctcgataatctaatcaagatttatcgatataaaactctaattccgactaaagaacagtgtaaacaacacatgtggaacaatatccaagttctattttgtcctggtt

SEQ ID NO: 4678 - DNA, 352 bp, Glycine max
tgtcacatgggatgaaaattccttgctcatgaattctggatccaacaaatcagtgccttgtaaggatgagctcgccaatcttcttggaaatgaaggcacgcacacttcttttagttcttatatttgttggttcaattgcttgtttgatatgaagagtctgtgatggctgtactaaatggaacttttccaccacttaattatgttatatgacgttactgattcagctgatattggatcaaaggggataacacgaattgaccacagcagtcttagtggtgttgggaactctactagaaatctgcctgctactgagatgccaaaacaagggaaacaggctcaggttattcatgat

SEQ ID NO: 4679 - DNA, 393 bp, Glycine max
gattgccacagcgattgcgactcttcttcctccgtcgtcgacgacggccaggactgcgtcctcatctcctccttccggcaaccgctgcccttcgatctaaacctcccaccatccgatgccgacgacgacaacgacgacgacctgccggccaccgcgctgtgcctctgatgatgaagaagaagaagaagaagaagaacctcttctcggtataatcatcattttcttcttgttgttgttattgttgttgttgttgttcaccatctctggtttaattaattaattaaaagttgttagattgtgttgtggtgttgtagagtaatattataataggcatgaatgtgttgttgtaagttatttggatccattactgtgtcatagcattggacctgatct

SEQ ID NO: 4680 - DNA, 972 bp, Glycine max
aactaaagtacttttagaagttccattttacagagtaggcccagttttgtttgttggatttccggatgctgcctggtgcaatgaattcaactggatcattacatgtttagatttacaccagaagtattgaaaattttgcttcaaattggttttagtataccaatcctgtttgctactatttgctgcatatgattatagttttataatccgtctttacttattaccttcaaatattttccttgaaccatagagatatctatgttgattttaatttaaaaaatattacttttggattattctgtttgtatttctcttctggaattcctccttattatatagaaatataaaattttctaaaatcttacataatccaatcacattggtgaactatggtaaatataatggtgctttgttttttaggcttcaccctggttgactttagtctctatccatacaaaaactaattgtggcttaataggaatatgacaaaaatatttcttgattctttatagagggacacatctggccttagtactgaaaatacagagcttaagctccgtctgcaagccatggagcaacaagcacagcttcgcgatggtagtcatcatcactttctttgctcgatttattaattttttaactaaagtttagagcatgttattaagattagttaattacactgaaattagtttttgatatgttgtagctcttaatgaagcattgaagaaggaagttgagagacttaaggttgctaccggtgaggggatgagccacactgaatcctttaatctgggaatgcaccagatgccattttccggatcaaatttcattccaatcccgccacaatcaggtccttctggtcaccagaacatgcagatgccaccatttggtcactccccatccacaatgccaactcatcaactgcatcaaacaagttctcatccatattcagaaatattgcaaaagaacagc

SEQ ID NO: 4681 - DNA, 582 bp, Glycine max
acagaacccgaaccttccctcagctatggagcaaggatcgttttcaatgggactcaggcatagtggaaataattctaaccttaccaggcatagtagctctcccgcaggactattttcccaaattaacattgaaaatggtatgtcctgtgtccactttatgtttatttactttttaattttggctgcaaggtggtacaattatgttgtcaacttagagataaggaaaaaagaaaaaaaggctaattgttttgggggctattaggcttcatgtttgtttagagcttgaatgggtttatgtatgggttgtcttaatgttatggaagcttaattggcagtgtatgctggtgtgagaggcatggggagtttgggagctgttaacaacagtatcgaagatgcgaaattttctagttcgaggaggttgaagaatcaaccgaactattcttcgtcggggagaatgtcgtccattgctgaaattggggacaaagggtatagagaaagtagtccagacagtgaagcttttgctgatggtaacgattttatggccggtttccaagttggtcattgggatgatactgcaatgat

SEQ ID NO: 4682 - DNA, 1001 bp, Glycine max
ggttaagatgtcttagcttagttatgagtattgtcaaaatattctttgtaggatttggacaattttcttgttctgaactagctattcaaagtaaatattggcatggtgtccgatactaattttctatttttaacttttaacataaattttagtcttcagccaatacaaaaaaaatgtcatttgtatatgttacaaggcttcaataggaagctgggaacaacttttaagatttttttaaatatatataagaactgctttatgactatgattttatgaaaatatgaaaacaggaatctcaagcgggaacttcatttgttagactacaaagatgggctttcacaaaccagtgaagaaactgattatgatctaaaccaggtacgactattttaactaatattgatatcacttggcgtctccttatttttttgggacttttcattgatcaatgatcatcttatgctgtaaaagcatcaagcaatgtttcagaaaatgtgcatttattagtttatattccatgcgtggcacaaaattttaaattaaaaacttagtttacttcaaattggtagctatatagggcaggcagaatgtttttcgcttggcacataaaattttagtcccaacgtaaaaatataagactaattttaatacagtgtattaaatttagcatttttatttaaaaaaaaaaactaaagacgcagaatagatgttcatattcattacatacatgataattcatatatatatactggaaccttgcaggaaccacagtcaagtgcagtactcttgcttagtgatgatgtgtcaaatgaagaagaaaattttgctgatctatcattgatctcctttagcatgcctctaatttccatgatgcaaagtgagaataacaaagagataatgcgtttttcgtcatcgactgcagctgcagctgctaatcattccgtcgttgattccagttcttctacgccgtcttttgcaaacaattacataaacttagatctaac

SEQ ID NO: 4683 - DNA, 693 bp, Glycine max
ataattaattctatttttttattggccataatgttagttattaatttttatcactagaaaaattcgaatgtaaggataattatatttgaatatttataaatttcaaacacccaaataatacttataattttattctatttctctatcaaaatgaatcacttatttttctatctcacaacgttgtacacttaaaagaggtgtctaagaaaacattttccttatgataattagttgtattttaagatgtaatatgttagctaatataacactatgtaaaacagggtgaccaagcctctattattggaggggccataaactttgtgaaggagttggagcagcttttgcagtcgatggagggccaaaagagaacgaaccaagggaaagagaatgttgttgggttaaatgggacgtcgagaacaacaacaacaacaccctttgctgagttcttcgcgtttcctcaatacacgacacgtggtacgacgatggcacagaacaaccaggagcagaaacagtgggccgtagcagacattgaagtgaccatggtggataaccatgccaatctaaaggtactatcaaagaaacaacctgggcagattatgaagatcgttgttgggcttcaaagtctcaagctcagcattctccaccttaatgtttccactcttgatgatatggtcctttactcagttagcgtca

SEQ ID NO: 4684 - DNA, 920 bp, Glycine max
ttgttatgatttgattgacagtgttgacgcagccaatggacatcatgagcttcagcatctcagattctcttgtcatgtaccgaatgtgactggaagagggtttatcgaggtggtatctactcatggtcataattatttttgaaaatatgttttttgcgctggcattcctttcagcaaagttcatgaagtaatttttcttttcttcaatatggacttctttatcttagctgaagctcagaagaaactggagaatgcttttgagacttcattaatttatctcaatgattggatatatactgctgttgatgcctggtatttggtgactttaagaaactctgaaggtcctgtatagtgttaggttctgttatgaattgttgaaaatcaatctataaatgagagtgtgtcctaatttgacatcacctctccccttatgtataagagatgctttattcctgatgctaaactataaattttcaaatcatttagaaaaggtttaagaaatggctgaatggaggcaagtaatctatcctcaaaaagcatgtagttagatgatttctgatgataaagcagacacttgtcaagtattagaatcagataaaagatattctgcacaaatcagataaaagttatatttgcatatatgatatgatatctttactcaggtggaagacaatggtcttagcagctgttcctttccattcatagttgcagagcaagaaatttgctcagagatctgtaagctggagaatgtcattgaggcagcagagactgctgatgacatccaaataaaaactaacctaatggaagaaaagactcaagcattgtatttcatacaagaaatgggttggctccttcatagaaatcgtgtgaaagttaggctaggtcctgtggcacctgtccaagatacttccatttaatcg

SEQ ID NO: 4685 - DNA, 777 bp, Glycine max
caatacatgaacttctgcaggatgttgaaagtttccctctgttgctgttatatgtattagtgttagtaattcaatcatactgactaggatcttgcttttattcttcaggccgagctcgagaggggaagaaaacaacaggtaaccactacccaataatgatctaattaaattcttgtttgaagttcatatcaagggtacacaagatttggtgtagcattgtcctttcatgttccattacaataattaaaacccagtatgagaactgttcaatatctatgcagctttggctacactcaatttaagacacaacaaaactcacacttgctctaaggaaatttgtcttatgatattttcatgacaccacccccactttccctttcttagcaacaaataacttaaaactacatctgaattagtatcttgtgatcaccttgtgcagtgttttgaggaagtgaacgttagtgttaaaaccaaagctcagaaagcaaaagagaaactgagagctttgagaaggaacatgagttgtcctttgtgaagaaactgcacggtaatggtagcagtgaaatacttggattttagtacgcacaacaagagtttgttgtgatgcatctactacttgtgtggctaaacgaagaaatagtcatgacacaaatcaagaggggagaagaaaactaaagaactactcaagtcaaagccggttgaagaaacagagaaacaaaaggtcggagttatgaaatttaattataaagccaagctgcaagagtcctcaagttcaag

SEQ ID NO: 4686 - DNA, 430 bp, Glycine max
tcagggaacccttactaccatcaccgcaaggtggaagcaggggaagaagacgaccatcacgggttcgagctcgtgagcttgctcaccggctgcgtcgacgcaattggatcgagaaacgtcactgcaatcaaccatttcatagcaaaattgggtgatcttgcttcccccaaaggaacaacctcgataagccgcatttgcgcttacttcacagaagcattagccatcagagtcacgaggctctggcctcacgtttttcacatcgccgccgccaccacttcacgcgacatggtggaggacgatgaatccgccacagcattaagacttctcaaccaagtaaccccaattccaaagttccttcatttcacatcaaacgagatgctgctgagggcctttgaaggcaaagacagggtccacataatagatttcgaca

SEQ ID NO: 4687 - DNA, 314 bp, Glycine max
ttctcctgaacggtgttttaatttttgacaatatatattttgatcttcttttcttatgctttctacttttcctctgtcaaagcatctcctttgaaactgaaaatgagtagctttttgctaaaagaagaagcatgggcattagaaaaaaaggttaaattgaaggaaaatggggagtccattacacactgctactatcagtaccatactctgcaggctaccctttaactaatgccggtctcattgggagggatgcttcctttcaacaagtggttgttgatgattacagggaaagggaaagagaattaaaaaaaaaa

SEQ ID NO: 4688 - DNA, 324 bp, Glycine max
ggttctttgacattgccaaggactcttagtcagaaaacagttgatgaggtttggagggacttgatcaaagatagtagtggtggggccaaggatggtggaagtggcaatggtggctcatcaattcctcaaaggcaagcaacattgggagaaatgacattggaggagtttttggcgagagctggggttgtgagagaagatgtgcctcaacaacaacaacaacaacaaattggaaaaccaaacaacaatggatggtttggtgactttcctagaccagacaataacaacactggcctactttttgggtttcaacaaccaaatagaagc

SEQ ID NO: 4689 - DNA, 371 bp, Glycine max
cttccgcgacctcgccagcgcctccggagtagatcctcctccgtcgggatgcgccgtgtgcctgagcgagttttccgaagaagaggaaatccggtgcatggcgaactgcaagcacattttccactgcgcgtgcgtggaccgttggatcgatcacgatcagaagacgtgtccgctgtgcagaagtacgttggtgccacatcagaagctcgaagaatacaaccagcgactatgggcggcttctggagtttcgcagttttattaccaagacgattacacggcttccctctgaatttttctttttctttttccacttatataattatatatatctttttttattatggtggggggacttgacagctagtgtagcc

SEQ ID NO: 4690 - DNA, 359 bp, Glycine max
aataaatagagatcaaaaataaaattttaactttttgcgggatgaaaattacaagtaaaattataaggaaaaaaaaatcaaaattactaattttatagaaattaaaaatatatttaagtcaaattataaagatacacccacttttattacaatctcaaagcttttttacctaagaatataatgtcaaagaagatgaattcataattaatttgtaaactacagattaagtcgtcaccgtgtacgtgttttggtaaaattagcatgtactttatcacatttttatgtttctatttgttgtattgttttgcagtgttagaggaacgatcgataggtacaagaaagcatgtgctgcctccaca

SEQ ID NO: 4691 - DNA, 419 bp, Glycine max
aagctggagtgaatcctcctggtggagtttggcaagaggataaggatggacacgttgcaggaagagcaatatatgcttcagatacacaagcttactatgtcttcctcatcttcaatactttggcattttctaattccatcttggtcattctctcgctcactcacaagttccctttccatttcgagatatgtgttgccactatttccatggctgtgacttatggatcatccatttttgctgtctccccagacgattctgtaagatttcgctatatccttatcactgctgcggggccttttgtttttagatttctggttcttatcttcaacttgctcttaaggaaacatgttcaaagtcagaatctactacctgaatcagactcagttcgtggttgatctcgttcttcaactctacccatg

SEQ ID NO: 4692 - DNA, 477 bp, Glycine max
tgattggcaactcattattaaatcaattacgaaaacgaagaaacccaacaaaacaatggtagtagcttagctaattgcctaattgaatgaatctcaatggaacctcctctcatcaacgactccacattctcttccgctaacccttccttgtccgagatttggccctctcattttcccacagaccacactcccagtaacaagagacacctctccccctcggttctttcctctttctctcttcatttccaccatttcaattatttctaatccatttctcacaccctcttctgtttgggattcgaacagactgattgtggcagcaataaacatatcaaatcatcaggatcaggatcccaggatcaaaacggtgccttgaaggcgggtgaagtggacgcgacttcagtagccggtaacaagttacccgaacaaacggcgaaacctagttcttccgagcagccacctaagcaagactaaaaa

SEQ ID NO: 4693 - DNA, 395 bp, Glycine max
ccgagcgacgtcgggaagctgaaccggctcgtgatcccgaaacagcacgcggagaagtacttccctcttgactcgtccggcggtgactcggcggcggcgaaagggctcttgctgagtttcgaggacgagtcggggaagtgctggcgcttccgttactcttattggaacagtagccagagttacgttttgaccaaaggctggagccgttacgtcaaagacaaacgcctccacgcaggcgacgtcgttttgttccacagacaccgcgcccaccctcaacgcttcttcatctcctgcacccgccaccaacccaaccccaaccctcccgcgcacgttagcatcagatcctcctccttctactctgcgctcccagcttatcctacgcaccatcatcatca

SEQ ID NO: 4694 - DNA, 526 bp, Glycine max
  misc_feature (109)..(116): n is a, c, g, or t
  misc_feature (119)..(124): n is a, c, g, or t
  misc_feature (262)..(262): n is a, c, g, or t
  misc_feature (264)..(265): n is a, c, g, or t
  misc_feature (267)..(267): n is a, c, g, or t
  misc_feature (269)..(269): n is a, c, g, or t
  misc_feature (271)..(276): n is a, c, g, or t
  misc_feature (310)..(310): n is a, c, g, or t
  misc_feature (330)..(333): n is a, c, g, or t
  misc_feature (335)..(336): n is a, c, g, or t
  misc_feature (339)..(350): n is a, c, g, or t
  misc_feature (352)..(361): n is a, c, g, or t
  misc_feature (367)..(368): n is a, c, g, or t
  misc_feature (371)..(375): n is a, c, g, or t
  misc_feature (377)..(378): n is a, c, g, or t
  misc_feature (381)..(381): n is a, c, g, or t
  misc_feature (383)..(385): n is a, c, g, or t
  misc_feature (390)..(392): n is a, c, g, or t
  misc_feature (394)..(394): n is a, c, g, or t
  misc_feature (396)..(396): n is a, c, g, or t
  misc_feature (402)..(411): n is a, c, g, or t
  misc_feature (414)..(419): n is a, c, g, or t
  misc_feature (421)..(422): n is a, c, g, or t
  misc_feature (425)..(435): n is a, c, g, or t
  misc_feature (439)..(440): n is a, c, g, or t
  misc_feature (443)..(446): n is a, c, g, or t
  misc_feature (448)..(454): n is a, c, g, or t
  misc_feature (457)..(471): n is a, c, g, or t
  misc_feature (474)..(478): n is a, c, g, or t
  misc_feature (481)..(483): n is a, c, g, or t
  misc_feature (486)..(489): n is a, c, g, or t
  misc_feature (491)..(503): n is a, c, g, or t
  misc_feature (505)..(508): n is a, c, g, or t
  misc_feature (512)..(517): n is a, c, g, or t
  misc_feature (520)..(522): n is a, c, g, or t
ccttctcactgcctacagtaatttatttattgcaaaaaatatttttttccccactattcattgcagtgtggggcaattatttgctttattttcaatatatatatatatnnnnnnnnatnnnnnntccccattaggaagataaaatcatgaaatattagttttgtgcaaccaattaaggcaaagttaaattgaaaggaaaggaagcaaagcaaagtatgagtaaaatgttaagaaatcaagtgtatgtatggccacacagatntnncngngnnnnnncaacagacggcatggtgttcatcctaccggctgnggtgattattgttggtcctnnnntnncgnnnnnnnnnnnngnnnnnnnnnngctctnnatnnnnncnncgngnnnccccnnntnancccacnnnnnnnnnncannnnnngnnctnnnnnnnnnnnaatnnccnnnncnnnnnnnggnnnnnnnnnnnnnnntcnnnnnctnnncgnnnntnnnnnnnnnnnnntnnnngttnnnnnnggnnntccc

SEQ ID NO: 4695 - DNA, 337 bp, Glycine max
cagctatggattaactctaatgaattggttccttcttggtccaaagttcctcaattcttgagagcttcccctccaaaaccaccacccaataaccagttgcatttcactaaccccgcaaccttttggaatgcttctgaggctgcaaacatcaaagatgttcgccccagcttcttcccttcattgcaaccccctttctctacgccaaattttgaagtacagtcaaaggtactattactatactactacgacaacatagtttatatggtttttttttatcggtaaatattaatttttaataaagaagatcaaatttgtaatctttttttttctttttttt

SEQ ID NO: 4696 - DNA, 660 bp, Glycine max
tattacttgaggccagatattaaacgagggaaattcagcaaggaagaagaggataccatcctaaagctacatggaattcttggaaacaggttggtgcatgtagggtacctaacatatatattattaattgactacactgttttctagctctatttctctgtctctctccgtgaatgagttctggctacggaaacaagaactccaaatatctcgtgtgtactgatttaaaaagatgccatgcatatatcatttcctattttaaagatttcaagaagatatgagatgtaacatattttcggtgtatagtcttttttctcattatagaatatgattgtgaagtgtgaaccccttgattgcatagatggtctgctatagcggcaagtttgcccggaagaacagacaacgaaataaagaatttttggcatacccatttgaagaagaggatccagaaaagtggagtgcacaatggcaatccttcctcacgtatcttgcaagaggcacaagcaaatactagttcgaatgcatcaagtgtaatgattgccaattacggtttaccctcaaggaatattaatccacctattgcaggattttacggtgcagtctcctcagatacttttggagaaattaaggacaatcatggttcttgtcagctcagtgaag

SEQ ID NO: 4697 - DNA, 393 bp, Glycine max
ttgaaaggttttaagtccacgaccgcaatttccactacataagtcaaggtttttggaaccattgtgattgtaattgtggttgcatcgactgtatttgttcgcaattttttacaacatcaaggatcataataaaacctttaggactatggtttactccttctatgacaaaacctcttcttctggctctgatatttcggggttgatcaatcctactttgaacaaccttggagcttccaatggcgtttcgcggggcggcttgtcatcaccacattctttggtttttgagagtgagaagggagagctagtgaagtgccctgcaactgcaaaggtagggaagagtgagatttgtgaggccaaagctttggctgctttgaagaaccatagtgaagcaga

SEQ ID NO: 4698 - DNA, 389 bp, Glycine max
ctcgaccggccggtccagacacgtggcatcctcgacctcgcgggccccacgggcgcagccggtaacccgttgcaagccgaatccaacggcctcaatcaagccaccatagaaacgttcccaactttcctctacgccgacgtgaagggtctcaagattggaaaagacacgcttgcatgcgcggtgtgcttgaacgagttcgaagacaacgacaccctccgcatgatccccaaatgctgccacgtgtaccaccccgattgcattggtgcgtggttagcctctcattccacgtgcccggtgtgtcgtgccaaccttgttccacaaccagaagacatgaacacgaacacgaacacgaacatgccttcaatcttgtccattcagatacccaatga

SEQ ID NO: 4699 - DNA, 402 bp, Glycine max
acaggatcctgataatgctgaagctttggagggacttgacacccttgcaaatctagctatcctgggagagggtgaggcactcccagcatccgcccaggccacaactaagcatccacgccatagacctggctgctcttgcattgtttgcattcaacctcccagtggaaagggccccaagcataagcagacatgcacatgtaatgtatgcttaacagtgaagcgacgattccgtacccttatgttacggcgtgagaagaaacaatcagaaaaagaagcagagacaactcgtaaaaagcaacagcaacaacatcctctaccattaccttcatctgaaattttgcttgatgaagattccttgccctgtagtaacacaggtgatagtagcccaaaccagaacaaagt

SEQ ID NO: 4700 - DNA, 403 bp, Glycine max
aggtcaccgcctccgccgaatccgctgtcaagttcgccgactgcgcgatctgcctcaccgagttcgcagccggagacgaaatccgagtgcttcctcagtgcggacatggcttccacgtcagctgcatcgacgcctggctcagatcgcattcctcctgtccatcctgccgtcagattctggtggtttctcgctgcgacaagtgcggcgggatcccggctccggcgagttccagctcggcgccaccgctggcggactcgggggacagattgaagggaagggaggaggacgcgaatagattcttgccttagctactgctttcggtttatatcaactcaaaattcatgaatccttctaaaaaagaaaaacattgtctatatatagtgtggaaatagcaggtggtgta

SEQ ID NO: 4701 - DNA, 380 bp, Glycine max
  misc_feature (309)..(309): n is a, c, g, or t
gcatcattgattgcccggtgacggttgttgctgagccatacaacgaacatcctacgggtgattcccatctcagagcagaagctttcgatttcgtccttcttttcctttcgaggtttccaccccacactctcagcaaacctaatcagcttgttcttctgctccgacgagaaggtagtcctcttcttcctcttggacctcatctcttgcacttgatccggtgtttgagtttggggctcagcaatgaaaatggtgttcttgtggtgaaagtttcggcggcagccacaacaagcacacaagagagcatcctcnccggcgatatacttgacacaaccatcataggtgacatgaccaagtgctgctgaatggttatgcaaacactc

SEQ ID NO: 4702 - DNA, 408 bp, Glycine max
attagttgtccaatcagaaaaaggagcattgaacactacttatttttccttaaaagcatgtctaggatctaaacttaatgaattctagtgtgctagtgaagttaaaaggaaaaacccgaaacaaaatattgtttctcataatctaagtagaccatatcatagcgtaccaaataagatatcaaatggaactcatttttttccttcttatgatagagttaaccatgcaattgtagtactttataacttaacacaaatggaaatgaatttagtgtaacttgcaattgtagaggaaaaagaatgatggtggtttaatgttgttactaaaactctgtgaatgctttctgaattgtgtacagttgagaatggtaggcgcttctttccccattgctctgaagtgcttgataaaaa

SEQ ID NO: 4703 - DNA, 367 bp, Glycine max
caaacacgcaccaatttcaattaaatctcttctttattccttttttcttatcagatccggaggcagaggtgatcgctctctcgcccaagactctcttagcgacgaaccgtttcgtgtgcgagatatgcaacaaaggattccagagagaccagaatctgcagctccaccgccggggtcacaacctgccgtggaagctgcggcagaggtctagcaaggaggtcagaaagagagtgtacgtgtgccccgagcccacgtgcgtgcaccacgacccttccagagcgttgggggacttgacggggattaagaagcacttctgcagaaagcacggcgagaagaagtggaaatgcgataagtgctccaagaagta

SEQ ID NO: 4704 - DNA, 363 bp, Glycine max
gatgccggagtgtcgccattacttccacctatgttgtctcgattcgtggctgaagctcaatggctcttgccccgtttgcagaaactcgccgcttccgacgccgctttctacgccgctgcaggaggtggtgccgctctctcagtatgctgctgataggagaagaaataggtgaatctttttttacaaaaaaaataactttttgggttaattggtgatgtgggttttgctttttttgttgttggggtatttaaagtttttaactttcttagttttagaggttgggtaggtgtagggggagggggagaaaatagagggtttttatctttttcttttttgtttcgatttagctttgatcatgagagg

SEQ ID NO: 4705 - DNA, 402 bp, Glycine max
ggtggagggtgctgagagaagatacaaaggaataaggatgaggaagtggggcaagtgggtcgctgaaattagagaacccaataagcgttcaaggatttggctcggttcctattctacccctgtcgccgccgcacgtgcctacgacacggccgtcttttacctccggggaccctccgcacgcctcaacttcccggagcttctcgtcagagaaggcccggccgccctagtcgccggctgcgacatgtcagcggcttctattaggaagaaggccaccgaggtcggtgctagagtcgatgctcttcaggcaacccttcaccaccactacgtgcccccgcggcaacttctctctggcggtgatggtgggtccggggatttcccggtgcgggttgttgacctgaatag

SEQ ID NO: 4706 - DNA, 562 bp, Glycine max
gctccaaaggctatgcggtgcagtctgattacaaagcacatctcaaaacttgtggcacccgaggacactcttgcgattgtggccgcgttttctcaaggtacgtacgtacgtaattcagtcgatcactcatgcccgatggaaccttaaactaattaattcaattttccatttccttctgtgcgatcgatcatctatttttgaatgctcgatcgtctacatataagtaattaaggatctgagatgaatggattcttaattttgtagggtggagagctttattgagcaccaagacgcgtgcaacgtagggaggctggggccaaaaacacaatcacaggcacaggcagtgcaagcagctgcatgcttgtctcgaacagcttcaagcgaaaccaatttcagcactggttccccttggccacaaagcggtactataataattccaaatcccaccgttacggtagtagaaccctcctcatacaccattgtcactgccgaaaccaacaacaaagtccaccccaacctggagcttcagctctctaataccactcctactgcatcatcacaa

SEQ ID NO: 4707 - DNA, 603 bp, Glycine max
tgacagttggatcaagttactgtggtagcaatcacatcccccaagatccagatgcaagcagggcatcaagcaatggtgtctggactactactttatccgccgagcctgaagctgttagagaccatgtgccgagaacaagtcctcagaatgaaaaagggaaatcggagatgcttgaaccaactacaacttcatcatccggtggctcaggtagtagtcttggaaaaaattgttcgctatctacgagaaaccagggccaaaaaagaaaaggaatagatgtggaagaatctgaggagcaaagtgaggtgaagcctccctctctctagttagttaccttcatgattagatgctgttattctttggcgctctgagctatcactttatgtttaataggacacagaacttaaatcagcacttggaaacaagtcatctcaacgtgcagggttggctcgaaggaaccgcgctgctgaagtgcataatctatctgaaagggtggggttttttgatgcatttcttgcgaagttaatgtccataaaatttattcttacaagtggtagtattgctttattgatgcagagaaggagagaccggatcaatgagaagata

SEQ ID NO: 4708 - DNA, 315 bp, Glycine max
agaaggttgaaaagaagaagaagaagaagaagaaggtgggtgagaagattaagaggctgagccaagtgaagacacccgaaactctgaagaagaaagcacccaccaagaaggacgcggcggcaactaagaagaaatctgcgtcggcggtggaaggttcaggaggagggaaagtgaagtgtttgagtcaggtgaagacccctgaggccttgaagaagaagaagcccaatttgacacccaaaccttccaggcccaacaggaatgctaggaaatgaaaccaccacttgtgtcgtatgtatgttaatgcttttttttttt

SEQ ID NO: 4709 - DNA, 389 bp, Glycine max
gtgtgttattctaggaggcagaaaaaactctaatacataatcatcatttcctgtatgagagcttcgtaaacatattgcaaaacagcttgttaacccaaacatgagagcataatgaactaaggggtaatcagttttgtagaattgggtaatgtttgaacagaagcacatgccgtgggacaaaaaagccctcccagcaaccccttgaccttgttgtaagtgatgctcaacacaggcctcccgaaaaccccataaatgagcatctataatataaaatgctatgtcagttgtagacatgcaaactttccccatgcatctaccatcaaaactagaacaacttttctttacaccaccaccttgggccaaaacacttcgatgcttacagggaataa

SEQ ID NO: 4710 - DNA, 785 bp, Glycine max
atcaccgaggtatatcatttgtctacattatgacatctatattccctttttatgtacccttttgtatcctgacattaaaatttttgcctcgtttgtcttcagatgcggtgcttgcaagagttgcaactgagaagaggttgtcattaatcaaagcatgggaagaaagtgaaaaatcaaaagctgaaaacaagtgagaatctacaccctttggttcaaaagttagaatcttcaattgagtcaccttaatcatggtgattaatcaacctaacatcaagttgaggtcacatgttatgaatatttgaggtcaacaatgtctaggataataatttaaatgaaattgttaagcagggctcacaaaaagctttcatcagtttctgcatgggaaaacagtaagaaagctgcagtggaggcggacctgaaaaagattgaagtaagaattgatttcattagtagttctaacatattttatgtgttcattttcttctcttcttttttgtaattttaaatcttggtttcatgtgattatttctctattgaatctgcccaaagagaagaagaaattaaagttcactttttttatttttttatttttgcatctgagtaggaagaactggagaagaaaaaggcagaagctgcagagaaaataaaaaacaaaattgctacaatccacaaggaagctgaagaaagaagagcaataattgaggcaaagaaaggggaagatcttcttaaggcagaggagcaagctgcaaagtatagagcaactggaacagctccaaagaaactcc

SEQ ID NO: 4711 - DNA, 732 bp, Glycine max
aggcaacaggcaaggacagagagatatataaggcaaaggcactgattggaatgaagaaaactcttgttttctacaaaggaagagctccaagtggtgaaaaaactagctgggtcatgcatgaatacagattagaagatgaacattctgtgcacaatccacccaaaaaggccatggtaaagtttgttttctgttttctgttagggttctctaatatttgataccatatacatttatttctattttcgctttatattttttatttttttaatacacaaatcttaaaaatacttcacaagaatcgaaaaaacaacgatttttgtgaaatatttgtctcaaagttattatacaacaaatgttgtacaaaaatctcagtgcccgcctattagtaggggatttgggtagtcttacaaggtatcaggttcaaacctcattacggtcattttacccacacaaaaaaagtttaacaaaaagtatttaattttgtctactttttattgttttttcattaatgtttgttcatatggttgtttgtgttggtttccattcagaatgattgggccatctgcaggatttttcagaagagtaatggtgggaagaaaatgccaatttctgggttggtgagattcagcaattttgcaaaggacatgccttcattgatggattcttctccatacaacgacagtgaatcaaaacctgttttgggggagtcatcacagccaacatgcttctctg

SEQ ID NO: 4712 - DNA, 298 bp, Glycine max
aaaaaatggagaacaggaacacatgcatcatgttcaagggctagagagcaacatggacaccaagcaaaagaaacattgatccatggaatttatcaatggtggtattggggatgggatgctcccattggagatgttaaatgtccaaaatagtccttggcctaaagcatctctcctttaaaaaagtatgttcttttaagtgtttcagttgtctttcccatttaaatcagtgatgcttaattttattgtctttctttgaaagtgtctgtgaatacaatagccgtatgtcatagtttggaaa

SEQ ID NO: 4713 - DNA, 417 bp, Glycine max
aggagaacaagaaccatgaatcaactttgtggtgttatccttttggttctctcagtcttgtgtttccatgctagagcacagactgctgcaccttcaggagatgctgtctccaatttccaaccaagccttgctgttgtcataggaatccttggtgtcatgttcttactcacattctttcttctcatgtatgcaaaattctgtcaacgctgcgcttcttcgcccgttggagacacagaaaatcaactcccttttgttagatcaagatctagattctcaggaattgacaagaatgtcatagaatcactccccttcttcagattctcttcactcaaagggtcaaaggaagggctggagtgtgcagtgtgcttatcaaagtttgaagatgttgaaattctcagaccttctaccaaagtgcaa

SEQ ID NO: 4714 - DNA, 392 bp, Glycine max
gggaacctcaatcaatggaattgatcttcaaaccctttcagctgctggccagttcccatcacaaagtctagccaagtttcaagctgctggacttggcaggacaactgccaaagcaggtatgcctatgtctctatccgatcaaaagaaccttttcagttttgagaacccaagattaagatttggagaagggtcactacaacatttaagcaacagtaagccaataaacttgcttcatggaattcttaccaacatggagccaaagcaacttgccaatttgcaccaatctacccaaccccttggtagcttgaatatgcgagtcaattctcctgccacgcagaacaaacccttgctgatgcagatgactcagtctcaaccaagaggtcagttgctaa

SEQ ID NO: 4715 - DNA, 349 bp, Glycine max
tattcccttattcccatgttgttttgatgtatgctttctctctaaacatggtgctgcatcacagaaagcttttattgtttccaccaccaccaccaccactctgtagaagtgcctgtcctgagaaatttaatgaccctctacccccacctgactccccagatgattatttgacccaaagtcccaccaaaaacatcaaaatctccaaatacttgatcataagtttctccattgtagcaaccgctttcattgtcctcagcttctacgccatctacgccaaatttttctctcctcggaacaggtcaatacgaagaacactatcacgcccagaaacagaacaagatttcttgga

SEQ ID NO: 4716 - DNA, 789 bp, Glycine max
ctgaactttgatgtagacaggatcctatccaaggatgtaagtgaaggtcttaatcttctaggtccatttactattttttaacacattaaactaagataatttcatttctcttcaattagattctccaatcacgcataggacatggaattggtgcatatggtcctggtatcaattcctctcacaccttccccaatggaagtttccatggaacattggctggcatgtctagtacatcctcacaattccctcctttgccacaggtaaaaagagttaagatctttgaacatgttactctaatgcgtttaatttctatgcactgtaaatataaaagcttttatactgccaacctatcagaaatcattgttggtatgatatttaaggtactttttgtaaaagtcaactaattgttcatacatgatgatgtgtggttggattattgtgtaaaactctttatactataagtgcatatatgattttctctgctctaatactctttagctctcaattatgaaaaatactgattcttttacatgcagaatgttttggaccatgagttccaaagcttctatggaattggatacgattctaatacagcacttgacaacttgggacccaatggtaataatggacagaattttaaatttggttgcttgcacaattatatcaagtgtctgattcttgtaatttattgttacattgaacagggcggttgaaaacagagttatagtgtgtgcattattacatagccatgttactacagcaacaaagactttggaattttcttgttga

SEQ ID NO: 4717 - DNA, 296 bp, Glycine max
cagtagggaacttggagtgcatggtacaaactttgtgcctagaatagtaagccttagcaccactcagatctactttgcagccctcaacctgacacctaggagcttgcactgagccaccccttcccttctttgaagcagaaaccccacctcttgttttgttgcccccttgagttgttgttgctgctgctgcagcaacactcacttcctcaaagtagattttctggccaaacttcaagccatcaagggactcagtagaagaagagttgggtgatgaggaggaagagggtggtggtgct

SEQ ID NO: 4718 - DNA, 661 bp, Glycine max
ataataatgttccagccgaacctgatggacgcgttggagatgggtcagaacacttccgagagtgaggttcctcgaatcctagaagacgagttcgacagtgccaccaagtccggtagtgaaaaccatgaaggtgcctctggtgaagaccaagaccctcgtcccaacaaaaagaagcgttaccaccgccacacccaacaccagatccaagaaatggaagcgtaagttttcccaaataaaccccaatttcgtgatatttttttgataccagaaatagttctgttcatgtcagataaaaaattcttttttgagtatttaagttcaaacttaaacttttggttaaactggagcaaataaaaaaattggatgaattttgttttgcagttttttcaaggagtgtccgcacccagatgacaagcaaaggaaggaactgagcagggagttagggttagagccattgcaggttaagttttggtttcagaacaagcgtactcagatgaaggtatatttgtatatctttggtgcatatatagtaggttttgcttttctatttttgtgagttgttggtaaagggggtgatggagttttgttgttgcagacacagcacgagcggcatgagaatacaaatctcagaaccgaaaacgagaagcttcgagcagataat

SEQ ID NO: 4719 - DNA, 627 bp, Glycine max
agaaagcagacttatcccttcaaacccaacagcttctctgcctatgcaccaagaaaaccccatgcactatttgtccaatctacctaacaaactcgccatggcagatcagcaatccgtgccaactccatcatatataatcaactcagaaacttctttcaggctggaatctcctattccagaaaatataagatcatttcaactccgaagatttcccgaggttagctcactcacttatgttttggctacatatatgatacacctacttaaaagcctaacaatgttcatttttatattattctttccttataagcagatgtgcagggaagacatattgcagcaccagcatttaaatgcaaaccattaagataccaatccattaggttgttctcaagatggccatttttctttcagtagaaattcaatgtagttcttccattgggatacataacaatctcactctaattgaacctttttccccttaattgtcaaatgaatcaggcacattggctacatcatcactttcctttgatatgcaaacatctgcagttaaggacaacagcactttggaaaatggcatcattggaagtgatcaatcaaaagtgataccaagaaatagtgagcccaaca

SEQ ID NO: 4720 - DNA, 410 bp, Glycine max
gctgggtcggtgatgaaagaagttggtcaacggatggagaagtttgcaagactcatgggcgtgccctttgaattcaacgtcattagtggattaagccaaatcaccaaagaaggcttgggggttcaagaagatgaggctatagctgtgaattgcgttggagcattgagaagagtccaagttgaagagagggaaaacttgattcgtgtgtttaagtctcttggtcctaaagtggtaaccgttgttgaagaagaagctgatttttgcagctcgaggggggatttttttaagtgctttgaagagtgtctcaagttctacacactttacttcgagatgttgaaggagagtttccctccaacgagtaacgagaggttgatgttggagagggagtgttcgaggagcatagttagggt

SEQ ID NO: 4721 - DNA, 416 bp, Glycine max
aaattctttttggatgtacattaagtagtcagattgcaaagaaacaaaaaatgaaattcagtttctagtcttctgacttccattgcttgcgtctcacagtcagattcaaataatgcattcaccacatcatctttttttggtcacattggtcaataaacagtctcaagtacaagaaacatgactaaacattacatgtattcgtatatgaaatcaatatcaaatctcactgtataacatatgcacggagccagagaggtgaggcctgactccttttctcattaatatacataaaattgtgatttgtatagatgtatgaaacaataataggatgattttttgcaatagttcagacttcatatataaggttgagttgataatttgtagcctgaaatgagggcagatactgctagacacaa

SEQ ID NO: 4722 - DNA, 389 bp, Glycine max
  misc_feature (338)..(338): n is a, c, g, or t
  misc_feature (377)..(381): n is a, c, g, or t
  misc_feature (383)..(383): n is a, c, g, or t
ctcgttcatgtgatccttcctttcccactcaactctcaaactgatatctctttctttgaacctcaactgtaatgtggtttgcacaaataggtgttcaaatctacggagatctctgttttgtttaacatgttaatgtatatgcatgctagttattaatggtgcctagctagtaccatgaaggctgaagcaaagtttatatgatttgttgatctagagaacaaatgaaccactctgtacataaatattgtatcatcttccacatggaatcatgaaaaaggatttaggacaaccttgataaatttctctgcaaatacttgcgggaagaaaacaatcttacngtggttttcgtttttaatcctgttgtgataggactcctnnnnncntaattt

SEQ ID NO: 4723 - DNA, 389 bp, Glycine max
caaggaaagcgttctaagcgtagccgcatggagcagcaactgcaacactcttcatgcaccgaggaagagtacctcgctctctgtctcatcatgctcgctcacggcggcgccggcggtgtccccgccgccaagcctgctgtctccgacaacaattccgcgccgctacccgccgccaaactgagctacaaatgttcggtctgcaacaaagccttctcctcttaccaagcactcggtggacacaaggccagccaccggaagctcggcggcgagcaccactcgacctcctccgccgtgacaacgagttcggcgtcgaacggcggtgctaggacccacgagtgctccatctgccaaaagacgttcccaacaggacaggccttgggaggacacaa

SEQ ID NO: 4724 - DNA, 373 bp, Glycine max
cttggcttctgctatgaaactgcgcaggcacgtgatgtgttgtttactttagacatgaaggggaccactcaaagcttgcatgattagaatggagggggatccacatgtgcagcagtggccgcaacatcaaaagagaggagtgtggaagaaacagttgtgtctatctactttaacttgatagataggagttagtggaggggaggtggtagtatatgcaattgttggtgttgatgattctttcacttctttatttgttgtctttgattctttttctactattttgtttcatgtttttcaatgcatatatatgttggaaaacaaacacaagtgtgtagggatggatggcgcatgaaaggaaggtgtcagtgagtcc

SEQ ID NO: 4725 - DNA, 1445 bp, Glycine max
  misc_feature (1381)..(1384): n is a, c, g, or t
  misc_feature (1438)..(1442): n is a, c, g, or t
gagcacatggatcctggcagtggaggaatggtcttagcaacaactctaatctcacctcaaaacaacgtttacggtggacacatgaattgcatgagcgctttgttgatgctgtggctcaacttggtgggccagatcgtgagtatttccccttctattttttgtttttaacaggaatccagaattgattttttcttcttctccctcttgaacataaagcattactttagtcagtaaaatgaaaatgctaggttgtgtacagtgtagtagataataaaataaatgcatctacttctcatcaactttacatgtgttactggagatttgttagttgttaaaattttacattacctgtgaatttctccagttttttactttttgtaacatccctcactctttccctccctctcttccatgtttgtgcatgtgcatcagtaattattttcatggaagatggtatcagatgtgcatgatgacatgacttccagataattcgttgggagatcatatgcaaattttctttgtatgaaattcattagataatgcataagttgatcagatgtctcgttcttaggttggcctgatatgttattgttgaccgaggaatatttcaagtttctatgcatgattttaactttccttataaaagtgttttaaatctctaactatacttgttgctaggtgccacacccaaaggcgtgctcagagttatgggtgtacaaggcttgaccatttaccatgtcaaaagtcatttacaggtaatgtgcacttaaaagagcctctttaaatgatgttcattatcctcattcataaatcctttttcattctacttatctgttgcttacagaaataccgacttgcaaaatatttacctgactcctcatctgatggtatgtctatctgttttttcgttatttaaattgtttgtgtatatgatatttaggacttatttatttgttgtttttagtccattaaacattcattttagcctgatttctcctttagatttatttggtgataacttttaaaaatgttgatagaagggaaaaagcccgacaagaaagaaacaggggatatgctttccaatcttgatggttcatcgtgagtattgctgcctcttttttctttctttcatttggttttttgtattcatgcaagttggtggaggcttatagtaatagaaaaaattgatttgggttaccaaagcacattcagctgggctttaaccatcttcaaagctttaacatcatgtagtcaaatttgcaacattgttaataaacacagaaacttttatctaattcttttgtattcaattcctaataactgttactggaggaaaaatgtaactttttttatcaaaagatcttgaatatttgatgagttnnnntggtatgaatgactaaagttgtgggcttatctgtctgtagtgggatgcagattnnnnnagc

SEQ ID NO: 4726 - DNA, 357 bp, Glycine max
agggttacaagttagagaatatcgcgggttttgtggtgagtaaggaggagcagaaagagaaaaataagcccttcttatttgaccttaacctgccggcgccgctcttctgaagccgccggcggagaatgacggcgccgggggcttagtgtttctatcttaaatgtctttgaatttgtctatatgacttgttttgagggggaattttaggtgctactccgcccttgttttgatgtacagtttagtttattataggttttgagcagcaagcattttggttattacggtggcataggtttaaagttcatttaacgttgtttttgtttgtcgtttgtttcttccttggattctcactgaatc

SEQ ID NO: 4727 - DNA, 433 bp, Glycine max
tcatggtacactctctctaaaaactaagaatcaaacaacacactcaaatattctgtgactgataccggtttcctaatgttgatgcagggggagtgacctttctaggaaagagatccatgtcattttcatcagggattgagcatggagaagaggtcaatgccgaggaagatttgtctgatgatggatcacaagcaggggagaagaagaggaggctcaacatggagcaagtgaagacacttgagaagagctttgagttggggaacaagcttgagccagagaggaaaatgcagcttgcaagagcacttggcttgcagccaagacaaattgctatatggttccagaacagaagggctaggtggaagaccaagcagttggagaaagactatgatgttctcaaaagacagtatgaagctgtcaagtcagataatgatgc

SEQ ID NO: 4728 - DNA, 1225 bp, Glycine max
cgttctctttcacttacctaacttgaaaattgtcgtttatattggccttattccgtgttacaattataggatagaactactgataatattattcaatataagtcatctcttttcttttatgcaattgatttttcagatagggttgcgtgaggagtaatcaagcttctaagttaatggagtgatactaaatcagcttcttccttttgattgaagttcgtttatcatgttaaattttgcttataagtggcatcaaacatatgttattttgttttttaatagtattgtttagaaaacagttatttcctttggacaatcctagagataacagaacataaaccatgtgaaaagttcaatcttgctgtttctgatgttgaggtttcattcaatttccagcaaacccatattccagttttcaaatcaattgccagttttatagagaaccaagtctaaattttcccattttaccttgtctacattgcattgaatctccaatttgagatgtgaattttctttttgcatgatttatagtatatgaactcttcatcaactcaactagtcctcacgaaaaggatgggtatatatgacccattccatcaagtgaacatgtggggggacagctttaaaattgatggaagcttgaactcaattgctccccaaatgttaatgattaagcctagcatgcagaacaaggtaagaatgaaggaatttctcttttgttagtgagttagcattgttttgtgggaaaacttgtttacgaaagtcttttgaattttatttgtccagtctgaatgtactcctcacgaatcaagggaaccttctggagatgatcaagagactaatgaaaaagctgatactaaggtaatcaaatttcatcactacatatttcttttatgtatttcctcatcatctttcacatgcttcactttgatcattgtaaataacttggaaagaaacatgagatttccttcacatatttataccttaataaaaaactgaaattaatgctttggagatctgatatcaaacatgaatgttttttatttgagtctttaacaatgtagttgatgaatatttatttgtaggcactaagacgtcaagctcaaaatcgcgaggctgctcggaaatgtcggctgcggaagaaggttgtaaaaaataaatttataggaagttagccagtgtttataatctgattcttacttatgtaattcataggcttatgttcaac

SEQ ID NO: 4729 - DNA, 368 bp, Glycine max
  misc_feature (293)..(293): n is a, c, g, or t
ctctctcttcctcttggcctttctacgagcgcttggacgctctaatcggccctaattttagcgcgaagaaatcaacctcttcgccgtctccgtcgccgccggtggctcttcctttgctgccgcatcggaagaaccagaaccaaaaccagaacccttcctcttctcctgcgattgcggtgccgccgacggccgtcgctctgccgcagaagcgctcctcggcagcggcgatggacgagggctacttcagaaggaattactccgccgcggctgccgcggcggcggcagcggaggcngatgaggacgatgaggaggaagacgaggaggaggaggaggatgaggaggaggaggaggaggaagaatgtgaagag

SEQ ID NO: 4730 - DNA, 416 bp, Glycine max
aattgctttggaaactctcaactcaccaacaacaaccgccccatctttccccttcgacgacccaactattccatgggccaaaagaaaacgttcaaagcgttgttcacgcgaccacccttcggaggaagagtacctcgctctctgcctcatcatgctcgctcgcggcggcaccacccgccgcgtcagcactccaccgccgcaaccgactccagatccttccaccaagctcagttacaaatgctccgtttgcaacaaaagcttcccctcttaccaagcgctcggtggacacaaggccagtcaccggaaactcgctgcctccggcggcgaagaccaacccaccaccacctcctccgccgccagctccgccaacaccgcctccggaggtaggacccacgagtgctccatctgccacaagt

SEQ ID NO: 4731 - DNA, 361 bp, Glycine max
cccccggcggtcggtgagcgactccgtcactttcctggaggcaccattgctggaccaccatcattgcaaaggtggcagtgttgttggtggtggcggcggcaacaacgagttcgagaggttcgatgatgaacaattcatgtccatgtttagtgatgaagcttcagggaacaataacaataataataccatgatggcacacacgttgtcctcctccaacccttctacaccctctgatcacaacagcatcaatgatgagaaggaaatggaaaataaggaagaggaagagaagaagcaattgaagaatgaatcggaggatgaggataaaagccaatgcaaacaagaaatcacacaacttcccaac

SEQ ID NO: 4732 - DNA, 696 bp, Glycine max
  misc_feature (354)..(356): n is a, c, g, or t
  misc_feature (397)..(398): n is a, c, g, or t
  misc_feature (400)..(407): n is a, c, g, or t
  misc_feature (409)..(414): n is a, c, g, or t
  misc_feature (421)..(427): n is a, c, g, or t
  misc_feature (432)..(432): n is a, c, g, or t
  misc_feature (434)..(440): n is a, c, g, or t
  misc_feature (447)..(447): n is a, c, g, or t
  misc_feature (449)..(456): n is a, c, g, or t
  misc_feature (459)..(463): n is a, c, g, or t
  misc_feature (466)..(471): n is a, c, g, or t
  misc_feature (473)..(474): n is a, c, g, or t
  misc_feature (476)..(482): n is a, c, g, or t
  misc_feature (489)..(495): n is a, c, g, or t
  misc_feature (499)..(502): n is a, c, g, or t
  misc_feature (511)..(518): n is a, c, g, or t
  misc_feature (521)..(527): n is a, c, g, or t
  misc_feature (530)..(538): n is a, c, g, or t
  misc_feature (541)..(543): n is a, c, g, or t
  misc_feature (549)..(555): n is a, c, g, or t
  misc_feature (559)..(562): n is a, c, g, or t
  misc_feature (565)..(580): n is a, c, g, or t
  misc_feature (582)..(582): n is a, c, g, or t
  misc_feature (584)..(595): n is a, c, g, or t
  misc_feature (597)..(602): n is a, c, g, or t
  misc_feature (604)..(612): n is a, c, g, or t
  misc_feature (614)..(615): n is a, c, g, or t
  misc_feature (626)..(626): n is a, c, g, or t
  misc_feature (628)..(635): n is a, c, g, or t
  misc_feature (638)..(639): n is a, c, g, or t
  misc_feature (641)..(646): n is a, c, g, or t
  misc_feature (648)..(651): n is a, c, g, or t
  misc_feature (656)..(658): n is a, c, g, or t
  misc_feature (664)..(668): n is a, c, g, or t
  misc_feature (670)..(671): n is a, c, g, or t
  misc_feature (690)..(692): n is a, c, g, or t
tttctgctgagagcagggaagttgatgtccatctcaaattataactcttagattgattattattaatttttttagtgctagtttctagctgcttcagccttctttgctccaaatagatcttatctttttttctcgccccttcagattatgcgagcttgctttaccaattattggctcgaatagttaaacagtactttccagagtaggagctagacactgaaagattataccatgcttaatgaagattagtgattgttcaaaccaactgctgataggttttatctgtaaattcgagtagtttcttctgttacatactcgtcaatatttttggctggctacgtttgatttcaggannnttgtaatttcccattaggcgtgccagactggttagttaaanngnnnnnnnnannnnnnggttagnnnnnnnctctngnnnnnnnggccacnannnnnnnngannnnnctnnnnnntnngnnnnnnntttttgnnnnnnntgannnnctgggcccnnnnnnnnccnnnnnnnaannnnnnnnnccnnnatcctnnnnnnncctnnnnccnnnnnnnnnnnnnnnnantnnnnnnnnnnnnannnnnntnnnnnnnnntnntttaaaaaccngnnnnnnnnagnnannnnnngnnnntttannntttttnnnnncnnttttttttttttcgaaaannngccc

SEQ ID NO: 4733 - DNA, 405 bp, Glycine max
tcaagagcaattgaattgtccaaggtgcagttcaaccaacacaaagttctgttattacaacaactatagtctcacacagcccagatacatctgcaagacttgtagaaggtattggacagaaggagggtctctcagaaacgttcccgttggaggtggctctaggaagaacaagagggtcacctcatcaaaggttcctcctgacttgaatccaccaagcctctcatcagtctcagctatttcttcccaaaaccctaaaatgcaaggagtccatgaccttaatctagcttttcctacagctatggacaattatcatggcatgtctccatatgttgagatgccaaaacttgaaattggtggtgatcacagtactagtcatagtcaccaccatagcccttctgctgttga

SEQ ID NO: 4734 - DNA, 519 bp, Glycine max
ggaaaagaagttgccgtaggcgactagctggccataatgaacgtcggagaaagcccccaacaagctccctcttaacctctcgctatgccagactttcttcgtctgcttttggttagaaactatcagtaaaatatcagtttcatgtctcttccaattttttcatagggaagcatatttagtttcagcttgtgtcattcctggcatacaaaagtaaaacaaactctaatgtctggcacttttattgacagataatagtggcagaggtagcaactttctgatggaattgacttcatacccaaagcttagtctgagaaattcacttccaactcctagatcatctgagctagctcctggaaatcaaacctccacacttagctggaatggcaactcagagacatcatctgaccttttcttgcaaggttcggtgggtgggacaagcttcgccagcccgggacatcctccaggggaaagttacattggggtcaccgacacgagctgtgctctctctcttctgtcaaa

SEQ ID NO: 4735 - DNA, 395 bp, Glycine max
gcggcctcggccgcgaagtcatcgaaacgttcccgacgttcgtgtactccaccgtgaagagcctcaagatagggcgcgccacgctagaatgcgccgtgtgcctaaacgagttcgaggaggatgaaacgctgcgtttcatccccaactgcagccacgtgttccactccgactgcatcgacgcgtggctcgcaaaccactccacttgccccgtctgtcgcgccaatcttacttccaaacccgatgaccggtgttctgctcctatccaaaacccggatccggagcagcccgttttaacctcatcaacccgacccgaaaccgtgggtgctgatttgcttagtcagaaccgtacaccgccgcgaccatggtcaacgggtcttagtatcgcgagttggttt

SEQ ID NO: 4736 - DNA, 394 bp, Glycine max
ctggtggaatcatgatgcatcagggacacgtgtacggttctgccggcttccatcaagtggctggcggggctataaagggtgggcctgcttatcctgggcctggatccaatgccggtaggcccagataaatgagcctattattattagtagtaagttaaaaagaaaaatgtgatatagtggtgattagactgaactagtttcaacaaggtctaatttgattggtaaagaatgatgcatcacctcttcatctctattcgattcttattgataaaaaaaaaattagagtgaactagtataataattctgagagagttggtttgtattctgatgatgatattattattgttgattgcgatatgtatagtatgacacacttctaggttcaaaggccaac

SEQ ID NO: 4737 - DNA, 344 bp, Glycine max
tcagtttctattccaaagctgcaagtagaatgactattttattttcaacacctttctgatagtaaagaaaaatcatatacatatgtcctcattggtaagatttagtaacaactttgtgttgaacagaaatatagaatacacaagagacaaagtgcacccagggaagaagatcggaaatggcataatcaaagggatgcaatgcaaaggaactattatatgcaaagaccaatcatggcataccctccatatcattcaaatcacaccctttctccagctcctatatatcctatgtggggacaacctggtagtcaaacagctggtgtacagatttggggccatcctgg

SEQ ID NO: 4738 - DNA, 493 bp, Glycine max
ggatgcctcaagttcaatatttcctggtttcagtttagtgcaatggatgagcatgcagcagaataaccagctcactgctgctcaatcaggatgtttcccatcaatgcttccatttaatacccttcagggtaaccttagcactgatgacccttccaagttattgagctttcaagctcctgtcctctctaccccaagtcttcaattaaacaaacctaatctaccaaatcaaatcaaccagttgcaacagtctccagtgtcatggcctcagcagcaacagttgcagcaacaacaacagctgcagcagcagcaacagcaacaacaacagcagcagcagcagctacagcagcaacaacagcagcagctacagtcattgttgcaagtaccaatgaaccatctccagaaggaggacaaagacgaaaaaggtgatttgaatggagtggtcggtagggatgacatttcaaaaaggcttgaggaaatatataagaggcttgaa

SEQ ID NO: 4739 - DNA, 396 bp, Glycine max
atgaatccttgaagggtggcagttctggttctcctcaaggccctctccaattagccacacaatcgggggaagcaacatcccaaacagaaggtgacaacatgatagatgatgatgatgtaaaatcggacttataactggaaaaagtcacattcaaaaaacatggaaaaggtgatgtgtagatattttctcaccatgaatttagcagataaaagtagaggagttttacaactactcaagaacaacacatgatacataaaagaggatggatctttggagagaggctttttgagattttgaagtaaaaattggtttttgcacaataagaagccggagcagttcatttgtccaaaataataatgatcattcatttctttttgccctgagaacactgtaatg

SEQ ID NO: 4740 - DNA, 755 bp, Glycine max
gaaagaagagtacttagaatcgccgccaccatcatcgtcgtcgccaacaacaggagttgatgagtcagcaatggttcctcctccgaggccaatggaggggcttcacgaaatagggccacccccatttctgaccaagacttacgatgcagtggaggaccccaccactagccacatagtttcatggaacagaggaggtgccagctttgtggtttgggatccacacgctttctccagagaccttcttcctagatacttcaagcacaacaatttctcaagcttcgtcaggcaactaaacacttacgtaagtcctctcttcaccaccaccaccttcttcactcgttttgtctctaatccttctagttttatgggaataatgttttgacataacttaaatttggtttcatgggtattttgatacctgttctctgatcagaattgtgttttttttttctcagtaacatttaatgcaaacttttttctctgataaaatttcatttttgattggaaaacaaacaatactaataatacttatggaaatgtttttaagttttgttgtttttgttttgcttgctcatataagtaacaatctcatcttctgtttgaatgagaaataagttctctatctcttttttcctgctagcttttgaaggggaatatagtttcactgttctatcgttttatattttctttactcctagcctcaggggaaagttttcatgttttattactaaaactaattaaaaagttattatatg

SEQ ID NO: 4741 - DNA, 1206 bp, Glycine max
cccggattagagtgaagatcgctgcggagacagatgattcgtccagggtgtcgtggtgtcagggtacggtctcttctgtcgctcttcacggtaatggccaatggcgcggttctctttggcgtatgcttcaggtataatatacatataactccacgtttcttttgtttgtctgttatgtgtatttaaatttgtcaatttagttcaacagccatgtattgtcaaattaactagaaatcatctttggaatgactttttcaatatatggtaatgggtgattggatgacagaggaaagtgcataggctatttttctctataaattttgcttgattggattagttttagtttaataatgagtgagtgcataggctattttctctatgaattttgcttggttgcataagttttattttaatgatgagtgagtcagatttaaagtcagatactggtggtggtgaaataaaacttttgtatgagatcacaccgagtcgttctttcttctttgtttaattcatgagtcatgggtgtgggttagaagaggtaatttatgattagcaaaattttatcaaaccaacgcatactatttttgtttgtaatctgttttcagtttgagtgatatttttaatttaatgtggaaatgaagtctaccaaataaagtcttcatcacaatctttatcagaagatcacttaatgtgttttcttttttgggttactgtgtgtcagtcttgcttatacatgccatgtcaaattctcaacaagttttactgggatgctctctcttcttcatgcatgtctctatctgtgtttgtgtttgcacttttgctagggaaattcttaattagaggatctattgcctgcccttaatttcttttgtttgagtctcagtattatgtcttttgagccaatgttctttttattgaaagaaactttatgtcagaaattgtacttcaagaagttattttctctctcaaatgactgatactggccatttatcacttctgatcttaacatcataggttacatgggatgaacctgaaggtttgcagatagcaaaatgggtcagcccttggcaggtggaacttgtttcaaccacacctgcacttcattcagcattccccccaataaaaaggattaaagctgctcatgattctggggtgtttactaatggagagagagacccctttcctatgacaggatcactaatcgac

SEQ ID NO: 4742 - DNA, 406 bp, Glycine max
gatttgcagaaactgatatatgacatgtgctttacctttgcaaggtgcactaaacctgtatctttagtccctccagtgtactatgctgatctcactgcatatagaggacggttatactatgaagcaatgaatcaaatgcaatctcctggttcagctgtgtcgtcttcatcatcacagattacttctttgtcaatttcttcaacaggctcaagtttaaatgatccggggtattacaagttgcatgctgatgtggaaaatataatgttcttcgtttgaagggcttatatctgcactttctgttgtggcagaagaacttattttgctcctcttctctgctctctttgcattgggacaaactacttttcctgattgaaatagataagtagtttgtgcgtgaatctaatgg

SEQ ID NO: 4743 - DNA, 779 bp, Glycine max
ttttctgtctccattatttatgggtcaatatctgattatgtatattccttgagctaagctaactgcaatcttctatttcattgtttttccttttttctttattatttgcgttaattctcactttttattcattcaaattattgacaaaattttgagcttctcctttaaaatcagtgtactgataacttatttggattttcagttcaatatttgcccaaaatacgatctttaactcattagatagagtacattttcattctcttctgattgttaatgcatacttcttgactctgctccatttttattttttaagcttggtgcagttgagttcctcagaaaaccactatctgaggacaagctcagaaatatctggcagcatgtggttcacaaggtctgttaatattgacgatattacactggcatttactattaacataatatgagcaaaatagtttctcatgtggttgaactcaagcaggcattcaatgccagggcaagcatcctgtctgaatcacttaaacctgtcaaagaatctgtagtgtccatgttgcagctccaaacagacgatgaacaacatgaaagtagagtatccagggatatagagaaagtatcccgctttgttgataatgatcatgagttgtcttctggaaatgataaatatccagctccttcaaccccacaattgagacaagggacgagattgttggatgatggtgattgccaagagcagactaattgctccacaggaaaagaaagtggggaacatgaaggagaatcta

SEQ ID NO: 4744 - DNA, 324 bp, Glycine max
agtggaatcctagggaccaatatcatcatcaggaccaagatcaagatgagtcgtgggaagtcagagccttcgcagaagacaccagtaacatcatgggcaccacctggcctcctaggtcctactcctgcaccttctgtagaaaggagttccgttcagcacaagccctcggcggccacatgaacgttcaccgccgcgaccgcgcccgcctccaccaagcctcagtaccccacaacaacccctctttttctcccacaccctcttttcttaacatctctcatcaggagccttttgttgcaaatgggggtttgtgcctcttgtaccaaa

SEQ ID NO: 4745 - DNA, 380 bp, Glycine max
acacacaacaccaacaccaactattggaacctgaagatgtgtggtgccactgaagtgaattccacaagaaaaggtgttatgaacatggaggatgagggaagcaataagcaaatgatggagagtgaggaaggtgggggtgagtttagggtgtgccaggattgtggcaatagagccaagagagattgcagcttcagaaggtgcaggacttgctgcaagggacgtggctttgattgcagcactcacgtgaagagcacgtgggtccccgcgtctatgagacggggtggtggtggtgatagtagtggtggtgatggcaacagcgatgctggtgcttctaagaggctaagaactatggggtcatcaaagaatgttgctgctagtgc

SEQ ID NO: 4746 - DNA, 420 bp, Glycine max
ggtgataagcaagtccattccggggagatccgggaaatcgtgccgcttacggtggtgcaaccagctctcgccgcaggtggcccatcgccccttctcgcaggaggaggacgaggccatcatcatggcccacgccaagttcggcaacaagtgggccaccatagctcgcctgctcaacggccgcaccgataacgccgtcaaaaaccactggaattccactctcaagagaaaatcctccgccgttagtgacgacgacgtcgtcacgcatcgtcagcctcttaaaagatccaacagcgtcggcccggcccacttgaaccctgccagcccatcagtctccgatttgagcgatccgggccttcccgctctgtcaaacccctcaccttcggcccattacatgcccaatctcatggaaactgcttcttc

SEQ ID NO: 4747 - DNA, 392 bp, Glycine max
  misc_feature (389)..(389): n is a, c, g, or t
taatgtcttatgactccaatgacctcactcttgcattggcaaggcttcaaaagcagtcatgtgggcaattagggtatgatgatcatgatctttcaatgttggggaaccaccacacaaacaccccatgtggtgataatatccttggcatgcatcaccactcatcatcctcatccacaaacccagggttcttggatgccctcagaagtgggttccttggaacacaaagtaataataatatgcatcagaatatgtactatggatatgggaatggggacatgggggaggtggacaatggtggtggggttggggttagtagtagtggagagatgatgatgatgatgatgccttataataatgatcaagaaatgagtattgcatccacacaggtncca

SEQ ID NO: 4748 - DNA, 953 bp, Glycine max
tgtgttttctttttttgtcatgactctttcctattcttccttttgacagtctagtcgttttttcattttcttctagctattaattgctactccttaagtggaattaagacatcaaggctttatttctggcactgaagcctttgtgttaatttgtgtcaactagtgcatcaatataagtgaacttgagcataagagttctaatacatttattctctctctgaccttggctatattcaggtgctattgttgatgagaaacctgtctatcaatttagcaagcccagattttgaggaccatgtaagtattcttgtcaacgatctttgtattactattattatgaacatatataattatgaatgcaccttatttactacttgagctttgcccctctttttaaggcaacatcaaagtttgagtattttttttcaataccttgtctgaggattcttagcttgagatggttcctatatgttccccatctaatcaaaactgtccatctcacatcatgctcctataatgaatgcatggattggaatattcacctcagtagaaacttgaatgactcaagctgacatcaagttggattattaagaacgaaaaatgaactttatttatgtatgcatgttgtgtaattcatgcagagaaggctgcttgcatcatatgaggtggaacctgaggtcgataaatataaatgcagattgaaccatgcttgatgtgcagttgaagtgtgctacttagataggcggaggccgaaaatggctttgtttttcggctactgaatgcagtctggaaaaattttgcatgatgataaaatgccttggcatggcaactggctgaagtaaaaatgctgctgctcatcatcttggctaagcaacacttttaattctcttaattcaatttgattatgtatatagtaaaagaaattaatgtggaaatgtatagggtacatagtt

SEQ ID NO: 4749 - DNA, 652 bp, Glycine max
  misc_feature (549)..(549): n is a, c, g, or t
  misc_feature (618)..(618): n is a, c, g, or t
  misc_feature (620)..(622): n is a, c, g, or t
atcaggatcagtgccttctctgggcacagtaaatcctactggtccaaatgatcaagctgttaatgatgatattttaccaatgcttcatatttttaatgatgacaaatggtttgaggtacgctatatatttcttgtttgtgcattcttttgggaaatgctgtaatgtttgtttttcgttgtgttatgtttcattgcctattatctgtagtctcctcataatttaagtgtcattttaatttttatcatttgattgtgatgcatgggttagtgctagttggatacacgtaattccagtgacttatttatctgaatttaaagccttattatatgcatattgtcttgtaatatgcttgtgtatactcatttcttgacgtatgttgttatgcttgtgggataacaggagatttataatcctggtcaggaaaatattgttgaaggtgcaccaccttcagatgatttttttgcgggcttggaagactactttgctggtttctcctctggccagaatacaggtgatgttgggaactctgatgacttggacttcttagngttgaatgacctagacaccccattattctatccgaccacacaaccttgaagttaataagagtcgcaatnannnggttgttttgttatgacttacgactgacct

SEQ ID NO: 4750 - DNA, 783 bp, Glycine max
  misc_feature (774)..(774): n is a, c, g, or t
cgtcgctctttggatttagagaagaggatcagaatcagatgaagcaacaacattccctgacaccatcttcatcaacaacaccagctgcacccccaccccagaagaaaaagagaaaccaacctggaacaccatgcaagtatcttaattttttattatcagaaattaagatctaatctctaaatcgtttcctatatcaatgatacaatttttttttccttctatagattttatctattttcattccacaatttgcttttggttagctccctacctttcttttttcatttggtatatgtgaattaattctctagggaaccctaatttcaaaacaaattttattaaaatggactgaaattaaatgggtatgtatgcctttggaaatctttgtcttgaagctttctcaatttgatttccagtctttttattttttaattatagcttgtgtagtgaattaattaatttttctaattaataattagtttttgtttggcatttttccatggtaacagatccagatgcggaggtgatagcactatctcccaagaccctaatggcaacaaacaggtttatatgtgaggtgtgcaacaaagggttccaaagagagcaaaacctacagctacacagaagaggacacaacctgccttggaagcttaagcagaagactacaaaagagccaaagagaaaggtttatctgtgtcctgagcccacatgcgttcaccatgacccttcaagggctcttggagacctcacagggattaagaaacactactctcngcaaacacg

SEQ ID NO: 4751 - DNA, 484 bp, Glycine max
cttccgattccacccaactgaagaagagcttcttgatttctaccttaaaaacatggttgttggcaagaaacttcgttacgatgtcattggtttcctcaacatctatcagcatgatccatgggacttgcctggtaatcagttaaaataaactatgtctctgttttatgatctgtgccacttaattgttatgacatgttatataatatatatgttcatagacattaatttgacaatgttatattataggtttggcaaaggttggggaaagagagtggtacttcttcgtgccaagggacaaaaagcacggaagcggaggaaggccaaaccgcacaactgaaaaagggttctggaaagccaccggttcagaccggaaaatagtgaccttatctgatccaaagcgcataattgggttaaggaagacactggttttctatcagggaagagctcctaggggatgcaagaccgattgggtcatgaatgagta

SEQ ID NO: 4752 - DNA, 368 bp, Glycine max
ttaccccctcgtaaagcgcatagacgctctaacagtgacattccgtttgggttttccaccgttttgcaatcctctccgccgcttatccctcttcggaaccccgtttcagcgaaacctgctcagttagtcaaaagagaaacaccgtgggacaggggtgttgagaataataataataataataatgtagaggggtccggggagaagaaatcccctgaaggggaagtggtggatgatcttttctctgcttacatgaatttggatagctttgatgcgttgaactcttctgggacagatgataaaaatggaggcgaaaatcgcgatgatttggatagtagagcgagtgggactaagaccaatggtggtgacag

SEQ ID NO: 4753 - DNA, 485 bp, Glycine max
gggatggtggggtgaggcagggagggaatgagaagagggaagggatgaagaggagtgctgggggtgagattgcgcccaccactaggcactataggagtgtctccatggatagtttcattgggaagttgaatttcgatgaggagtcgcccaagctgcctccttcccccgggcagagaagtgctctgatgtcgcctgctggtggaattgatgggaattcggcggccttcagcttggagtttggaaatggggagttcagtgggcctgaactgaagaaaattatggccaatgaaaagcttgctgagattgccttgatcgatccaaagcgtgccaaaaggtgtgttgatgttgtggcatttgacatactaacatgttgcctgtgaactgattgacttggttttggggtcattttcaggattttggccaaccggcaatcggctgcgcgatccaaagagcggaagatgcggtacatttcggagctagaacac

SEQ ID NO: 4754 - DNA, 361 bp, Glycine max
caaacaacacaccccacaaacatcacagacacagacacacaaaagtcaaaagggtcgcgatggagcaaggagtcgaagaaggaggtggcatgaataagatacctcgggattcaagagtgaaggagataagacaaggtgatgcacaaattcaggttcaggctcctcagcaaccccaaaagtgtcctcgatgcgactctctcaacaccaaattttgctattacaacaactatagcctctcacagcctcgttacttttgcaaaacatgcaggaggtactggactcaaggtggaaccttgaggaacgttcctgttggtggcggttgccgcaaggggaagcgcgccaagagttctaactcatcttc

SEQ ID NO: 4755 - DNA, 355 bp, Glycine max
cagaaaacgagagagaacaagacaagacaattagtgtggagtgtgccatctgcctcggagagtttgaagaaggggagtggctgaaacgtcttccacactgcagccatagtttccatgtttcatgcattggtacgtggtttcagtcgcattcaaattgtcctctttgtagatcttttgtgcatcatcacatcctacagtgttctatagcttctcacacattgctacagcctttgaggagggaggactttgaaagggttcagagataaaagtagctaccctttttgttgtttgcttttagttttgatattttcgtgaggtgaagccttgttggaaaatagaatttggatgcaaagct

SEQ ID NO: 4756 - DNA, 1060 bp, Glycine max
gacgaaaacaatttaaaacaaggcataaaacaagcttcaaagagctatgaatttggtcctttcgctccagcttgcgtgcccaaagttggagcctctcagaataataatatgaagcaggtgcatgactggggcagtcttgcaactgcacatagccctcagtatcaaaatgaaggtaataaataatattaaacctttccacagctcaggcagatagaaaatgtttggcattggttgttaatccatgttttcattttacatatttatgatcgtttggaagtttttaggaatttgttaattatgatttaggtttttaggatgtttttgagataaaaaaggatttagttcttatcatttggacttgtgaatattattgttttagtttcatctcgttgttcacccatctttcacctccatactacacactaacccgcttattccccttcaccttcgttgttattctattttgcataaattgattgtttggaattttcttgataatgcttgaatcatgtgtgtgtaagcactacctgaaattattaactttatgcgtctctttgtgactcatgaattttaaaacctctttattctaagtttctaacaccagaaattattaacttgttctccatcactatcaccatcataactgctcagaacatctcttttaaaaccaccctccagtgactcttgtttactcaaaattgttgcaagcttctccctctctgttgcagcaaggccactgcacggtcaaagcatctagctgtgcctcctttgtgtgattttcaaagctttctgatgcatatatcctctttgagcgagtgagagccaggttgcgtgcatttattgtagtgttttgtgcatacggttttcatactgaatagtaacactgatttttttcatagccgagggataggtcagcttcctccaaccgttatcctacataaaaaaactggttcttagacatatgaaccgtaagaactggcgtcggaggtgctctaagcctcatttaacctctattattcagtctttgggtgctgagaatttaatgaatctgatgtccgtt

SEQ ID NO: 4757 - DNA, 890 bp, Glycine max
ctgtttatgacaggacactcctgaccgttggtacaatgttgctcatgctgttggtggcaaaactccagaggaagtgaaaaggcactacgaactccttgttcaggatgttaagcatattgagtctggacgtgtgccattcccaaattacaagaaaactacttcagggtcaactgatcaggaggaaaaaaggtatcattccctttatacatttgtgtttgtttgatccgtataagaatagaaggcagatattaagaaaagttgataacaacgcaccttacttaaccatctgagttacatctttaatcttatacattaatagtgtcatattcctacatgttgcttttcaaacaatgctgctatctctgcacagaataatctttttttccacaagaaagcagaagtttatgcaatagttaaaattaagcaaatgctaaccaaccagtttccttggagtaatagttaaggaagtagaattaaagagcaagtttttattttttattattaaaatatgtaaaaatacgttctcttatgatttcaaaatatactctcacattatttttaataaaacatttctgcttttaactctttccataccgggcgctcctaactgattagtaagacccttaaaattatgcctaacaactatgcacccgacaaatttatttgatcttcaagactctaatatttgattttctttctttcaggctgaggaatttgaatttgaacctccagtgacccccctcaagaacaacaaattgattttctaattttcatatcaaccaacatcattaatttccagcatccctggtagtactacgtggtgttatgtcacacataattgctagtgcaatagcatcttaggctatattagtcatcataagaatcatatg

SEQ ID NO: 4758 - DNA, 445 bp, Glycine max
ttctgaagcgtcaaacctctctgatagcagaaacgagtccggttccaacagaagctgatgagttaacagtagtggacgaagctgatgaagatggaaactcagtgatcaaagcctctttgtgctgcgaagataggtcagatctgttccctgaactcatcaagaccttgaaagcgttgaggctaagaacgcttaaggctgagataacaacgcttggtgggcgcgtcaagaacgtattgttcatcactggagaagaaacagactcatcaagcagtgaggaccatagccagcaacaacaacagtgctgcattagctcaatacaagaagcgcttaaggctgtgatggagaagagcgttggggatcatcatgagtctgcttctgcgaatattaagaggcaaaggaccaatataatatcaatgtcctaggaacggatcgaggtctttataaa

SEQ ID NO: 4759 - DNA, 407 bp, Glycine max
  misc_feature (399)..(399): n is a, c, g, or t
gtgagtttcaagatgatgaaagtgttaggctcttacctaaatgcagccacgcttttcatcttccttgcattgacacatggctcaagtctcactctagttgccctctatgtcgtgctagcatattcaccttcaatgctgcagcacttcatgttgcttcccctgtcacggaaccaccttcaaggaacgatacttcttcaggtaaccaacgtgcagatgaaaacattgttgctgttgcaagggacagtgaattagatgctgtggaaggagaagtcacactcacacatggtggagctgtttcaaagagtgcattgcgtgctttgagtgatctaggcaatttgagaggaaggcatagtgtaattgagattagagatgaagggtatgattccattaaaaggacgngaaggacg

SEQ ID NO: 4760 - DNA, 406 bp, Glycine max
actgcttccgccgctgcctcagccgccacaggcccctcacgtgggggttgaatccgagcaaatccggtccggtctgatggcggatcgggccaagattccggcaccggaaggagttctgaagtgtcctcggtgtgaatccaccaacacaaagttttgctacttcaacaattacagcctctctcagccaaggcacttctgcaagacatgtaggcgttattggacaagaggtggtgctctcaggaacgttcctgttggtggaggatgccgtaggaacaaaaagaacaaaaggtctcgctccaaatctccggtttctactgagaaaccatcacttcccaataatacaagtgcaatccctgagcttattggtcgtttcccacaacctttcatggcctctcttcagagtatg

SEQ ID NO: 4761 - DNA, 729 bp, Glycine max
aggtattttttcctctttgtatgtttagtaattcttctttaagagatttattatcattagttgattacttggatgttttgttagtgataatttgtgataacatataagaaactcttttagtttttctcatgaaaattgttatgtggttttttcaaccaagcaataaatttatgagaagtcttaatttaataacactcagtttggatataggattagattaaatgcattggtcttttttttttctatgtatgatttgcctctaatgttgttaattaagtgtcagacaaagtgctcaatttttttcttaaaatttgtttgttggttatgagtttagtttgtctgactatctcttcatatgcttttccagcacccgctataaacggaagttcattagagagtgtaagtatgggattgcagagatatcatgatccagttggaaatcgaaatggccttaggtttccttatcatgttcctgtcaaccaacaacaccatagttatcatcactcaacactgcccatgcaaggagtaagagatcatagtctcaacttccaccctacagtaactacaaattcatttagggttccaacaaatcctttgcgtaatgttgcaatcccaacacaagctagttttgagatgggtcctagacatgttggccctgcaccatcatctagcctccgaatttaccgacctcatagaggggttgtgcctgagacaactctcagacatcga

SEQ ID NO: 4762 - DNA, 350 bp, Glycine max
agcggtaacaacaacaacacccaattaccgtcttcgtcacagtcacacaaagaagcgtcaccgccgctgaaactatcacacaggtgcaccgtttgcaacaaggcttttccttcttaccaagcactcggtggacacaaggccagccaccgcaaggcctcgtcggaatccaacaccaccgcctccgccgtcgccgtctctgccacagccaacgacagcgtttccgcttcgaccgtcggcggcggaaggatgcacgagtgttccatctgtcacaagagtttccctaccggtcaggccctgggtggccacaagcgctgtcactacgacggcggaaacaaccacagtaacagcaa

SEQ ID NO: 4763 - DNA, 375 bp, Glycine max
tcttctctatgataactctgctggagagactccgccaagtccaagcacaccattgcagaattcacgggagaagaaacaactatctgttaaggaagaagaagaggaagaaaaggaggcaaaagcagatactttattggatctaaatgcccctggtggtgattctgctattgggtgcagtccagtgctgaatctgatcacgtgtttggacacagatttgtcaagcaccacatcagaaaaccaacatggctcagagccacgagtgttctcttgcaactattgtcagagaaagttctacagttcacaagctcttgggggacaccaaaacgcccacaagagagaaaggtcaattgcaaagagaggtcatcaaagatcaat

SEQ ID NO: 4764 - DNA, 371 bp, Glycine max
gatttttctgaatttgctgctgatgttgaaggccggcttgacaaagaagacgatgaaataagtgcgtatgtgggaggaggagagggagttcaaggtgtattggccaaggttaagggcgaagaagaaattgatggtgatgtagcgtgttatctggagtcagtttttgacatgatcagtgatgatgcctttcattggaataatattgagtctgtggtgtcagatgcccgggaagagaaggggtgtgtggtgccatgtgatggtggggttagtgaacaaggaggaataaagagagacatatttttgagactaaactatgatgaggttattactgcttggtctagccaaggttctttcccatggacaactttaat

SEQ ID NO: 4765 - DNA, 369 bp, Glycine max
agctgcaatgctaaggctaccatgttactgttgtgcccagggttgcaagaacaacatcaatcacccaagagcaaagcccttgaaggatttcagaaccctccaaacccactacaaaagaaagcacggtgcaaaaccatttatgtgccgaaagtgttcgaaatcctttgcagttaaaggggattggaggactcacgagaagaactgtggaaagttttggtactgcacttgtggttcagattttaagcacaaaaggtcccttaaagatcatattagatcctttggaaaaggtcactctccacatccttctcttgaaggcttcgtcgaggatgagaaggaatgtgttacaggttctgatgatgaagatgaagt

SEQ ID NO: 4766 - DNA, 310 bp, Glycine max
attccccgtctttgtaatgcaatgtaatgtttaattttcttgcgataacacgggattttaatttcagtaatttcatctcctgagggcaagaggagcatgatgaaacttgctcaaaggatggtcaccgatttttgtgccagcattagcacatcaagtggccatcgatggaccacgctctctgggttgaatgaaatcgtagtaagagtcactgtccacaaaagctcagatcctggacaacctaatggtgtggtgctaagtgcagccactaccatttggctccccacccctccacacactgtctttaatttca

SEQ ID NO: 4767 - DNA, 876 bp, Glycine max
  misc_feature (19)..(19): n is a, c, g, or t
  misc_feature (823)..(825): n is a, c, g, or t
  misc_feature (862)..(864): n is a, c, g, or t
cggcattaatgaactaccncatcaaatggattcggttgccactcctgaaaactcatcaatatcaatggaagatgatgattttgatcatactaaatcaggaggagatgagtttgataatgatgaacctgatgccaaaagatggtgagcttaattttattttttacgttatagtcccttcaataaagtgtattttaatcaatctttttttcattaatattattgcaggagaatagaaggtgaaaatgagggtatgccagctatagaaagtagaacagtgagagaacccagagttgtgtttcagacaaccagtgacatcgatattctagatgatggatacaggtggaggaaatacgggcagaaagtggtcaagggaaatccaaatccaaggtaaaaaaaaagaagcactttttaatctctttctttaattgataaaagtaattatccaacttttataaagttgttctactttaaaacttttattaagaatcccatcagtccttaattctaattctagtagaaagaaataaacgatcattacactctccttgacttgactagctattcaaatgtggtaaacacacgtcataaatgcatgatacgtgccatcaaaatatctaaccatatatcgtattaggttcgttagcaatagtggctctttcttggaatatattctaaagcatgcatgcacctgtaattgccttgcttttgcattgtcttaaactcctttctttggtcaaatttggcaaccatggtttcactcacgtgtgcatgtgggaatcgaattaattaatcttttgtaccatgtgatgtctattcacatatnnncctttcttactaatttgtctttaattaatttgtgacnnnaatatataggag

SEQ ID NO: 4768 - DNA, 402 bp, Glycine max
aagcttcatccaccgcatcagccgctgccgcagccgccgccgcggatcgcaagcagaaggccagcgtgttctcccgcataagcttccccgctgaagaggaacttcctaagaagagaaaagtcaccgcttcttccacaacagaacctgccgctgccgctgccgctgccgccgccgctcccactgcctcttcggcacacctgaagacaatgtcgaacgggtactacgaagggaggaagagcagcagcgccgtcgcggactacgaatctagcgacgacgagcggcacttcaaacggaggccgtcgaggtacgagccgtcgcccccgccgcagccggcggagtgggaggaggaagggaggcattcgagaggaacgagggagcggaagcataggtgacttgcaattt

SEQ ID NO: 4769 - DNA, 239 bp, Glycine max
agtaggtcaaaaatttgctcaacaaggtaaaacatttattagttagctagcagtatggggagagcaccttgttgtgacaagaatggcctcaagaaaggaccatggacaaccgaggaggaccagaaactcattgattacattcagaaacatggatatggcaattggaggacactcccaaagaatgctggtatgtcaccaaattaaactaaacttaacaaaatggctctcttttttttttt

SEQ ID NO: 4770 - DNA, 397 bp, Glycine max
taatgtttcctctcaggtgcccctcaatagagggcatgcccttcttcctcctaggaagggacacaggcgctctagtagtgattcccctttgggaatctctggttttatgcagtcttctccagttccctccggaggagagagctcggggttcgagaagccgattcagttggtcttgaaggcgtcctttagggacagcctggatgggggccatgctaatgagcctgttaatgggaggaaggaggaggctgcggatgatttgttcagggaatacatgaatttggacaactttgataatctgaactttcctggcatggaagataaggacttggatagcaggaccagtggttccaagacagttgagagcagcgataatgaagttgagagtcatgtcaatggg

SEQ ID NO: 4771 - DNA, 779 bp, Glycine max
tctctcttcgacaccatcccactcctatttcccaaaaccacatgcaaccaaaaacaaatacaaatcagttagatttgagtcttcaaataatcaatgatcaaacatacatatacataagtactaagtaagggtttcgtttaacttatttttaaccgttctaataagtttttttattggtataatttcttatttttatggatttcataaaagagattttaaaaaagtaaataattattttcttaaatcaatctcaagattagtatctgattatcggccgaaaggatcatcagtccgtgactctcaacctgaaaatactttgaattcaaaacaaaacaaaaaataccaagccttgttatgcaaccatgtgggtgggtgtgttaatttggtgtgtgtgcgcgagagagtgtgtgtattacatgagtagttggctccatgactcaggtagctcttgattgttgtcatgccaagaaggaagaggaagagaagaagtgggggtataataaggagttagaaagttggaaggagtggagaagaaaggaggagaagcttgtggaggaggaggaggagggcgcatggtgttgatgttccaccaattgttagggttcccggccatcatttgtttcaccggtgagctttgcaaaacacctctattcatgcctttcttaatttctacgatctcgatctacaaaagagaaagaaagtctctcctttctttttttgatgttgttccaacccaagcctaaacagggtcttgtagagactttgagagaggtccactc

SEQ ID NO: 4772 - DNA, 411 bp, Glycine max
ctcctctctcccatctccattcttccctcccctcctgaatactccatcatgtccccgctccctccagtcacgacctgcggcccttccaccacagggcacgtgaccttgcggtggaagttgcgatggcaaccgcaggccatgcactggagagaaggggacgagacgctatccgcgtcgagggtgaactccccgcagccatccgtggcatagctgcctaggctggctgcatggttgcggaggcactctcggtagagatagtttgaagatgatgagttctccatctttctttctttcttgcttgtgtggtttttgtgtgactttgagagagggtgtagtgtaggttttaatatatatatttatttggtgtatgtattgtgtggacattgatatggagagtgacgagaataggca

SEQ ID NO: 4773 - DNA, 373 bp, Glycine max
gggaagagtgtcatgagtccaattctagaagttcctccagagtattttccttccttcccagagggtttgaccaaggagaagaaagactttcaagatttttctgctcttggaactgaaggcatgataaagctagaagatatatgggactctggcctcaatgttagtggtgctgctttaagcagtgggaatgagctgtggggcaatcatgtcaactatgaagagtttccacaatttggagtcacaagtggtatgtctgactcagatatctgggatattggcttaggaagttttggaattgatacgtggccaactgatgaaccttctcttggtgaaacagatggtcaatctggtcagccaaatgaagataggtcta

SEQ ID NO: 4774 - DNA, 377 bp, Glycine max
cggacactgctagtgaaggcagaagaagaagattcctggattgattgtgaagatggctgagtcggacaacgactcgggaggggcgcagaacgcgggaaacagtggaaacttgagcgagttgtcgcctcgggaacaggaccggtttctccccatagcgaacgtgagcaggatcatgaagaaggccttgccggcgaacgcgaagatctcgaaggacgcgaaggagacggtgcaggaatgcgtgtcggagttcatcagcttcataacgggtgaggcgtcggacaagtgccagagggagaagcgcaagaccatcaacggcgacgatcttctctgggccatgacaaccctgggattcgaagagtacgtggagcctctgaaga

SEQ ID NO: 4775 - DNA, 670 bp, Glycine max
  misc_feature (617)..(617): n is a, c, g, or t
  misc_feature (620)..(620): n is a, c, g, or t
acagttcttcacaactactccagctttctaaaatctttgcaattctttccccaattcctaattaatccttcaaactagaaagataacaccaacagaattccattagatctcgaaccagccacacatgaagtctctatatatcaccccaaggttttaaataaccacatatatatatatatatataatatcaattgtgagtgcaacaataaagttgtgatcacaaaattcttcacaacaatgacggcatcagcaatttaaaaccttggtatgaattcagtaaggtggccttccatggccatgagcccaagcaaaagcctcatgccccacttggcctccattgggaagaagatttggtgggagattatacaaaggcaaagaagaaggaccaggaatcccacctgataagtggccaccaccactaccgccaccgccgccgctactaccaattccatgaggagatcctcctagggtactccctccttgcacgctaccaccaccgtcgtcttcctcctcctcaaggggcaacctctcataggtagcattagcaaaagtggcagcaatcaccatgactggtccagctgccacaagggagcccacgacgctccctcccactaccnggncctgccctccagcgagatacacagtaagtcctgtagctcctggcggggca

SEQ ID NO: 4776 - DNA, 681 bp, Glycine max
gtgatgtcagctgagtttcaggttccttcaccccttgttcctactcgtgacaactatttcatcaggttctgtaagaagcaccaaggacaatcgtgggcggtggttgatttttcaatggatcatctgcgacctggtgcaatcacaaaaattcgaagacgaccctctggttgcataattcaagaattgccaaatggttactcaaaggtcatatttcaattatcaacttcattctacaatgggtacataattaattacttcccgattgagaaaactttattttaaccattaattaatcaattgttttcttcaggtcatatgggttgaacatgtagaggtggacgacagcgaggtgcataatctttacaaaaatttggttgattctacccttgcgtttggagctaaacgttgggttgcagcaattgataggacatgcgaacgtcttgctagtgcaatggccaccaacataccccaaggggcactttgtggtatatatgtgacatctcatcatcttgcttcaatttttattttttgttatcatttcatttttaattaagattgtgttaattaaaatgacttaattaatcagtgtgactttgaatgcttatatgtatgtatgtatgcagtgataacaagtcacgagagtcggaaaagcatgatgaagctggctgaaagaatggtatt

SEQ ID NO: 4777 - DNA, 459 bp, Glycine max
taaaagatcttcagaaagaattcaaggtattcaatgggagaagtttattagatccccaaaccatgcaattaatgactttttcatgcatgcattaacgttttttttaatacctttatgcagactctgaacgataaacgggctaaatgcaaatgtataaacatgcagaagtcagaagcagatcaagttgcttgagtttcttttgtacaggtaataaaaaggaactacgccaaacatgaataggacccgggttttatattttgacgtgctgaaaaatcaatagaacaaagctaatatgcagaatgccagcttttaactcttcatgccacattgtgtattttgagttaacgggagttccagccacacagacaataaatcataattttgtatacaaaaattctaatgaattaattttagcttatttttccccgtgctcctaaacttatcaaagacttcccagag

SEQ ID NO: 4778 - DNA, 402 bp, Glycine max
gaagaagcacttcatcagatcaacatagtggctattgtgatgacaatattcagaatgttgtcaagtatgaagtggacatggcaatggtgcactcagcccaaggttttgcatggagtaatgctctaagtgtgaagcttcaaagagatagagtcaatgtagattgtgacaccactagctttggtgaaggttcatcatcatcaagggtttgtggccaaaattgtgaaatggtgccgttggataatttcccttcaaaccctagtttgaaatctaataacaagtgcaaggaaatgcctgaaatgaaaaggggtttgagagaagatgatgatggtgatgatgaagatgaagatgaagtcatcaatggtcaattgaagagcctaagaaggttgatgccgggtggagaag

SEQ ID NO: 4779 - DNA, 253 bp, Glycine max
  misc_feature (194)..(194): n is a, c, g, or t
  misc_feature (232)..(232): n is a, c, g, or t
  misc_feature (238)..(239): n is a, c, g, or t
  misc_feature (243)..(244): n is a, c, g, or t
actcaaaaggcagcaaacacatggggaaatgactttcgaggatttcctagtaaaagctgtggtggtacatgaatcatcatcactattcaagtcttcattattatattagaatcagattggtaacattgcaagtaatggaacattgagtgcaagttataggttcagccgtttaagcatgtaatagggacaggatntagtgtgtcttgtaatgggcttgaaacacaaacatgtnggcacnnaatnncaaatggaa

SEQ ID NO: 4780 - DNA, 372 bp, Glycine max
tattttgcttcatttggtggggggcaacaattctatcccaacaatcaggctatgcacactcttttagctgcacaaaagtttcaacaactccaaattcattcccaaaagcagcatcaacttcagcagcaacagcaatttcagcaacaacagcaatttcagcagctgcaacagctgcaactgcagcagcaacaacaactgcaactgcagcagcagcaacaacagcagcagcagcagcaacaacagcagcagcagcagcagcagcagcagcagcagcaactgcaactgcagcagcagcagcagcaacaggaacagtaatatcaacaaatgggggacatgaatagggaggggacacacctcatcaaatgtactaaa

SEQ ID NO: 4781 - DNA, 371 bp, Glycine max
gggttcgatcgctatctaacaggttttgaccaatgcagctgtaatctagtgcactgcacacttggcttgttactttataacgaaagtaattaaggataaaaatctatagacttaaagcatgtttagtgcagtttatatttagagaataatcgcttatttttttaaaatatttctactttaatttaaattacatcacatgcacgttaaattttttacatcttcaatttgagggagtaccccataatcatcacttcggctgatggttcactgggttggggttgggactgcctttgttgcagactgttagggtcaagtgtatcatatctatttttgatagcacatggaggtttgagtgctgccctttcttctta

SEQ ID NO: 4782 - DNA, 750 bp, Glycine max
  misc_feature (56)..(58): n is a, c, g, or t
  misc_feature (495)..(495): n is a, c, g, or t
  misc_feature (497)..(499): n is a, c, g, or t
  misc_feature (519)..(520): n is a, c, g, or t
  misc_feature (528)..(529): n is a, c, g, or t
  misc_feature (557)..(557): n is a, c, g, or t
  misc_feature (570)..(575): n is a, c, g, or t
  misc_feature (577)..(587): n is a, c, g, or t
  misc_feature (596)..(597): n is a, c, g, or t
  misc_feature (599)..(605): n is a, c, g, or t
  misc_feature (610)..(617): n is a, c, g, or t
  misc_feature (621)..(627): n is a, c, g, or t
  misc_feature (629)..(634): n is a, c, g, or t
  misc_feature (636)..(636): n is a, c, g, or t
  misc_feature (640)..(641): n is a, c, g, or t
  misc_feature (643)..(655): n is a, c, g, or t
  misc_feature (657)..(672): n is a, c, g, or t
  misc_feature (675)..(679): n is a, c, g, or t
  misc_feature (681)..(693): n is a, c, g, or t
  misc_feature (695)..(711): n is a, c, g, or t
  misc_feature (713)..(717): n is a, c, g, or t
  misc_feature (719)..(731): n is a, c, g, or t
  misc_feature (733)..(734): n is a, c, g, or t
  misc_feature (737)..(739): n is a, c, g, or t
  misc_feature (742)..(744): n is a, c, g, or t
  misc_feature (746)..(747): n is a, c, g, or t
caagatgatgcaatggaccctgagattgtctcaagattgcagagctttaacgctannngcaaactccgtgcagctgcaattgctagtgtttggagcaccgcaatctttctcagaactaaaaaactgaaatccttggtgggaacacatgatctcacagaagaggaaattgaaaatctcaggatgagttttaagaagatgtaagtattcatgagtcaagatcaaaatacagaattgatcaaactactaaggccttatttggataaacttctctataaacacttgtaggaaaagaaaataagaaggtaaaatacattaagcttctccataagataaaattaacttatgtaccttagccttaagagaatttatattaaaagagcttctctaaaaattaagtgcataagttgattttaacttgtgcaagaaggttaattcattttagcttcctaatttctttttgtttatacagaagtttatccaaacagggattatatntnnnttttagttgggatcctccannattctttnnaaagtaaaactaataaagtcgctttagntctcagttgaatnnnnnnannnnnnnnnnncaactccanntnnnnnnntgacnnnnnnnnaaannnnnnnannnnnnantttnnannnnnnnnnnnnntnnnnnnnnnnnnnnnnatnnnnntnnnnnnnnnnnnntnnnnnnnnnnnnnnnnnannnnnannnnnnnnnnnnncnnctnnntannncnnaaa

SEQ ID NO: 4783 - DNA, 233 bp, Glycine max
cagcgccgcaacacgttcgtgttgttcaacaccaacgacccttcctccctcctgtttccacctcccaccatttttttccttcctcagatcaaacactctcctcaacgcttccacgcgattcccctaataatacctgtaactttttttctccgaaattcgaattctaacgctcgacctcgccgtttatcgatttaaatagaaacagaaacttaatcaaaacaaacaaaaaaaaa

SEQ ID NO: 4784 - DNA, 200 bp, Glycine max
ctgagggtccttcttctgcagcggataatgactctgctgctatcagcttgaatggaatttggctgtccctttcagtggctactattgctgcagtgttttccttgtgacaatgatacgagttattggtacatcaagtgtgctacttggggttcgatgttcttgtgctttgttaaaattttctacatgctttgttttgggaa

SEQ ID NO: 4785 - DNA, 730 bp, Glycine max
tgcccgtggcaccttcgctcgctatcatctccaattctcgcctctccaagacactctccgttcccgttctcaacaacccaaaggtaacgacgcataattagggtttcacgtttcgcacagtaaaacatgtactgaaggtgtatgattgattgctatgcgtgcagtttcaagggttaagcatcaagtgcgttcgtgttggaggtgtggagattccgaacaacaagcgaatcgagtactcgctgcagtacattcatggagttggcaggaccagagcaaaacagattctgtgtgatatccaaatggataacaaaatcacgaaggaactcactgaggaggagctcatcactctcagggacgaagtctccaaatatatgattgaaggcgacctggtaaaattacggttttaaccctttcgtttttttataggaaaatgttaattgtttgttagaaattagtgttgttaggttttatttgcaaatgttagttgttagtaattagtattgttagttgttatttattttttgaaattatggttttaacctctgtccccttctcttcttccttcaccactaaactaaccttatatttcctcgattttttctttttctgtgagtgagtctctttgtgaattctaactaactgtggaattgaatctcattgggggattcagagacggttcaatgcggttaatataaagagactgaaggacattcagtgctacagaggaata

SEQ ID NO: 4786 - DNA, 1040 bp, Glycine max
  misc_feature (969)..(971): n is a, c, g, or t
  misc_feature (1020)..(1021): n is a, c, g, or t
tgctggaagaaggttcctttgactctgcttttgagggttgtgatggtgtctttcatactgcttcacccgttcatttcattgttactgatccacaggttcatttcattctacattttttcatgtatttcataagtaaaggttgataaaaaattgtttctgttaataattaaatttcagtactaacctaacaattcaaccttaacttcaatatattaatcatttgtactcaatctcttattacatgcagaatgtgttatgttttagttagcatttcttttttaagttgaaagtgtttgagatcccatatctactatagatatggtcaaactagtgtatataaatgaaagacaactcaacttcttataagttagttgtattagttgagttagacccaaacaaaatttataaggcaagtttattttattaattgatttcaaaatagatcagttttcttgttgattgcttttaaatttttgttttccttattttttcagaatcagttaattgatccagcgattaaaggaacccttaacgttgttaaatcatgtgccaaatcgccatctgtgaaacaagttattttaacttcttctgttgctgccgttttatataatggaaggcctcgtacccccgaggttgtagttgacgagacttggttttcggatccagacttcttaagggaaaatgaggtatgtgtcatttttttttgtcttaatcttcctgtttaccaggaagaatgaatctgattaatttgaaataatgctacatgattaatcttcctgattaattattcaattttaacttcagtatccaattacctgattggtatgtcatcttctttctgaataattgcaattgagaaataatgccaatgcattaattccattgtgcacaaaagtaataattgttcatgtgtagtagtagtagtagtatgttaatatgtttctaccattttctatatttttttttcannngagtggtatgcatttgcaaagacttcggcagaggatgctgccaggaaanntaagcgaatacgacataag

SEQ ID NO: 4787 - DNA, 463 bp, Glycine max
ggtgactatacggcttgttatttactaccttcaatcatgcaatagttaataatgacttgatggtggatgcatgtatatgcaggaatgggcgaagcaggattcaacgcagattgctactgagttgtgtggttttgtgacaatattatctgggaccttcctccttcacagaactaaggatatgggaaataaaccctccgacgcctccgttcattcaagtcctgaagataacaatagtaatactaagacacctctaagcaaccaaatttgaatctatatagcttctctccacaagcattattttgcttcttaacaagcatgtaatttcacacattttttttataaaaaaatcaaagatatgcgatgaaaatatggaagattaaaggaaacatgcctatatatatgtggttttgcccaataactgcgtactcccccatgcccctgcacaaatcacagttgcatatca

SEQ ID NO: 4788 - DNA, 420 bp, Glycine max
tttcttcagtgccacaagaagcattttcacttgtttcttgtggatcagttccttcttgttgttgaccattctctaaaagcatttgaagccacttctcgacattcccttttccacgttgctttctggtttcttcatcttcctcaatttctgtcttatgaagacctgagaatgaaatgccataactcctcttgccttcgctgattttgagcttctgaagtctttgctcaattgagttttcttcatccaatgcaacacttgatctggtatgctcctcaagcttctcttctgggtcattattagctggcattttcagcttctctactttttcttcctgcttttgctctactttttcttcccgcttttgctctactttttcttcccgcttttgctcttcgtttgcagataagtcaaaaaaaaaaa

SEQ ID NO: 4789 - DNA, 320 bp, Glycine max
gatttcttcgacagatcttagcagtgcctgaagctgctgctttcagaggagctgctgggttaatgcctctgggcttgaatttggagcaagctggctttctaagacaccaacaccaaattaacgttgacgacgttgttcatgttaatgttgatgatgccaccattcaccaccatcacctcactctccacaataacaccacctcctcatcaccttcttccactgcaccaatcaccgtatgtacatatattatgcttccttctctttaatcatattaccatgcagatcagtgtgaggacaagaaatacaaccctatttgtttg

SEQ ID NO: 4790 - DNA, 329 bp, Glycine max
actgcagaaaacaggattgggatgatgccgtcgtcctccgcttcttttcctccgccacctcctaccgcccatgccagtaacccagccatgccttactctctctctctctctctctctctctctcttcttttctttgtttctctgtctctctctgtctctctctgtgtcttcactcgccttccattttttccgttttgcgatggctgaacattccgtgttgtggttggaaattggggtggtttggttagttgctcctgattcaactgccttaccaaaaaagagaaaatcaataaattaaactaacccaaacaaaccaaggtgctatcaca

SEQ ID NO: 4791 - DNA, 407 bp, Glycine max
aatctacgtggtcaccgactctggcgacgacgacgcggtgaaccctaggccaggaaccctaaggtacgcagccatacaagacgagccattgtggatcatgttcaagagggacatggtaatcacgctaaaagaagagcttttggtgaattcgttcaagacaattgatggaaggggtgctagtgttcacattgctggtgggggatgcattaccatacactatgttagtaacattattattcatggtattcacattcatgattgcaagcccacggggaataccaatattagagactctccacatcactctgggttttggactcaatcagacggtgatggtgtgtccatctttaattcgaagcatatttgggttgatcattgctctttgtctaattgtcgtgatggtctca

SEQ ID NO: 4792 - DNA, 832 bp, Glycine max
gtggtgtattctggagctaggtagccctttgctgcactaccctttagtgcagagaagacgatgtcattggtgagaagcttgtacaagccagaatctgaaagcaatgggttgtatcgctgatcaatgagcactttctcagctgagatgttttggtgaacaagagcttgtttctttgctttgtatgcatgtaaatatgctatacctggttaagaaaacaaggtttcagtatgcacatgaagattggaaaccatgagaatatgaattcaaatgaatgcaaattgatcacagcaatgttgaaggaaatttaatctacaattaggcaagaggtttgtcattaagccagcaataaaaaaaaagaaaccaagaatatgtttatctatagatagaaatagaataaaatataatgtgtaacaaaaataatataatatatagtatactatgtaagtggtgttggcatctcttgaagcatccatgagtaacagtgagaaaagagatgctctcagttattcaccaaccactgccttttcttagcaatagcatgctgttggtgtatactttatatctcagaatatttaaaagatgctgattgctgaagtatcaaaccatcagaaagtaaatcattttaataaagggtatgatagaagagtaacctttagcaatccctttcacaatagaaactctagttgaccattcaaggacttctccatcaccttccttcacgtcaaggtagcatgacagatttccattagaaacaaaatcgtaaaccaggaagcattcacctcgtccccttgaacaacagaatcctctcagcctcactaaattctcattcctc

SEQ ID NO: 4793 - DNA, 379 bp, Glycine max
gcattaaaaaaaaacctaaaaacatatctcaaagtaatttacagacatgggctacaaaatattgaaatgtctgagcccgggttcgaaccggggacctctagtgtgtgagactagcgtgataaccaactacaccacccagacgagaatgtcaccttttggattgtctttaaatcaatagtttaaacctggagtgtatctttgaagacaaagaagattttattttaagacaattatgctgctgattaaatgttgatgacagttatcctggggaataatacattggtttgatgaaccaccttatgaatgtaaacatttgttgtggggtgattttgctggagcaacattcccacgtataattacaatataaggcattggcctc

SEQ ID NO: 4794 - DNA, 550 bp, Glycine max
tggaggtttattatctggatggcaaggtcaaagagcctttgacagtgctcatgaccccaaaattgctatttttcttgaagagttaaaatctggcaaaggtcgcagatttgagctatccgatattattggacatatagttgaatttaggcaagtactattttcggtggtctttttacctatcactttatcaattccttggctttggaaattaagttcattttttttattaactccagcactgatcagcatgggagccgttttatacagcagaagttggaaagctgtggcgttgaagagaaggaattagtattcaaagaggttcttccacatacttcaaaattaatgactgatgtatttggcaactatgtaatccaaaaggtatgttttgaagtgatgtacattgtcattaactaactttatgattgtctggaatctgttatgctcaatttgtctgtttctcttgtgcatagttttttgagtatggaagccctgagcagagaaaggaacttgcaaatcgacttcttggccagatactgcctttaagtctgca

SEQ ID NO: 4795 - DNA, 439 bp, Glycine max
  misc_feature (405)..(405): n is a, c, g, or t
ctaaattgatcatggttccctgggtactgaagtatctaataatttatttgaacttagcaaattcagttcatcaagaggtggtaaaattgccaatttgctggaataatgactagataacatgtgtgtctattcatttttgtgtttgtacaggcctctgtctgttgatgtcttttctgcttgtctcaccatcattttatgaaaaataataaacatgcatgatatgtagttatattttgccatttctaattgtattaatgtctgacagaagaaactacacaacatgaaaaggatgctgaaattttccaaactgctcatgaaggtaaagagcaaggtgattttgttgattatggatgggtcaacataggaagttttgatgaccttgatcaaatttttatgtaatgtagnttatctctatcgcattatacaatgcatgtgtatc

SEQ ID NO: 4796 - DNA, 476 bp, Glycine max
ccgaccttaccctcatcttcattctcttcatattgtgcttcagtttctgtttccatttccgccacaaaatcttccctatcccgaaccttaccctcctctttattctcttcacactgaacttctgtttctgtttctgtttccaccacgagttcttcactatcatcttgaaacttaccctcctcatctttattctcttgagattgtgcttctgtcactgtttttctttctctttcttccacgagttcttcatcatcccgaacctttccctccttttctttattctcttctggttctgtctcagtttcttccctaccatgaacctgattcacacgtgcctctccctcctcatctttattatctttagactgtgcttgtgttcctgtttcctccatgagttcttcactatcctgaacaaccagatccacatgtgcagccgcacgtgcgtggtcgtgattgtccagaaagcgtgacaagta

SEQ ID NO: 4797 - DNA, 385 bp, Glycine max
tgaaccgtggatactgtacaagcccgagaatggaacagctcctgatcctccttgtcaacgtgccatgtcgatggagccgtgcttccatgctcctcccttctatgattgcaaagctaagagaggaactgatactggtgcacttgttccacatgtaaggcactgtgaggatatgagctggggtcttaagcttgtagacagtaatagttggcaataagtagctatggtcatgaatgctgtcatgactgtcaaaactagcttacaagttttgcaaagtttgttgtacgatagaattgttattgattttaaatttatatgatttcatacagaaaccacaaaacaaaaaactctctctgtcatcactattttacggttattgagtgcatga

SEQ ID NO: 4798 - DNA, 380 bp, Glycine max
atgctcacacttataaccatatctatggtctttcattgactggattgaggttcttcactgtttatggtccttggggtaggcctgatatggcttacttcttcttcactagggatcttttgaaggggaagcccatccctattttcgaggccgcgaatcatggaaccgttgctagggattttacttacattgatgatattgtgaggggttgtttgggggctttggatactgcggagaagagcacggggagtggggggaagaagagggggccagcacagttgagggtgttcaatttggggaacacttcgccggttccggttagtgatctcgtgagcattttggagaggcttctgaaggttaaggcgaagaggaacataatgaag

SEQ ID NO: 4799 - DNA, 393 bp, Glycine max
tgcagtgaaccaacaaggcttcctcaaggttgcactcgtcggcgaaggcgagatcgccttcggctcggccgtgagtggcgccccagtcgacgccaccgagctcatgaggaccgtcaccagcgagccctacaacatctccattctccaagtcaccaaacccatcctagtcccaggtgttgattcacaaaccccagcctcatcatctggtgcacaatcctcacaaggagccaatgctcccgttgctgcacagggtgccaaagctcctatgtcatcattacaaggtgccaaggcacccattccgacaccggttgcaaagtcacctgtgccagcacagagtgccaaggcaccagttccttcgaagactgcggccgcatctccacctactggtgaaag

SEQ ID NO: 4800 - DNA, 415 bp, Glycine max
  misc_feature (398)..(399): n is a, c, g, or t
ggcgtccgacgatgattcaagtgatggcaatgttcaaggagattcaggcgggatccgggattgattctcagtcaaccatagccaatgacgaggaaggtttcaatgcagttgaaatggtggagatgagcattaaagaagcccctgaattgagcaagcattaggcattaaagtgtcgtgtggattctttgggaaacagacaagaagagaggaggagatgacggattcagctcccctcagttttttccttctttgccgcttcaaattatttcagacataagggaaaacggttaaaaggggaatgaatgcttttgatgtatgtattcttgttattttatacataaaaaaaagttgtttaacttgtatataaacagcttcagttgttaccatctgtgtttagnngtacccttcggggtta

SEQ ID NO: 4801 - DNA, 946 bp, Glycine max
ggaggagaataaagtagccgaaaatactttcattgtaattatgctatcaaaggtaaaattttcttctcttttttaaaaactactacacattggctttttaagttatcaaaatatattccattattttgtttcatatattatgttgtttaaattttatgaactactgttttgcaattatattcatttattctgcacttaattagaattacgtgcttaaaatatgttagagtaagagcacatctggtgaaggatctactacttcaactgcattatcaaccaaggtgagaacagtttgccatgttatgaatatttttaatgttactatcattttggcttttcccttttttgggatatggtaagacaaaagcttaatccatcttaagggttatgtaaagttatctaacaattatgtattcattgcaggctccacagacaagtacagttcccgcttcaacccctccagtgtcagtagcgcctcaagctcctgctcctgctgcaactggggcactgtgagtgacatattcatcacaggattttcttgatttgttttgttaaatttcagttccgtccattttgaaatgtattgtatggtatctaaagctttctttcaatttgacaggcctgcatctgttactgcacctgtatcttcaccttctccagctccagccccagctcctgctcctatatcttcaggaactgctgtgtaagtattttgtttcctgcgatgtttggtaagtggagtttaaaatacctgttaattgtgtatcctgaaagatggaaaaacactccaacttggttgatttttccttttaaattttgttgttaaaagagacttttttgaaccagggaagggtctgatatctatgggcaggctgcatccaatctggttgctggaagcaacttggagggaacaattcagcaaattcttgatatgggtggagggagc

SEQ ID NO: 4802 - DNA, 409 bp, Glycine max
caaaaacattctcgggactcggaaacctcgtcaagctccttcccaccggcactgtctttctgttccagttcctcatccctgtcgtaaccaacagcggacactgcaccactcttcacaagtacctcactggctctttccttgtcgtatgcgcattcaactgcgccttcgcctccttcaccgacagctacaccggcagcgacggcgagcgccactacgccctcgtcactgccaaggggctttggccttcgccggcgtcggagtctgttaatttatcggcgtataagctccggttcggggacttcgtgcatgcgttcttttcgctggttgtgttcgctgtgcttggactccttgacaccaacaccgtgcggtgtttctacccggcgtttgagtccgctgagaagattctaaa

SEQ ID NO: 4803 - DNA, 397 bp, Glycine max
taaataccaccattcttcccctgcctaacccataatctaacatcaacagcatctcttcaccaacatgacgcggtcaacgcttccaccctcatctccgatctccctcttcgtgtcgctcatgtgcgttgctttcgcgtgcgccacatcgttgaacaaaattgagcactgcgagttggattgtgcaagttccacggtggaggggctgaacgtggttggtgactgcgaacccaagtgttctcaggggttgaagattccgacccaaattgaaaaagaaggacaagacgcgatcaaagagtatttggataccgttttcagcaacgcgctctttggcggtggttcaattgaaacagggcagaataaggaaacacaaattgaggacaacaagggtgcgtaaata

SEQ ID NO: 4804 - DNA, 210 bp, Glycine max
aaagtgtcagctttctctggcctacaaagggtatgaactttggttacaactatcatgagactgttgacgatgaaattgagtcctatcttgtaagtcaatccataaccattttaggtgtttgcagtgaagacacaatcttgaaacagatgtcttggatgtttgtattttaattggattaatggaatttaaaagcctcgcatcctatacctc

SEQ ID NO: 4805 - DNA, 330 bp, Glycine max
tcgagagggtagtggagaaattgagtcccagaaggaatattctgacacagacaggagtgagattcaggattcaagagaagaaagaagagggtgaacaacagacatgaccccaagaattcggtgggttggtgggatttataaagtggtagcttttgttttcctccatagctttttagattcttggatttttgcctacctcagatgggcatggcaaaggggctggcacagctggagatatttttattttttatttttttcccatgcattggttcttggtgtccttttgtttgtatataggatagatattgtttgtgtatgaaggtggatggt

SEQ ID NO: 4806 - DNA, 705 bp, Glycine max
  misc_feature (696)..(696): n is a, c, g, or t
  misc_feature (698)..(698): n is a, c, g, or t
tatgatactcatctaggaattggtatgctcttatgtctcttttgattaataccctttcttatttttttgttgaataccattgatatggaactgaaaatgtcattttcatgctttgatagagcaaagccgtagggatgatttagagtcacttggatatgttcttatgtactttttaagaggaaggtaattagcctctctcctttgttatttaatttatgatttttatcatctactatttttttatttggtagttctgcagtctgccttggcagggattgaaagctggtactaagaagcagaagtatgagaagattagtgagaagaaagtttctacttctattgaggtgtgattgtgtgatgaagttttttgtttcatatcatatatgcccatattttgtttttaaatttgtgtctgattgtggattgcttctttgttagtctctctgtcgtggctatccctcagaatttgcttcatacttccattactgccggtcactgaggtttgatgataaaccagattatgcttatttgaaaagacttcttcgtgaccttttcattcgtgaaggtttgagccttgttcttcaatttatattttatactgggatgtgctaagtactatgctccttgataaaaatattttagggaccagatggctatgttattatattccctttttttgttgttgacttcttgcancnaggattc

SEQ ID NO: 4807 - DNA, 656 bp, Glycine max
tgttcgaagagcttcccccttccccgccagtatccaagaggctccgctgttcctcctcccctattcgcctctctctcccttctctcatcgaccaccttcgccctctcttccctcatatggatgaccaggttccacttttgcttttttctttttcattcattcattatcaattaattaatcaataattgaattaaaaaattattcattgctatgctttcttcgttggtttttttattaggtcctcgagagagcgctccaagaatgtggcaacgacctagatgcggccatcaagagcctccacggcctctgtttgggatctgctgatgataattctcaacctgctccacaacctgaccaccctaacctcgtcgtcgacacaggtttcaattctatactttatttaaacgtccaccaagagattagggaaaggatcatcaattttcacctattgactggattacacatattattcgtaaccacgggtttcaaatttcaattgggtgttgttcgttttgtgctgttgtcggctgtaatttccttgatagcatttcgtggcttaataaaatggattttggatgatttgattttcaaaaacttgcttgcaggtgcgttggaagagaatggggatgcttctgcttctggggatcagcccgctg

SEQ ID NO: 4808 - DNA, 487 bp, Glycine max
cgctctacatgatgaatatagaacaaagcaacaagaaggacaagctgtggcagtcccgcaacagaagaaacccaaggtatttccctcactgtttgatcacatcctagaatgcagttacgcaacagaagaaacccgtcaggctggaaatcacatcctagaatgcagttacattaacttgccagtatgattatttgcatatttgcagttgataagtgtatttaatagttcaacctgtttgtaggggtcacaagataaacagcagaaaggtaagctccttgagagcttatatagtgaaaaccccaagctttcaagtttatgtggaattctcttcccccaaaatagtcagtctgtctggagtggaccacactcactaatacggaagacaaattctgctcggactagttcaattcacgctgctataaggactttcatggagtagctttttatctttatcagttcactacacttcctagcagcctatgtcatt

SEQ ID NO: 4809 - DNA, 395 bp, Glycine max
gttctggtgaaatcggttatggaccagaagcccatggcaggcccattcactcgctgccccacgtgcaacggaaccggtcgagtcacgtgcctctgctcgcgttggtccgacggcgacgtcggatgctccacgtgctccgggtcgggtcgcatggcctgcagcagttgcggcggctccggtaccggtcgacccttgccggcgaaaatcgcgattcgcccgccgaaccgcccaattaattagttcaccaattcgttgggctcgcttgctcgcttgctactactccttttattttagcgtcagtataacattttaattttatatagcttttttattttattttatatcgatcaattattatgtaatataaagtgcacgttgacacttgatttgaaatg

SEQ ID NO: 4810 - DNA, 620 bp, Glycine max
  misc_feature (28)..(30): n is a, c, g, or t
  misc_feature (377)..(377): n is a, c, g, or t
  misc_feature (393)..(393): n is a, c, g, or t
  misc_feature (405)..(405): n is a, c, g, or t
  misc_feature (419)..(419): n is a, c, g, or t
  misc_feature (443)..(443): n is a, c, g, or t
  misc_feature (448)..(448): n is a, c, g, or t
  misc_feature (496)..(496): n is a, c, g, or t
  misc_feature (500)..(500): n is a, c, g, or t
  misc_feature (502)..(502): n is a, c, g, or t
  misc_feature (506)..(507): n is a, c, g, or t
  misc_feature (511)..(511): n is a, c, g, or t
  misc_feature (514)..(515): n is a, c, g, or t
  misc_feature (524)..(524): n is a, c, g, or t
  misc_feature (528)..(528): n is a, c, g, or t
  misc_feature (533)..(533): n is a, c, g, or t
  misc_feature (536)..(536): n is a, c, g, or t
  misc_feature (538)..(538): n is a, c, g, or t
  misc_feature (551)..(554): n is a, c, g, or t
  misc_feature (562)..(563): n is a, c, g, or t
  misc_feature (565)..(565): n is a, c, g, or t
  misc_feature (567)..(567): n is a, c, g, or t
  misc_feature (574)..(574): n is a, c, g, or t
  misc_feature (578)..(578): n is a, c, g, or t
  misc_feature (588)..(592): n is a, c, g, or t
  misc_feature (594)..(594): n is a, c, g, or t
  misc_feature (597)..(598): n is a, c, g, or t
  misc_feature (600)..(608): n is a, c, g, or t
gtttctttctttgtgcacaacaacaacnnnaagatgaataagcatcaagcgtcagagaagaagaacgataacatggagaagccactaactccattgatgcctcctcctcctcccacacttgaaaggacaacttccattgatgatgagcctaaaactttgcttgaggaggagatgaaagttgcaagggtttgatatacccattttttctctttatatacggtttccagctttaattattttctcttgtttttgtttttgtttaaaaattcttaattaaaattctttgtgcaggaggcagctctcaaaatcatcaattctcactcaaaagaagatgccctgaaaatattcctggcggtaattgaaatgttttttttttnttttttgcgattccgnaataattgttcncttttattcagcanatttatcaaaactttttttgttgnggggnatacccgggatcctgatgctgttgctttcaaaagttttttttttcccngaangnaacnngatntgnnaattaaccncaanccccntgnanaaaaagaaaaaannnntaattttnntntnaaaaagngttntgtaaaaatnnnnnanctnncnnnnnnnnnttttgaggaaaa

SEQ ID NO: 4811 - DNA, 710 bp, Glycine max
  misc_feature (696)..(701): n is a, c, g, or t
  misc_feature (703)..(707): n is a, c, g, or t
gcttctgatttcacagtatatgttgaccctggaaagtgggtagcaactgttgaagatggtgcacggtttgggtttgatctgatggctgtcatgcttattttcaattttgctgctatcttctgtcagtacatatctgcaaggattggtgcaattactggaaaaagtctagctcaggtattttgtcttgcacctcagggatttataaattatactgttgttgaggtagtaagattgcaatatttgaaaagcttctgcactctgagctgctttttatcccccctcagaaaaaaaaaactgttctatttgagtttcaaataatttgctagttttgttgtctttttaatgtagcaccctgccattcactccctattaaataactcgttgcacagtaggaagactattaagaagaaatcacttatcaagaggatatgaacccagaagaaaattattaaacaatcttttaccttcttttgctcaaaattcatctaccaaaaaatcaaaattcactcaataaaaaattcataatttgcgtgtttttcttatagactaacattactttctttttccaaagatttgcagtgatgagtatgatacatggacatgcatgctccttggagttcaaacagaactttctgtgataatgttaacaagggagtacgcttgattaaccttcaaagatttagctggctcttcaannnnnntnnnnngga

SEQ ID NO: 4812 - DNA, 376 bp, Glycine max
gtagtggcattcattaagggccctagaagtgcaccattatgtggattctcacagagagtaatagccattcttgaaaatgaaggagtagattatgagagtgtaaatgtgctggatgaagagtataactacggattgagggaaacacttaaaaaatacagcaattggccaacattccctcagatttttgtggatggtgaactggttgggggttgtgatatattgacctcaatgtatgagaaaggtgaacttgctagcttgttcaaaaaataattgtgcaagttacctgcatttaggcattcttttgaagttgggggataggagtagagaatggagagtgagggaagggtgtaatgcattcaaggtcatttcaactctg

SEQ ID NO: 4813 - DNA, 474 bp, Glycine max
ttttagaacaccaaagtacttgatgcctttagttaaatttaacaggcaattcaaaatgatagaaacgatgaaagaagatgtatctaacatcgagaaggcctatcataagttggaggaagagaagggcaatactcattcatgttggcatatggctccaaggtgttatagccaggcagttccatcttgtattcaccaagaatctgacagaatggaatccggtcattctcattgttgcaccaacttggtaggcgtgtttggttgtcctcgaaaattctgagcatgtatgcatcgcgaatctgcaaataacaagatataagcattagaaaaagtttttataatggtgaaaggttcatgcatttgcagagacattacgacttacggtgaactcggttacttgaatggaattagcaatgggaccaaaaacttcagcctctttatacatagaaaggataaaggcaacacaagttgtcgact

SEQ ID NO: 4814 - DNA, 219 bp, Glycine max
ttttattgcttttggaaagggcggcaccaacaaccttccttcccgctcggatataaacccaaacacttggccttcactcatttcctttccccaaatcacacaatgaaatacgtggtcatcagcggcggagtggtcagtggcctcggcaaaggcgtcaccgccagcagcataggcgtcgtgctcaaagcctgtggccttcgcgtcacttccatcaaaaaa

SEQ ID NO: 4815 - DNA, 525 bp, Glycine max
ctgatttatgttcatgccaagatgatgataggtaattcacaaaattaagcttgcaaattttgtaaaagcattcttactcgcttaccatctagattttgaaaccttttaaactcacaattataattgcccttttagaaaaggtgacctgatcattgagaaaatctcaaaaacattgccttaattgtgaagataaagtaatggaacttttttgcagttgatgatgacacataatcgttggatctggcaacataaaccagagatcaatggatggtgccagagattctgaggtagccatgggtgcttatcaaccatgtcaccttggcttgcttcatgactccttccaccaccctgaaagtgaagaatgtattaagaaggtgaaccaaattgctgacaagtattgggatctctattcaagtgagtcacttgagcatgaccttcctggccacctgatccgatatcctattggggtttccagcgaaggagttgtcactgagcttccgttgagtacgagtcactgcatgacct

SEQ ID NO: 4816 - DNA, 377 bp, Glycine max
gggagaggacttcttcgccggcctcagtcgccgactcggtcagacctcgcttcacgaaactcgcaagcaactctcatccactgtttcggagattccaaggaaaactcagggtttggtcggttcccctcagtccacgctcgccggaataggaagctggtccggtcggagcgccgtttccggcgacggaagccccaacgggtactcgcgtgtcccttcgccctcgacgacgccgtttgacgaaaacaacgacccctgggaagtgatttacgcagccgcagttcaaatcgcaaggatgaagatgaacaacaacaacaaccgagttccagcacagtatgattttcacaataatagaaggttactcactcatcattgcccta

SEQ ID NO: 4817 - DNA, 921 bp, Glycine max
atatgggcacattggctacatagaccctgagtatgctagaacttcccgcctcactgagaagtccgatgtgtatagctatggtatcgtattgcttgagcttctaactgggaggaaagctgttgacaacgaatcaaacctccatcatctggtgagtcttctagtgtgtgtctggtttgtaggtgtcacaaatttcatagcaccccattggaaaagtatgtgacttgttggattggctcaaacgaatgtttgatgtgtgttagctatggtatcgtattgcttgagctttttcaatatctaagtgcatgtttggattaaagtttacaaacttaagtttgggttaaacttaagtttgtaaattgagtttgcaaaaacaacccaagttttactacctctataaaactaagtttccaggcaaaattttcatttgcaaacgtactttggtgtaagctccccactggcaaaccaaacatagcctaagaaaacataaacacttgctgtctttattttttgagctagttatatctttttggtttgacgtaaagccatagcaaattagtaacactttggtgtaaatcttgtgttgtgaccctttggtgttagcttagttggtaatttatgggatactcctaactaaattctcacgataattttcttatactataactaactatcatattccttacttgcgtagattttgtccaagacagctaatgatggcgtaatggaaaccgttgatccagatattactaccacatgcagggacatgggagcagtaaaaaaggtttttcagcttgctcttttatgcacaaagaagcaaccagtcgataggcctacaatgcatgaagtgactcgcgtgctgggaagccttgtgccatccataaccctaccaaaacaaactgactcaacacaagtgctgctact

SEQ ID NO: 4818 - DNA, 291 bp, Glycine max
  misc_feature (282)..(282): n is a, c, g, or t
ggttaaaccgttatctatgccatgtataaactaaactagtgtggctctagacttgtgccaataagaacatggaattaatatataataatacattactaatatttgtgctatatgtttatcaatgtgtcatgtattcaaagtggcaccaatggaccctgtgttgtgcttgtgcatattatcctgtaaaaccattgagaacttgttttgatgctttgagatgtaaatcctagtcaccgaggttgtgaccattaacttaaaagaggctttgtttagatgctgtgngatggaaat

SEQ ID NO: 4819 - DNA, 355 bp, Glycine max
ctcaatatgcttatggaggctatttccctaaccgacccacaattgcaagaaacaaaatgccaacagaagacccttctgaagaagaatggggaaattttctaaacaaacctgagcaaactcttttggagtgtttcccatcacaaattcaagcaacattagtgatggtagtcttgaacttattgtcagatcattcacttgatgaacagtacattgggaaatacatggagccatcatgggctgagaatccaactataaaggtagcctttgaaaggtttaataggagattgaaggagattgaaggtattatagactcaaggaatggaaatagtaatttgaagaacagacatggagctga

SEQ ID NO: 4820 - DNA, 412 bp, Glycine max
attttaaatttgtgatcatcttcattaatatttcattccatggcttcttgtcactcgtctcccactctagtgtttacagtacgaaggaggcaagcggagctaatagcgccggctaagccgacgcctcgtgaagttaagaaactatcggacattgatgaccaagaagggcttcgtttccaaatccccttcatacaattctatggtaataataaagagtcctccatgaaagaccctgttgaagtgataagaaaggcacttacaaaaactctagtattttactacccctttgcgggtaggcttagggaaggtcctggccgcaaactcatggtggattgcaatggtgaaggcgttcttttcatcgaggcagacgctgacgtcacgctgcaccaattcggtcccagttatcttctta

SEQ ID NO: 4821 - DNA, 1164 bp, Glycine max
  misc_feature (1158)..(1160): n is a, c, g, or t
tttttttctttctttcgtagacggagagcacactattttcactgcagcagcaacaatggcggagaccgagatcgagaagataacgacaatagacccagagacggagtttctggcgtcgaagataaggaacgggaacgagtgggagaccttcaaggagaacgtgaggccgctcaagagaggccgcaacgtcaacctcttgaaccacgccctcaactcccacaccgataacgaactcaagaaatccctcatggaacaacgaaggttcgtttttattcccactcttcatggagggagaggccgtgtgttcgaatctgtctcactcagacaaaaactaacaactaatatttatcgataaaaaataactattaattaattaattaatctcttttgtgattttgtctcatttctgtgtttccctgaaacaggaagctgattgaagccatcgaagaataccaaggtgatgaccctcttcttccctggatacagtgagtataaatatatctctttccatccccaatattcacttttctttgggtagtttgtatgcaattttaggttgaaatctcattttccccattatacacaaaatatttaatcttcccacatgtcataaataaattgccctaggcaaaccctaaaaatatgtgttgaataggtcaaatcacttaaatttaacaaaagttggcgtttcgaaccttggacataatttttaccatcccgtaactaatatgatctactgagcaatttttgcattagtttgagaacagtgactaaagagatgagaaagatgtttttctgaagttttttaatgttctaataataagtatatacatcaacaatctatttgtttgtatcgagagaaaataagaggagaaaatatttggaaatttcaacccaggagattttgaaatttcgttttttaaagttattttcccccattttctcataatcaaatgcaaacataaaataaaatagtattaagaatgtttcatttgacgtgttttacatatgatatattttttcgtatgatatgtgacatgtgctctgttattgtttagtcattaagcaactaagagcttactgttttactatttatttatctaaattaactttattgatgttgaaggtgtatcaagtgggttcaggaggcgttcctcnnncgag

SEQ ID NO: 4822 - DNA, 379 bp, Glycine max
ggtgttgcgatatgaagatgaattggcaaggaaaagattgcaggtgctgactacataaaaaatatactcttttattatttaatttgtgaatttagatagctttggaatttaaactagcatctagaaataattgttcctctagagcaaaaagtcatgatggctttgagaattatggatgtagttagaaaatatatatgcaaaatcaagctgagtttgagcttaaacttatggtcagtaaattcctttttgctctttggtcctaggcactggatatacttttgctaacaaacctatcttcttttagttgttccaattttttcttaagaaatgtatgatcttagcttatgattttctcaatgacttctgatatttatccccc

SEQ ID NO: 4823 - DNA, 440 bp, Glycine max
tacgttcctctcactccgatcagcttcttggaacgcgctgccctagtttaccgccaccgactttctcttatctccggtgacgttacctacacctggactcagacccaccaacgctgcatcagactcgcttcttccatttctcaacttggtgtcggtctttctctccgtcatgtggtaagtcattttctttctttctctctctctcttcatcaatttctttctttctctcagctacaattatcatgaatttgagcaggttgctgtattggcccccaatgttccggctatgtatgagttacattttgctgttcccatgtctggggctgttctctgcacgctaaacacgcgtcacgattctaccatggtttctttgttgctgaaacattctgaggccaaacttctttttgttgattatcaatttcttcatattgctcaaggag

SEQ ID NO: 4824 - DNA, 638 bp, Glycine max
tcagactttggtcaagaaaacaattctcccaagtcagtgttatctacagttgtttcagaaacccttggttcctccgattcagatacacctactagatgtttgtcaccaacctcatccattagtgatgtccccacaaacagatttccactcgctgagcccaaaacatcatttgaggaagaagggtctccaccaagttcagctcatgataagcaacctcctgtggtacaacttaaatcctaatcaattttcactttcttgactacaatatcatcatgagaatacttttaagaaaatgatataattttaggctcttatgtttgattttagaatttaatttaaacatgttgtatattgtcaaccaattattaactgtcatgattgttaacgtgtacgataactactttaaaagtgatattgaaggtgatttctaattagttgatatggtagtgcaagtctttacattgataatatacatgaaaattcaactctcccttgattttaatgtgtagaaactggagttttttcacaaagaaagtgtttctaccaaggacgatgcaacagaagaatcatctggtcgtactctcaaactttttgggaccactctactgataacagatacatgcaaaccttcttcacca

SEQ ID NO: 4825 - DNA, 376 bp, Glycine max
gtatgagtgcttccatggtgtgttttggaaggagtcagatcttgttaggttaatttgtacttgcaactgacaaactcagcctcagcttaactttttatatcttatagatggatcgtcgtgatacttcaggatttgtcagtggggggtgcattaaacacctgtagacacatctaaccctaactttgtagataagcatctctttttttacccggaagtcaggaaggttgtactgtgaaattcataaataggattagatattgtttcgggagtggtttcatcactttcatggacgcgaggttcaagaactttttaggatttgctgctaatcattctgcaaatgcattcaagattttgggcaattctatgcaagttgaag

SEQ ID NO: 4826 - DNA, 549 bp, Glycine max
atgcatgatatattatgcaaatcctacaacttcatccaatgacattgatcagagcaattatttaaacaccaccttattcatctaatacttaactgccttgcttacctcaatgttcaagaacaatacagagtaaatatccgcagacattgaactaggtgaccaattccattattgcctcaaaactttttcagacgaactaactcaccttgcctagctccagattcaagcattgcctctaacacagcaacatctcttgcaccttcgacataagagaggcgaggctcagtcacaaactgattccgcttctgctagaaggaaataaattagactagagaatagcaccctgttcaggttgatttgaatctatagttccgggtatgtttggacatataattgagggtaaggtaacatgataaatcaacgagaggaatttgttatagaattcaaatatgagaaggaggaaccattttgtactcaattaccttgagggtgatttcagatacatcattaataaaagcttttaattcttcagttactccactgaatggg

SEQ ID NO: 4827 - DNA, 881 bp, Glycine max
  misc_feature (807)..(809): n is a, c, g, or t
  misc_feature (811)..(811): n is a, c, g, or t
  misc_feature (869)..(873): n is a, c, g, or t
gagccaatgaaaccgagtcagattggagcgagttgactcgcgagtgcctcatcaacatcctctctcgactcagcgtcgaggatcgatggcgcggcaccatgctcgtttgcaagtcatggttcagcgtcttcaaggaaccctctcttcacttcgtcttcaacctcgaccctcaattcgactcgcccaccgaatcaactcgctggtggacccccgagttcgaggccaagatcgataacatgcttcgatctgtcgtcgaatgggcccaatcctctctcacccatatacgcattcgccactgttctgatcgttctctcgccctcgtcgcccaaaggttccaactttctcccaaattccaatacccttttgtttttccttcgctaatcgatggtggccccaattgggtctcaaaactttggtcctttaagtgtgtgtttgggttatcatttgcaaaactgattttgcaaatttaattttggttaaaattgattttgaagtaaagtgatatatgtttgaatatttttattctaaaagcatgttagtatcaaaaagttgtttcaactcaaaatcaattttggacgagaatcaattcttcaacttggaactaaatgttacctatacctaaaattacattagctgatattttcatgtaatattgaatcatttaaggtgaatccaaacatgccataattcgttctgattgcttttgagatttcaagagtatgctatgatttttcttttatattaggactttgattctgaaattccaatattttaatttgtctgttaaatgcggggtttgtgccttcnnntngtgaataaaacatagcattggagcatttagcttctttttgtaaacttgtctctgcatnnnnngtgcccaa

SEQ ID NO: 4828 - DNA, 388 bp, Glycine max
atctgcatatctcctaccctcttctattattattgcagctataataactactgctgcttctaccactcctaccctgttaaataagtatttaaaattggaacatttttttttatcatccataaagctgcgtggtcgaagtggcagacaaggagatccaggaagctcccgctttttcttaagtcttgaagataacatatttcgtatttttggtggagatcgaattcaggtaatgcatttgttgtgttgctgctacacttggaattttgattggccagaacttggttaatattgtgatgtgtagggcctaatgcaagcgttcagagttgaagacctacctattgaatccaagatgttgaccaaagcattagatgaagcccaaaggaaagtg

SEQ ID NO: 4829 - DNA, 338 bp, Glycine max
atgatgaagtctgctatgtgtgcagtggtggttgtagcacttcttcttctggcggaggtggggcccatggctgaggctgtgacatgcaccccaacagagttgagtccgtgtcttccagcaatcacttccggtgctaaaccttccaatgcttgttgcacgaagctgaagcagcaaaaaccatgcttatgtggctacctcaaaaacgctagcttgaagcagtatgttaactctcctaatgcccgaaaaaccgttgcttcttgtgggattccctttccaacttgttaattaattaagccttcttataattaaagtgtgggatatatatatatatatagata

SEQ ID NO: 4830 - DNA, 880 bp, Glycine max
tctgctattgactttccacacatcatgtttagttttaatgggaatattgtgtatgatataattaggctctagcagattcttattttaaaggcttggccaaggttgagagagagccttctgcccagccagttaccaagatagaatttgaattcgagagacataggataacaaaggaagacgtgcgagagcttatataccgagagattctggagtaccatccgaagatgttaaaagaacatctagagggagccgagccaacaggattcatgtatccaaggtactattgtccaaatctgaaccaaaatttctgtttcacttctcattcttttgcatgagtttgaacacttgatgggatctatcaattcaacattgtttggtatttctcctgatactgttatcaaataataacatttggtcaacatttttgttctaccctttaactaatttcatatataggtgtttggaggatttcttcttctccacttctggtttctgcattttccctttcttctaactgcaatttcatgtttttatagtcataaattttctatcctactttatatagtatatcaattcaacttctttttttttatcctaacacatttcaaatagtgcggtggatcacttcaagaagcaatttgcatatcttgaggagcattatggaaaaggtggaactgttactccacccgagaggcaacatgcatcattacccaggtattctaattttgctaaatgtttctggataatgtggcttttttctttagctattgctcttttatcttgtcagcacacccattcatcttctcttgaactgcaccaactgtgctgatttgagactttaaatgcaggtcatgtgtgtgtattcagataactcaagacc

SEQ ID NO: 4831 - DNA, 371 bp, Glycine max
ctaccccgtcacaatccccaacgaatactccctcttcttcgccaactgcgcccccgaaacctccgtctccatgctcgtccacaccgagctctacaacctcgacgccgactccgaacactcccgcgattacctctccgccggccagacccaactccccactctctactctctcttctccttcgcctacttcgccttcctcgccctctggatatacatctgctactccaacaagctctccctccaccggatccacctcctcatggcggcgctcctccttatgaaggccctcaacctcctctccgccgccgaggacaagcactacgtcaaggtcaccggaactccccatggctgggatgtcctcttctacatct

SEQ ID NO: 4832 - DNA, 915 bp, Glycine max
  misc_feature (907)..(907): n is a, c, g, or t
  misc_feature (909)..(909): n is a, c, g, or t
acctagacgtatcactacaccaagaaatcctctaacggacacatgaatcatctagatacgtatttacaagaacaaatgatgtagcatggagcaccacaattagtaccaaaacccaaaatgcccaaaccaacgcaaaaactgatgccattagtgtcacattccatatggtttgcttagcatctttcaaaaatcttatacagtttctccagcgaagttacctgtaaaagaaaataaaaagaaaaggaagaaaatcaagaaatcgttgatggaactagtaataaaataccttcttcaggattaaattgtatgtttaccgtccttgtttctccaaaactatattaaaaaatttatggtatcgtcagatatttaagagttttggtgctattattaaaaaaactctctctggtgttcccaaactcccaactattgacccacaaaacaactaccataaccattaaatttcttttagtactatacaactctggactaagtattcataattcttagttaccggctcatgccatggacagttaagggaaaatgattagatcatcagcactgagtttcaatgctcacatatagcctacaatttctcctcccctcatccattcttatgaagttctttgtaaccagagagagggagggagagagataagtttgtgatcaataactgcgaaaatctagtcttcatgcattcttaatcaggcaagaggcaatatatacaaataaacaaataaaacagtaacaattttgtcattcataatggagagagagaacacggaggatgagacttgcatgaagagaaacggaagttcccaaggggctgattaatgtttttcagtaataatgagaaacatacatgtattacctgaacaaaggttccatcagtagccatagaagcaggtgntngaaaaa

SEQ ID NO: 4833 - DNA, 380 bp, Glycine max
  misc_feature (372)..(372): n is a, c, g, or t
tgccgcagaaaagaacaacaaaaacagaatttgagccttttgttttgggaatgtgtaaggagggagaagaaattttggcaatgggggaataggaggatcaatcaaggtggtgttagtagcattatagatgttttgtacattgtaaaaaggttaaaaaaactaaaggcaaagttaatgccatatggggtctcacactttactcttggggatctggatggtgttttttttttgaatgagaaagcgaaacatttgaactgaagtgtgagcccatagtgaaccaattgaccttttgttccttcattattctggaaagaaaatgagtatcttggacttgggggggaggggaagtcaaaaaaaagggaaaaaaatcanattggagg

SEQ ID NO: 4834 - DNA, 450 bp, Glycine max
  misc_feature (394)..(395): n is a, c, g, or t
  misc_feature (443)..(443): n is a, c, g, or t
  misc_feature (445)..(447): n is a, c, g, or t
tgagcttcctccataccaagcaactagcccacaagaacttgaaatgcagcagtgtgtttctagatgtcaatttcagagctgttttgggtgattttgggtttgtgttgatgggtgcagaatcaaaacactttgagtcacaagtgtgccaaggtgctgatgtgtttgaatttggtgtccttgtgttggaagtgatagctggaagggtaagggatgagaaagaggagggaaatccagaagagaggaacctactgggttatgcttggaacttgcatcagattgatgaaaaggtgaagctggtggacaaaaggatgggatcattgatcaacctggagcaggcaattcgcgctcttgaaattgggttgctttgccctctaaatgagaacaaaggaaaaannaaaatttcgggagcgcgaattgcctgctccaggttgatcaatgatccnannnttt

SEQ ID NO: 4835 - DNA, 412 bp, Glycine max
  misc_feature (141)..(141): n is a, c, g, or t
gactttgtagccaaaatggctgattttgggttgtccaaagacggaccagcttttgaacacacccatgttagcactgctgtgaaaggaagttttggttatctagaccctgagtacttcagaaggcagcaattgactgagaantctgatgtatactcctttggtgttgtgttgtttgaagttgtttgtgctagagctgtgataaaccccaccttacctaaggatcagatcaaccttgcagaatgggcaatgagatggcaaaggcaaagatcacttgagacaatcattgactctcttcttagaggaaactattgtccggaatcattggctaagtatggagagatagcagaaaaatgtcttgctgacgatggaaagagccgccccaccatgggagaggtgttatggcacttggagt

SEQ ID NO: 4836 - DNA, 388 bp, Glycine max
ttctctccgaccaccaccgtcattctcgtaatacgtcatcggaaaatgcaaaaaaacaacaaaacaatccaaaattattgggcacacaaaaaaccacccagcaaaaaaaagctttttttctctctttgtttatgaatggttgatcatggtcggtggcagcgttttatagcccaatcaatcaatcatcagcacccgcaacgagataatcgattagggcacgaagatgacgatgatgagagaagggtcacgagaaactcgtggattgaggaatgaggtttcaatttggaagaatgagaacgtgaaattggcagctactttttatgtttctgtttcggtttttctctcttttcttttcttcacacgcagcacccaggtgagttgatctaat

SEQ ID NO: 4837 - DNA, 360 bp, Glycine max
ctcgccaccgataaggacatcggccaggtccacgttcctctcatggaactcctcaagcaacctggcgacggtaaatccttccagcacgttagttaccaggtcagaaaaccctccggcaaacccaagggagccctcaatttctcctacaaatttggcgatgaattcgcagccccagccaaggtatcagcacccgcacctacctcgccttctcacaaggtggaccccgtcacggcttatcctgctcccgcggtgggctccacttcttctgccgcgtatcccgccatgtatcctccgccgccgccgccacaatatgcctatcctccgccgcctcaacccgctcacggatacggatacgctcca

SEQ ID NO: 4838 - DNA, 721 bp, Glycine max
  misc_feature (689)..(691): n is a, c, g, or t
  misc_feature (693)..(693): n is a, c, g, or t
  misc_feature (707)..(714): n is a, c, g, or t
gggaactcctatcctgcatagaacagctttgactgctctagtaacttgcttggagatccttcgccgtggcatatggaattttttcaggtatactttgttgtgcttaattcaataaccttactagcatttagcagaatgtgaatgtgaatggaagtgcatgctgatcttgatcatgatttatgactgaagtctaattcactttcactaacaaaacattaggtttatacatgaattctgatatatcttggatgccttagaaccggttgaattgggtaatccaagctcaatgttctaaaataggaaatgcaaactagccagaatctttttccataatatgttagcatgtttgttgactctgaatgagtggttcctaatattttatcttatccaacaactacacttctggttgtgctgaagtaatatctaaaaattcattctactgttatatcatagtgttatactgttattaactatttcctctgcaaagagtttgctaacaggaaaatttctcctagataacaatgcattcataattttgaagaataaaggaaattgaattacttcataattttgtcttacaatcaatatagtataagatgtgatttttttattcatccttggaattgaataactcattcaagaaacattttttacccaatctggaggaatcacacagaaaagacaaatcnnnantgatacaccaaaannnnnnnnctactta

SEQ ID NO: 4839 - DNA, 415 bp, Glycine max
agggttctgaatgtcgaattctcaacaaaatgagattgatttaaccggcgacggggaagagaggtcaaactctctcttagcgaacacgcgctgcagcttctgctttccctgctgctttggttcccggtgccactcggtcagcgtcgggttcgcgtggtgggagcgcgtgcgagccacgtcgtcatggtcggagacaagccctcactctgaggcgcaaccagcaaccgggagttccagtgggagttggtggtctggcggcgtgagggcctttatgaaggtgcgggagtggtcggagctcgcggcggggcctcggtggaagaccttcatccggcggttcagccggagccggagtggctgggcccggcacgcggcggggaagtaccagtacgaccccttgagttactccttgaacttc

SEQ ID NO: 4840 - DNA, 406 bp, Glycine max
acaaaaagatctagtcctagaatccaacaggggcgacctcacctccaagaacacatagccatgtcaagaaacttgcttcttgttctttttgcagtagccaccttcctccatggctcagaagcacaaaccagacacgtggtaggtgatgccacgggctggatcatccctcccggcggcgccgccacctacaccacctgggcttccaacaaaacattcaccgtaggcgacactctcggtaaacaaaaactttcactagtattctaactggaaaacttttttatgaattggcttaattaatcatggttatattttatgttgtattgcatgtgctgcctgtagacttaaaagttttggatttctttccttttttttttttttttttttgggggggtaaattcccccccca

SEQ ID NO: 4841 - DNA, 1211 bp, Glycine max
  misc_feature (1204)..(1208): n is a, c, g, or t
tagctgtgagtctgatgtctttgaattactggtaaagccagtgcgtttagtgagggataatgagttgttagaccaggaattcgtcaatattatgcatgcacttcaggtattttaaagaatcctatctaagtttttccccgctgttaatattgaaagatcaagtgtataacaaatgcacgtgaatatacattgaaagcctataagaagtgaccatgatttttggtctcctttttcaccctttacaaaaagcaggtttataaatgccactggtactcaatcttttgttgtgcttggaaaaagtgccaaagcaaaactaaactaactagaaatttagttttccactttttccaatgggaagaacgccggtgttagatattattactatttttaaaagatgagattcttgaagacaaagagataatggtaagtttagcagattttattaatgaaaactatcaatgagttatctgtagaacaatcggaccacccatcaatacatatgtgggaaattcttgctatttaatatatggagaatgctttctaaaagtataggttaactgccagcctgagtacattacatcaactaggattttgtagtttctatatcttgatgttaagattagtacttaaatgtatcatgtcgttttggacttatgtcgtcaaagttgtttggatgtgtttcttttgttgttagtaactcctatttcagcacgagaatagaaggaatcttaaaaagttaaactgggtcccccaagtttctttaagagacttaaaaatagatgtaccttttctcttttatttgcattttatgatttaatatggtcccttgatttttctttaactgcatttactactgttgtttgcgcatgaatgatttcttgcaatttataatcttgattgcttttggaaaagtttctgcaactactctgattcatgttctttgcttgaacaggttgtccatttctattgttggaaaggatcagctttactgaacaacatgtcaaatatagactccaaggtactaaaagtgacagaggtacagagagagaaaatcagtggtctgaattctgtacttttgaatgataatgattttgcatccaaagttttctgtaatatgccttcggaagaaaagggatgcatttgctttgactggtcagaagttctagctgcagttgctgcttgggaagattatgcgtcaaactannnnnaca

SEQ ID NO: 4842 - DNA, 681 bp, Glycine max
ataatcctacttgtatgctctttacacgtagatttgtaattgttaggcgtctgagacgattagctgtgtgtgactggtataccgcacataaggccatatgtaatttttttgtccaatttcttgtcgctcaggttttggatgcagacaagggagagaggctagaaagttcatatggacgcgttgcttcacgtgatatagtccaatttgttccatttcgggagcttcaaagtgagtatcaatttaaaaatttaggatggagatagtgatgagggtttcagcaccttgcatgaaatcacattgctatcattgtactaagaaagaaataataagtacttctttgcaaagaatgaagttttggcgaatgacgctttctcttgcaggtggattttcagttgttcaagcacttctagcagaattaccggctcagtttttaacttacgttcggagcagaaatatccaaccaagcctctagacatgtaaaaactgtacataaagaagttttctattcattgatcattgtgcaatttcgaggtccttttttttcagttcttcaatcaacgaattcggctaaagagctgaggaactgttgctttgtgctaataaacggctcaagaaaggttcgcctgctagctgtcttatccaaaggatatgtctgatcgacccttatgattagcatttcct

SEQ ID NO: 4843 - DNA, 1296 bp, Glycine max
gagaatgcttacgtggcgaaaggaatatggaactgataccatccttgaggtaaagataataatatatatcatagcccacagaatgtttcagtgtatcaaagtacaatacctaatcccttggtttatctgattttgtagattctaaattgaatttgtttgttatataatttgaacaagtcagatatagaagcattcattagcctctacctcacagattaagctttcgcaataaatgaccttgagatggtattagggctcttatgaccaagcaaagtggtcaagagttctgtcattgctgcctaattcttctacagataagcttaatttctttgcaagacaaaatttgcattgtctacacttcaagtgaggcatgttaaatataaaaaaaccattgatggacatccacctaatagcttaagcttttaggagagttgggctttgacataatattagtctctatgatcaagtggtactgagtttgatatctgctacccccaattctgtccatgcatcaagcacaaatagttcttatgaggggacatgttagatataaaaccattcattttccaaatggcataagattttaggagagttggtccttgatagaataaaacagaattatttgcttttttaatctttgaatatttcagcatcagcatattttcaatgctagaagacaccggatacatgttttattttggttgggtgtttttgaaggattttgaatttggagagctggaagaagtattgcagtattatcctcaagggtaccatggagttgataaggaaggtaggccagtttacattgagagacttgggaaagcccatccaagccgcctaatgcacatcaccacaatagatcgatatttgaattaccacgtccaggagtttgagaggaccctgcaggagaaatttccagcatgctccattgcggcaaagagacagatttcttcaacaacaacaatattggatgtacagggcttggtatgttgtattacacaaaattatttgtgtaccttactaataatataaggtgtatttctgttgctgtttctctttgtatgcgtgatagtttgtgctgcttttttatagtagattattaatgtagttatcctttaagcattttatcaaatatgatatttgcctttaatattttacaatccaatctatttactgagggggttgttcctgattgggtgtttctctattttgggatcttccttgttttaagttgttgaaaagtttttctactaaaattttagctgacacttgatatgtgatgcagggaatgaaaaa

SEQ ID NO: 4844 - DNA, 1042 bp, Glycine max
  misc_feature (743)..(744): n is a, c, g, or t
  misc_feature (785)..(788): n is a, c, g, or t
  misc_feature (798)..(798): n is a, c, g, or t
  misc_feature (808)..(810): n is a, c, g, or t
  misc_feature (813)..(813): n is a, c, g, or t
  misc_feature (816)..(818): n is a, c, g, or t
  misc_feature (821)..(825): n is a, c, g, or t
  misc_feature (831)..(836): n is a, c, g, or t
  misc_feature (843)..(843): n is a, c, g, or t
  misc_feature (852)..(853): n is a, c, g, or t
  misc_feature (863)..(865): n is a, c, g, or t
  misc_feature (871)..(878): n is a, c, g, or t
  misc_feature (880)..(882): n is a, c, g, or t
  misc_feature (885)..(888): n is a, c, g, or t
  misc_feature (890)..(893): n is a, c, g, or t
  misc_feature (900)..(901): n is a, c, g, or t
  misc_feature (904)..(905): n is a, c, g, or t
  misc_feature (907)..(909): n is a, c, g, or t
  misc_feature (911)..(911): n is a, c, g, or t
  misc_feature (913)..(918): n is a, c, g, or t
  misc_feature (920)..(926): n is a, c, g, or t
  misc_feature (928)..(930): n is a, c, g, or t
  misc_feature (938)..(943): n is a, c, g, or t
  misc_feature (948)..(948): n is a, c, g, or t
  misc_feature (950)..(950): n is a, c, g, or t
  misc_feature (955)..(956): n is a, c, g, or t
  misc_feature (969)..(970): n is a, c, g, or t
  misc_feature (972)..(976): n is a, c, g, or t
  misc_feature (980)..(992): n is a, c, g, or t
  misc_feature (994)..(994): n is a, c, g, or t
  misc_feature (998)..(1011): n is a, c, g, or t
  misc_feature (1013)..(1014): n is a, c, g, or t
  misc_feature (1016)..(1031): n is a, c, g, or t
cagatggtgacttgagtttgctgagaagatatgcagatttgcacgtgatatatacagggagcttacacttgtagtgccacatatggatgacagttctgatatgaaaacaaagatggatgtaatgctccaaagtgtcatgaaaatagagaatggtaatgcattggttttcaaaacactgtttgctagactgaaagttctatctgttatgtttgatgccttaataccttattactgcaagcacaagtagaataatctactgactgattggaatttttttcatatcatctttaatttaatgaaattggttttccatccactcaagagattcttttcttaagttcatgattttggatattgcatatttgatctgcattcttttcttaggtctaaagtcattctcactcttaaatgatgatgctgcagctaatagctattagtgtttgtatgataacaccaaatcttaaaaaactatggtacgtggtgagttcatgactggccaggtggttcatgaatgattgttatggtaattcggtaattcctacctacatatactgctcagatgatgtgtagtgacacaatatatttatctaaacagcaaaccgttgctacaggccacatcaatataaaatgttgattataaagtgttttcattagtattgaaaacccgatatcagctatctttttatccccttcccacccaaatgaagtgttagcgaagtatttttctttaagatattctatgnncaagtttttgcttgaaactcgttaacatatgttctttatgnnnnttgcttttgntgtcatgtgnnnggntcnnngtnnnnnccactnnnnnnatcccangatccaagnnctttcttagnnngagttnnnnnnnntnnnctnnnngnnnntggattnnttnncnnngncnnnnnnannnnnnngnnntttttttnnnnnnggtcncncttcnntttaaaaaaaagnncnnnnntctnnnnnnnnnnnnntnattnnnnnnnnnnnnnnannannnnnnnnnnnnnnnnaaaaaaactcc

SEQ ID NO: 4845 - DNA, 1030 bp, Glycine max
tcagagaggcatgcagcagcaatcctaaccgccattagcatctcatcttcctcaccttcttcccctaacatgctcttatctagagcttcgtgcgcctcgcccgcttgctgcaagtgtctcagccaacatcccaaacttcccccactggctgcttctccaaagaatggatctgtaggatccttaccagttaacaaaacacctagtatcatgccaaaactaaagatgtcacttttgtcagtgtacctgctgaaattgccaaaaaacaccattcaatctgaataccatgaagctccacatatacaagaatggaatgaagttaaaataaacatcttattggcaataccatacccatatatgcaatgccatcaatcaagcaatcttttattgttattacttattgctattgatattgatgcatccaaatatacaccactgaaaaactagaagtattccaagttaaattaggaaaaaaaacctttgtcaattattattataatttagttgtggtctcactcaccaatctaggtttagtagtttgcagcatgtgaactataaactatattattcatttggaccagacttagtgccaactgcctaaggtctaaaacttgacatcaggaagtaatgggtagttacaaaaacaaatagcaaagtctttattaaataataccaaattcaatcagcaaatgatacaatgacaatacagattacagaatagtaatttcgtttcaaaacaagagtctttcattagggtactacaaagggggcaaaaaaccaatgaggtgtggagcttttgaaaaggtaacgaatcaaacaaattcccaatatcaaccacctaattaccctattggtgtaaaaaagcgaaagaacagaaacagcccaagttcaaagcactagtgaatgagtatgattgaaatttgtcttacctgcaattatggaaacattcaggaggagtgtagagagaacttcctccatccaaattgggtagaagtttagccaacccataatctgccaatctaggtcaaactca

SEQ ID NO: 4846 - DNA, 358 bp, Glycine max
ttgaccaagctttcatccaatacccacaacacaggccaaatctcactatcatccaacctgaacacattcccataatagacctctctccaataaccaaccacacagtttcacatccatctcccattgaaggcttggtgaaggagataggaaatgcatgcaaagagtggggattcttccaagttatcaaccatggggtgtccctcactctaaggcaaaacattgagaaagcctcaaaattgttctttgctcagagtttagaagagaagaggaaggttagcagagatgagagttctcccatgggttattatgacacagagcacacaaaaaacattagggactggaaagaagtgtttgatta

SEQ ID NO: 4847 - DNA, 385 bp, Glycine max
aaattccttcaagcttatacccagattgatgataatagtttgagattcatacactccatgtcccttaaatgtgcaattgacttaagcataccagacatcatacacaagtatggccaacccatgccactctcacaactcattgcttcactaccaatccacccatccaagacttgctacatccatcgcttgatgcgactctttactcattccggtttcttctctcggcacgatttggtcgaaaacgaacaagaagtgatcacgtatgagctaactgatgcatctagactactcctcaaggaccacccttttagtttgaggcctttgttgctagtcacacttgatccaagtgtgattaagtcatggtgtcaattctctacttggctca

SEQ ID NO: 4848 - DNA, 400 bp, Glycine max
tttacttaaatccggttcctgatactgactccaaggaaaatcaaaccgaacctgaaacggaacctcacccgaacctgaacctgaacctgaaccaaaacccgaacatgtattcaaataaccctgttgttcactaccctccagaagctgcttattcggcgcattcagtaaacccggttccggtttactatgtttccggtccggttcgaccgggatccgtgccggttcctatgcaaaccccttatcactacgttcaacaatcgtatcatgctgtggtgccacctcaggttcctatcgggtaccatcctttggttccgggttcgggtcaagtatatggagcgggcgtgaggcacatgaccccactgcaaccttacagcccctccaccacggcggtggttcatga

SEQ ID NO: 4849 - DNA, 1233 bp, Glycine max
ctataggacatcttacaacaagacatgtacaaagagccacatagtaaacataactccaaaagcagagagatgaaagagcttttgagcttctttgatgggaaataccagttgtttctgtctagtgtaaaaacgatgccacatgtggatctgtccgacgtggaagaccagttcgagctcccaaagctctacacttggcagctgcctgcaattgtcaccatgaaattaatatttaaaaaaatcattcaattttataattttggtttgaaatgcaactctgaaatatgaataggatgtatttttctcttgcggcaacttaccacttgagcagcaagtggcaacattttctctggtaccatgtttgcacagatagctaaaaaataagtcagggagcataagtaattatccaaaacgtttaacatccagtgcaacaaagaaaacaacttttactaaacataaacatgcaaaaatgacaatcatattaatgttaacttcatcactgtctttcgctcgagggaccaactttgggctcttggttgggtacaccagctaatccaagcattaagtgattagatattaggagagtatcacttttgaaccaaatatttcccatttatgtctctaaccattgtgatcattgttcaattactgtattacaagtttacaactgttgtgattctgtatgggacttcatataagaaaaccatgtcaactgaatatatactacagcaaagttgcaagtaaaaactggctctatactttcccaattaggatttccgagaggaaaacatgagaaggacctcagtttaagatgttagaaaccttgcatatatatggggaacaagacaagcttggacctaggttaattgacatgattggaatcctagaaaagtttgccaataaaagatgaaaaactaacgttttttgtttattattttgggttctggggaggggccaccattggaatggaccatattgggagccccagggggaaggaggggactgagcactaaccacttgcacatcctcaggggggatgtttttgttcctttctgtgtttctatcatatatggtgacacaaatataagaacaaaaacgaaaacaagaaaacccagtcgaggtctcaagtaagaagcttagacagaaagtcagaaactcaaataatggaatcaattttaggtaagtcactacacctaccatacataatggctccaataaaagcatccccagcaccag

SEQ ID NO: 4850 - DNA, 350 bp, Glycine max
tatctggccgggcagaagtgtggaacaacaatgtaaatgccactgcttgtttgaattcaagttctgatgcttttaagtatgggatctatgtaaatgctgtaccacttactatagaaactagggtggtccacaaatatgtatttgcactgttttggggattccaggtatgcatttcattcttttctctttttgttccttgagtagtaaaagtgtacatctatgaagattcaaataagcttaatgaagtgtatgcatatatatagggggcacatatcaagtgagagcatgagatgaactaatattgaccattcaatcttacatggatggttaagattaattcctctaatctc

SEQ ID NO: 4851 - DNA, 1427 bp, Glycine max
  misc_feature (317)..(322): n is a, c, g, or t
  misc_feature (331)..(332): n is a, c, g, or t
  misc_feature (335)..(335): n is a, c, g, or t
  misc_feature (339)..(340): n is a, c, g, or t
  misc_feature (346)..(346): n is a, c, g, or t
  misc_feature (356)..(358): n is a, c, g, or t
  misc_feature (537)..(537): n is a, c, g, or t
  misc_feature (555)..(559): n is a, c, g, or t
  misc_feature (577)..(590): n is a, c, g, or t
  misc_feature (592)..(592): n is a, c, g, or t
  misc_feature (614)..(614): n is a, c, g, or t
  misc_feature (618)..(619): n is a, c, g, or t
  misc_feature (621)..(622): n is a, c, g, or t
  misc_feature (624)..(635): n is a, c, g, or t
  misc_feature (637)..(651): n is a, c, g, or t
  misc_feature (653)..(664): n is a, c, g, or t
  misc_feature (666)..(766): n is a, c, g, or t
  misc_feature (768)..(808): n is a, c, g, or t
  misc_feature (810)..(847): n is a, c, g, or t
  misc_feature (851)..(905): n is a, c, g, or t
  misc_feature (907)..(954): n is a, c, g, or t
  misc_feature (957)..(985): n is a, c, g, or t
  misc_feature (987)..(1029): n is a, c, g, or t
  misc_feature (1032)..(1150): n is a, c, g, or t
  misc_feature (1152)..(1195): n is a, c, g, or t
  misc_feature (1197)..(1257): n is a, c, g, or t
  misc_feature (1260)..(1265): n is a, c, g, or t
  misc_feature (1267)..(1271): n is a, c, g, or t
  misc_feature (1274)..(1280): n is a, c, g, or t
  misc_feature (1292)..(1293): n is a, c, g, or t
  misc_feature (1297)..(1303): n is a, c, g, or t
  misc_feature (1305)..(1310): n is a, c, g, or t
  misc_feature (1319)..(1322): n is a, c, g, or t
  misc_feature (1329)..(1366): n is a, c, g, or t
  misc_feature (1368)..(1368): n is a, c, g, or t
  misc_feature (1371)..(1374): n is a, c, g, or t
  misc_feature (1376)..(1378): n is a, c, g, or t
  misc_feature (1380)..(1381): n is a, c, g, or t
  misc_feature (1384)..(1401): n is a, c, g, or t
  misc_feature (1403)..(1412): n is a, c, g, or t
  misc_feature (1414)..(1422): n is a, c, g, or t
ttacatggggcgcagtttgagcgaactccgcatcaacgacgattcctcttcctccgccttcagcgactgcaacagtgacagatctggcgaattcgccaccgcttcttcgcaaacgcggcggtttctcatcgcctgcgccaccgaaaattccgacgacttgatccgccaactcgtcgccgatctccactcctcctccatcgacgatcagaagcaagccgccatggaaatccgattactcgcgaagaacaagccggagaatcgcatcaaaatcgcgaaagccggcgcaatcaaaccgctaatttctctcatttcctcannnnnntgggattanngantgcnnggttantgcggctaannnctcttacctctcattggtctgctcaagtctcatggaaagattgtaatggtggatgcaccagagaggcctctagaactaccagtctttcctttacttgctggtaagcatgtgaaaaatatttccctttataggatgcagagcacatgaaagcatatgtgatgattcatatataagaatantttagtgcaaaacttaannnnnttgatgccaattaacttnnnnnnnnnnnnnnanaattggcaaggagaaagatagntgcnngnncnnnnnnnnnnnntnnnnnnnnnnnnnnntnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnncnnnnnnnnnnnnnnnnnnnnnnnnnnnnnnnnnnnnnncccnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnntcnnnnnnnnnnnnnnnnnnnnnnnnnnnnncnnnnnnnnnnnnnnnnnnnnnnnnnnnnnnnnnnnnnnnnnnnatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnctnnnnnntnnnnnttnnnnnnnaacatgactcanntacnnnnnnncnnnnnntcatctatnnnntcccctnnnnnnnnnnnnnnnnnnnnnnnnnnnnnnnnnnnnnntnatnnnncnnngnncgnnnnnnnnnnnnnnnnnnannnnnnnnnnannnnnnnnnctctc

SEQ ID NO: 4852 - DNA, 334 bp, Glycine max
gatgaggtttgctattagagaaggaggcaaaactgttggagctggtgttatccaatccatcattgagtagtaagttgttgtgagattggtatcccaactacttgactcttacactgttagcagagtatctatcatcgacgatgggcttgtgcaattgagttttgtcattttacacaactgctgctattttgttatattttgtaggtttctagatgatgcttagttgagttggacaatgagtttcctatggcttgtttaacttccatcttttttattgttatgattcatctgttagaacttgagagcaagattccataaatttctggcttgcctg

SEQ ID NO: 4853 - DNA, 493 bp, Glycine max
  misc_feature (433)..(434): n is a, c, g, or t
  misc_feature (438)..(438): n is a, c, g, or t
  misc_feature (476)..(477): n is a, c, g, or t
cggtggcaatttgcccctcacgggtctcctcgacagcatacccgagttaacattcttccacgttaactccaacaacttctccttcgtcggtggcttccccaacaacattaccaggttccgtttcttcttcgagcttgatctcagtaacaacaaagtcagtggcaagttcccaacgcaagcaattcagaacaaccagttagtcttcctggacctcaggttcaaccagctcaccgggcccattgacccgaaactcttcgagagggacctggacgtgatttttgtgaacaacaacaagttcacggggtacctcccggagaatttcgggtccacgccggcccggtacctcacgtttgcccacaacagcctctcgggctcgctccctaagagcgtgggctacagagaacttgcgactgactttgttgttactgagatnnagcncgaagaagaaacggaacctggtaatgttgttggggaanncaccgacgaaggagaa

SEQ ID NO: 4854 - DNA, 1230 bp, Glycine max
tcttctcccttttcttccattccatttctcatttctttatttcttttttttcctttcaattttttagttaacgccaaagaaatcgtcatcaccgaagagggttacaccgtgaccaccgtattcgacggccacaagcctcacatcttccctttcaccgttctccagcgacccttttcctccgatctcatccttctcgattccgtcaacagcactttctacacggcgcaattccccattactgaaggttcttttctttccctttcttttttttagtcttctggggtgtgccaaagtttcgatttttgttgatattttgcggttattcttcgttattctgtggcagaaagcgttttcacgaggctttctggcgatgggtctgtggggtattctgatggggacgtgggttctgctcggttcgccaaacccagaagctttgcttttgatatgagagggaatgtgtatgttgctgataagtccaaccgtgcaataaggaaaattagtgccaagggtatgtttgtaaataattccttaatttggttgcaattaaagtttgtctttggcttcgtttaattgtcttggattgcatgatgttgattgaaaatgcatctatttactaccaaatgcgtgaataaacttgcacgaagttattctagcttaatgagcgatctcaagtttgaaccttggacgtttaattgcattaaattactcgaaggaaaatctttgttgtccatgatgatcctacctgacaagattgacttcctgcagaggattcatgtggtacccccaaaaaatgcatctgttctgtttttggacaagtagttgtaggatttgactcctaaaatgagactaaaatcaactgtcatattaaatgtgcatgcttaataaataatgaatgtcttgaaatatcaatagttaattttttaccatgactgaaatttctttattttctaaagcgagttgcttatttcggaagagccaattccatagttgcatgaaaagaggaagagagagagagagagagagcagatgaagagggaagtttcactctacaagcaaagcgtgggccaaactatttatgtaaaatgttgaatgtgatggcctccagtttttgctttagcttagagtagcttaatgattgtttttaaatgaatgacttggatgataagtctcatgggttgtgttgaacattccttttgtctgatttcatcttgactaggtgtgaccacgatg

SEQ ID NO: 4855 - DNA, 401 bp, Glycine max
ttccttgcaactttgagtccacaagaggtcgaaggaaaaggggtgctcaaggagtgtagggcttttcttgacgcctctcctttgaacaattgcagttatcccacagatgttaacaaagggattagtggtgctgtgcttcgttttcatcgcttcctccatgacaagaagatgaaattatacaccgtggggccttttcaattcaccgcatcaccgacaccaatctctgatggatattaatttttttttttccatataaaaccttatcatgactctttaagggggagttgatcaagttgcaagattagtatgaaatttcatggacgaaaaagaagtatcaaaaagagtgtattggtattcaaatcttttggtttatcttgtatatgaaaccaacaatctcccaa

SEQ ID NO: 4856 - DNA, 475 bp, Glycine max
tttttctctagaatggaataagcaagagaaggcatggatataacaataagcaaatatttgaaagaaaattcaaaaccaaaacattccaaatcaaccttctgtatgaaaaagagagcctcagacagaacttttcatgaactaggatcagccaactgatcagaaactgtacaaaaaaggtgtttggcttgcatatcaagatttgccatatttattgacatatccctgcaaatcaaagataattctgtcaaatgaaagacatatcacaatcaaacaacaatatccttgcactttcattgaaaaatcactaacacttatataaaaggggataaaacacttacattaaccagctttgcaattttcacctgacttgaagaaacatattgcttagcagtatctatggtcggaatctgatggggttccaaggtgttaacaaccttgtcaactgattttttgactatcattatatgtgtgtcct

SEQ ID NO: 4857 - DNA, 1196 bp, Glycine max
  misc_feature (1173)..(1174): n is a, c, g, or t
  misc_feature (1177)..(1177): n is a, c, g, or t
tctcttctctattctccgcacaatgttaaactctctttgcagaggaacttttgctctcatcttctctccgtttctacttctttaggtctccacctacttcatctaatttgttttttcctttagttttttggtgctacctaagtacctatatcttaaatgaatgatacccattatgtttaatcttttaaaactgcaatctttctgataaaagaaattgtgggtgctgaaaatgaaggcgagagaaattgtgttctttgacccgatacaagaatacgaataataccctgttattttaattttgaggtgcataaattaacagaccgttctagtgtcatctagagtacttattagtgtcagtggtaatgtacatgtcagatattctagtaatggttttgactagataactttcatttaaatcctgtaaatgccccttccctaaactacgattaatttgaggtattattattgtttgatcatctgttagaaaagaggtttactgggtgataacaaagcagtattcatgaattctttctccacttttgagctgcttgttcagtaaagtatgcatgattgttggcgactcaattaatcatgatccagtttcacatttttaatgttttatgaagtgcagcttcaggtgtaagccagacagtacaagctctaaagggagaagttgacttgttactcaaaggagtaggagaaagaagtgtaacgaaagaagtaaaacatattcttgagatggtactttcttgtttttccatggtctctagtctataaacatcattaccttacacatggcatgaacaaccttggaactcctttttatccctacttgaaagtttgatgtttattgtctgtgtcaaaaatattgaggcccttttgaccattccgtcttaaaatcttaccctataaatcattatttaatccctgacttgtttttctctgattgttgtccatttgttgtaggctagacgagcatcattaaagcgagagattctccatacagattttctaacccctccagtgttaaaggaatctatgcaagttttggaaaaactagcagacgtgaaagcaattgctcaaggaggttaccctcaggtaaatatccagataagtgcttttcagtacccttgatacataagtaatctgaatttatatgtagacataacactnnatnctctaggctgaacgtgtcg

SEQ ID NO: 4858 - DNA, 413 bp, Glycine max
tcttttacgtactttcctcaatcttttatccaaccggaacaatgattccaaaaaaccctcaccaccgtctcctccaaagcttccaataataggaaacctccatcaacttggtacccacattcaccgcagtctccaatccttagctcaaacctatggttctttaatgctacttcacttaggaaaagtgccagtccttgttgtctcaacagctgaggcagctcgtgaagttttgaaaacacatgaccccgttttctccaacaaaccacatcgtaagatgtttgatatcctcttgtatggttccaaagatgtggcatctgctccatatggcaactactggaggcagacaaggagtatccttgttttgcatcttctcagtgccaaaaaggttcaatccttcgaggcagtgagagaag

SEQ ID NO: 4859 - DNA, 410 bp, Glycine max
gcgggtcttctcttcctcgtggcacgctcacgtgggacgtctcgcgtaaggccacgtgtgcctttcacagagaccacgctgacagccaagaggatgtgtgcaagggaggtatctgttggcacggcgtcgcgccgcgatccccagcctctcaggtccgtgtcagacttcccagccaccttcccttagcccctttgtaataataacacccttcttcataatagtatatagtaataaataaataagatagttttcatttattttcttaacctcttgttctccctatttgtaagtgtgtgttttggttctaaaattcggactggtttttgtaatttgtatatcctttttttttttttttttaaaaaaaaatttggaattccttttggtttttccctggaaacaggggggggggg

SEQ ID NO: 4860 - DNA, 349 bp, Glycine max
  misc_feature (59)..(59): n is a, c, g, or t
cagtcacttatattgagtgcagctccaaaacacagacaggtaaataccttaacttcatnggattcaactattttgagccatattttgaagtgaatccaagctgtatattgagatgaagttaaagaaaacattgtctctaaagtttaatttatatgtattagtgtaaaattgtttattcaataagaatctaccatgttgtcacatcatattgcaaaagtatgatgtggtaatatggtgaagaacaataatatacaaacacccacttattttaaactctatcaattcttttatttttttttatctttcttcctactacatcataaatcctataatacttatatttttctct

SEQ ID NO: 4861 - DNA, 407 bp, Glycine max
gggcttctgtgttcaaacagttcacccactgctaggcctagcatgagacaggtggtgagatttttagaaggagaagttggcgtgccagatgagttgaaaaagccgggagagggaggttaccaggagggttttgatgaattcttgcactcacttgaatcttcttcatttgatcagatgagcacaggttcatatggtagaactagagacatggattctagttttccttctttaactgatacatctctttttagtccccatggtaaaggacaaacaatgtgattatctacattttacgtagagttctactcaattatgtactttaagatatttgtttattttatcatcccatgatgtcttataattgtagacagaaagttcttgatgatgagttatcccaatacacgaag

SEQ ID NO: 4862 - DNA, 518 bp, Glycine max
  misc_feature (499)..(499): n is a, c, g, or t
atcccaaaggagtgtcttttctttttttatcaagtttgttgtttatatttaacaacctagagttaaggattttttttgtgctaattagatttaaggatttttaataatggacataaaagtgctttcttccggagttcagtactcaaatctgccggagagttacatccgacccgaatcggagcgacctcgtctttccgaggtttcggagtgcgaggatgttccaatcatcgacttaggttctcaaaatagagcccagattgttcaccaaatcggtgaagcctgcagaaactatggtttcttccaggtcctgtcccctgggtttgaactgtttgaacatgttctcaatttttttattaaccactatttgtatttatacaaaaaaaaaaaaaaaaaggaaaagttttaggtaatttttaaaaaaattaaaaagggggtttaatccggggggggttttaaaaggggaaaaggaaagggaaaaagggggacggggttttttcangttcccggggggggaaaat

SEQ ID NO: 4863 - DNA, 582 bp, Glycine max
tctctttcaaaaaagcatatatctatataaacttgtgatattgggagttgaaattaaacttgagaaaatggacaaccagcgtagccctcttctaagctgggcttactacttccagggaaaggttgctacttactcttacccttcaacaatttccattgcacagacacattgataatttcatagtccttagttgttgcaatatgttttaattagccttaaaaaaaagtgtaatggagctgataatggttggaatttgagcactaatttttcattgttgtttgttgttgaactcgatcaattgggtacagtcaatggaggagctgaggcagtccctgatatacacaactctggagctagaacaaacaagggatgcagtgcaagaagagctaaaaaagagggatgaacaactactcaacctaaaggacctcctaagcaaaaccataagagagagagatgaagcacaagagaaatgccagagacttctcttggagaagctagttttccaacaacaacaacaacaagcagctcctgtgtctggaatttcaagcatcgaagatgagccaagaagaggaattgactcca

SEQ ID NO: 4864 - DNA, 550 bp, Glycine max
catcagaaattatcacgatcttcattgaggactatgtcacagctcctcagggcctaacaaaggtcttgagagattcagggctgagcaagtacatgttcccagtgtctcgcatgcccaagaatggtgaagattggccaaccgtcgatgacatggttcagaagaatcagcgcctagtcgtcttcacttccaaatcagccaaggaagcttctgagggcattgcttatcagtggacatacgtagtagaaaaccaatgtcagttccctccttggaaaaatgttttacttgtatttgagttcaaactttttgaatatttctataatttcttttcctttttattattatttgaagttaaaaactgtttcttaatgttactgttttgttgggtttaagatttagttgaacaataatgatgacaataaggtttaaagttaagattttgtgcaaatcatcaatatcttaaaattagcttatcaaaaagtattttttatgatttctttgttataaagaattttttaggggaaaaagtgatacaacctttctctcttttttt

SEQ ID NO: 4865 - DNA, 288 bp, Glycine max
attgactttgaggtcacttgcaaggtcatgaggtggagttgcagtgagctacatgtaggagcaagatgattgagcaattcatcaatttcgttattaggcctcccaggtattaatttttccttctctggttggtggcatggcactattcaagtaagcaggtaccattgtgatgggtacgggacagagaatgttaactgtctcatattcattagggctctttctcctagcaagaggattcctattttgttccccaccctagtaattacgtgtgtttttgtactttttttt

SEQ ID NO: 4866 - DNA, 1160 bp, Glycine max
  misc_feature (447)..(447): n is a, c, g, or t
  misc_feature (1121)..(1122): n is a, c, g, or t
  misc_feature (1146)..(1148): n is a, c, g, or t
atgagaagaaaagaaggtatttatttatttattgttattattaattgttaatttctttcatgcgttgcatttttctcgtgttgttttttactcgtttttttttggctggggtccaggctatccttcccaaaattttccgatccaaaggaaatgggaaagggtccgaacaaaaaaccccccaatcctccaggggcaaaaaagggaaagggggtacccctgggattggattccgggcctttttttttggctacctaaaaaatctaaatttccctggtgggggggtttcccttttccattttattttaaaaagggtttggggggaaaaatttgggaaaaaaaattggaaccaaaaaaaaagcttttttggaaacggcccccctcctggaaaaaagtttccccgggaccccaatggctaccctaagttggggccccaaccccattttcccntttcctgaaattgaatcaacccccttaattggtttaattacaaattttttacaatataatattattaatatcaattcatatatccaaaattgcggctttagtttacattgaaaatatggtgggtcaactctagattttggatccaacttgtacagttacacatgcctatcaaacaagacgaaatcttcttcatgttatcatgtattattttggtagcttacctaacaacaatgaaattttggtaattggtaagatgttttctaatcaggggaagagcgtaacgaagaaaatcaaattttgttgtttgatgtggaccttaaactcaaactctttgtctcatctaacatattgtacacccattgcaatcatagttttgtcaggacgtgataagatgataaagtaaaccataattttaattttttatcttactcacagaaagggagactagtcctgggatcgaaggcctaaatttgtccaattttgaacggcctatgatgactatggaaactgaacttctcaggtatgtgggatttcattttcagttcaaggcttcatgcacattattgttgttgcatagtatagtcagactcacatgcaatcttctttttcatggcatgccatttggtaacgtggattgcaggatctttgttgcagcgtggaatgtgggagtcacnnaagttatgacctcaacctccaagnnncttgctagggaa

SEQ ID NO: 4867 - DNA, 374 bp, Glycine max
  misc_feature (366)..(367): n is a, c, g, or t
tgagtaggttgtggtagttcggagaaaacggtgttccaattatgaaggcgccgccgtggaagtaaactaaaataggaagcttttgcgttggtgggtaagtggttttcggaatgtaaagcctggcggatacgccgtctttttcggcgattacgacgtctttcgattccacgttagtttcggggtcgagacccggaggaacaacctcgaagcctgcgagcctctctatgcgaccgtttttgtagactttgaggatgggtgggatgtcataggctacttcactttctgtggaagttgttgaatccatagtagttgatgagggtggtataaagtactgtaagggttttttgagtttgtgagaagggatgnnaagaggg

SEQ ID NO: 4868 - DNA, 393 bp, Glycine max
tctggttgggcatatcctccagaaggtgggggctgagaagggggatatccagattgcaaatgaccagattgaccatagcctcctgctgtgttaggtgattgggattgtccatacacaggcggcgtgccactaggcttttgggtctgagggggtccatagccagatccataaccagattgtgctggaggttgactaccataagctgctggttgggaggttgggggcacgccataacctggctgagcttgtggtggatagttggcagcatttgggctaggttgttggcttgtaccataaccttgacttggaggctgggcaggtggagcttgggttgaatccccctgggatccatagttggcagtgtggccctcttgagctgggttgctaccatag

SEQ ID NO: 4869 - DNA, 1271 bp, Glycine max
  misc_feature (1226)..(1227): n is a, c, g, or t
  misc_feature (1245)..(1246): n is a, c, g, or t
  misc_feature (1257)..(1259): n is a, c, g, or t
  misc_feature (1263)..(1267): n is a, c, g, or t
cctgaaatgggaactattgcagaaaattagttgaattttgcagtgggaaggctgtgagtgaattgtgccacaacatagagggaaacatcaacgatggctcatttagcaggttgacatatgacatgatgcttgcttgggagagacctagctactacgatgaagaagataccacggtgtgcatatttataatttatctctctctctcacacacactattgttttttggaacaaaatgaacttggatataatctaatatcataatactatctccaatcaaaataaaaattggcatttcattttgataataactgataattttagttacgagatgaaatatgattttaattgaagaatattttgtctttcttttttgttataaacttataatgtacacacacaattaacagatgctgttgaaatggaaatattggagatatctgatgaacccattaggggtccagattatcttgcagtggttgaccatggttttattcttcatattttaagtaatgaagtttaattgaattggatatcagttcaagaatctatgctacttatcaaattctcttgacacaagtaagattacatttaggaggaactgaagtaggctctgcatggcttgaaattattggtcatcgaacattatcctaagatcttgtcctgtttaatctgaacttcagcattatcacctttcatatctaaataagattttgatctaaagcttttgtttttgtgcttactgctgtcattaatcagatgaggcttttgaggtttgcaggagaatgtagcaaaggagaaagaagaaaggaagataactttgaataccactcaagaacaggatgatatccctcttttttattcagacatcatgcccctccttgtaagagcatcttttccccttattttgtgatgatattacagaatacagatgatgtgtttataagctgacccccccacccctcttctatttttagttttaagcataagtttgaattccatccttttgcagctttttctcttctaattcaaaatttcaagacgttgagttagactctgaatattctctttaataaggatgtttgatgcttcttccatttgaaccaagccagtttgatagaattacacaatatttatggctttaggtgtagatattttcaattgtagcttgtcactcttactatgtgcattttgttttctaatcatataattcataaactgtcttgccnnggttaataatgagcccanntgttggagaannntgcnnnnngtat

SEQ ID NO: 4870 - DNA, 436 bp, Glycine max
ctgctgctgtatattcctactcttctctaggtcatcgcagaattcattcccatgtccaagttagaggactaaagtgtggctttaggggtgcatcttttgtatgtgaagcaaagaggaacccagatttctcaaggcaaaacaagcatgggtcctccagaagcagaaatcggaatagtgatgggagagacagctttgagagctttgacgacgatatgttttctttaaaaaatggaccacctgtgtctctttcaacctcaggaaaattccaggccacttcagcccctggtcctagggagaaggagattgttgagctatttaggaaggtccaggctcggttgcgtgagagggctgcctccaaagaagaaaagaaagttgaagcctcccgagcacaaagcaaagagaacagtactgtggattcccttctcaaactactgaa

SEQ ID NO: 4871 - DNA, 406 bp, Glycine max
  misc_feature (19)..(21): n is a, c, g, or t
ttgggagggttcgaccccnnntgaagtcacagaactatcttcagaggaagatgactttggttgggccaaagcttgctcatttttcctctccacaacttcatccgctaaaacaggctcataggtcttcacattggaatcaaatgtcactttctttctgctgctaacacttagttgctcctcactttcatccctgcattaacaaaaaaaagaagtataaaaaaacaacatatatctatatcaaaagcttccaaaaatagtatgtaactaatgaaattgaaggtcgtagatgggaattgcttactggagttggggtatagggttaatagcatttgtggagcaaccatgaaccaaagagacactatgttgctcttgcttgctattgctactatcatttctctgaaaaaaa

SEQ ID NO: 4872 - DNA, 767 bp, Glycine max
gaatattctatatagcgagggtcgtactagatatatggacaacatatttcctctttacaggtaagttgttgatgttcatttgaatttttatgatgctgttacataattctgtgtttggataattgtgtgtatgtctgattgagcaacctcaaattttgattttccataatgatttcaagtgctaagatgatattccactactctgtatacccctattggcacaatgacgtcaagaaacatgattaatgaacatctgttttttgcagtctctttggatacatagtcttgcatatgataatgtactctgcaaatgtatacctatggaggcgttataaaatcaactacccctttatatttggcttcaaggaaggaacagaattgggatacagagaagtctttcttcttagctcgggccttgcagtactctcattggctgctgtcctctcaaacttggatatggagatggaccagagaacaaaaagtttctcagcattgacagaattagtccctttaggccttgtcattgtaagtttcaaaaaacatcatttgttatacttattcatattgtgcatttcctttgacactcaacattctgcctaagcacatgctattgatgttcttatttcactgtcctttttgttcgaccacggacgtatatgactatatgctaatgaatttgtattacaggttctgctgctcataacatttagtcccttcaacatcatatataaatccagccgcttcttccttattcaggggggcgtttc

SEQ ID NO: 4873 - DNA, 411 bp, Glycine max
aaaattccctatgctgctatcaacttagataggcagaagcaaaaaaaaaagaatttgatgtaacagtaaaggaggagaaaacaccaacagtcaatgatatttctatactgctggaggctgattctttattttcttttacattttaaatcactatccaatatttttttcttgtccagctatgggggctggtgtttgttgtgatccactatccaatatagttttgaaggaccaaacatgaaattactgtgtgacaatcaggcttcttttcgtctttcttctagcataacttttcatgaaaggaccaaacatatagtgatttactatcattttattaaagaaaaggttctttcaggggaaaggttatttgctttgaagcaaaattgtttactaaatccctcaaaggacctcagg

SEQ ID NO: 4874 - DNA, 406 bp, Glycine max
caatgcagatgctgaatgagtttgatggggctctccctttggtaacagttcctgctgttgctgaatttagcaaggaaaatggtgttgtctgggcatgctctcctgatcgtctcgaactgccttcaaagccattccaccattcaaactgctcagattcaccatgcgtatcagaatctggttctgatatttttagtaagcgggaagtcatacagaaactgcggcaacagttgaagagaagagatgatatgatactagaaatgcaagatcaaatggctgaattgcaaaattcactcaatgctcagatgggactttcttctcatttgcaattgcagcttgatgctacaaacagtgacttatttgactccgagagagagatccaacggctaaggaaagcaattgcagatca

SEQ ID NO: 4875 - DNA, 351 bp, Glycine max
cgacagggagattagagggaagaaatccaaagttagatttttcattgtggggttgaatttttatgccagtttttcttttttattttaagtttgtggtgttggggtagctgccgcttgggaccaaattaaggcaaattgagagactgagctgtgcagagccgaatccttaattactactattactattactacctacattatatttattttttttatttttctttagtttttttgggggtatatattacatttttatgtaatgatagtgatttgtgtatatggttattgccatggcatgatttttggtttaatgttagagctgtgcttgatttgtgagaattgtactgttcg

SEQ ID NO: 4876 - DNA, 401 bp, Glycine max
atctttccaaccaaagcagctccaatttacagttcccatgcgtgcacagactcttctaaataccaaccaaacagcacattccaaaccaacctcgacctcctcctctcttccctttcttccaacgccacccaaggcgtccacttttacaaaacaacagttggcagtgaaacccccaacgccgtcaagggcctcttcctctgccgcggagacaccctcgccgccgtgtgccacgattgcgtcaacgccgcagccaaagacctgacacgccggtgcccagttgagaaagaggccataatctggtacgacgtgtgcatggtacgctactccaaccaatactacctcaacaacatagtacccgcaattagtcggaaacctcaccgcggcggtggctgggagaatgt

SEQ ID NO: 4877 - DNA, 1263 bp, Glycine max
  misc_feature (616)..(617): n is a, c, g, or t
  misc_feature (653)..(653): n is a, c, g, or t
  misc_feature (666)..(671): n is a, c, g, or t
  misc_feature (673)..(677): n is a, c, g, or t
  misc_feature (687)..(689): n is a, c, g, or t
  misc_feature (702)..(703): n is a, c, g, or t
  misc_feature (707)..(710): n is a, c, g, or t
  misc_feature (714)..(719): n is a, c, g, or t
  misc_feature (723)..(724): n is a, c, g, or t
  misc_feature (727)..(729): n is a, c, g, or t
  misc_feature (731)..(735): n is a, c, g, or t
  misc_feature (737)..(749): n is a, c, g, or t
  misc_feature (754)..(755): n is a, c, g, or t
  misc_feature (757)..(758): n is a, c, g, or t
  misc_feature (760)..(760): n is a, c, g, or t
  misc_feature (765)..(765): n is a, c, g, or t
  misc_feature (784)..(784): n is a, c, g, or t
  misc_feature (786)..(798): n is a, c, g, or t
  misc_feature (805)..(812): n is a, c, g, or t
  misc_feature (815)..(816): n is a, c, g, or t
  misc_feature (825)..(826): n is a, c, g, or t
  misc_feature (832)..(836): n is a, c, g, or t
  misc_feature (848)..(848): n is a, c, g, or t
  misc_feature (852)..(854): n is a, c, g, or t
  misc_feature (859)..(862): n is a, c, g, or t
  misc_feature (866)..(867): n is a, c, g, or t
  misc_feature (871)..(875): n is a, c, g, or t
  misc_feature (880)..(880): n is a, c, g, or t
  misc_feature (887)..(888): n is a, c, g, or t
  misc_feature (890)..(892): n is a, c, g, or t
  misc_feature (895)..(895): n is a, c, g, or t
  misc_feature (901)..(902): n is a, c, g, or t
  misc_feature (916)..(922): n is a, c, g, or t
  misc_feature (925)..(932): n is a, c, g, or t
  misc_feature (942)..(946): n is a, c, g, or t
  misc_feature (949)..(953): n is a, c, g, or t
  misc_feature (956)..(959): n is a, c, g, or t
  misc_feature (961)..(967): n is a, c, g, or t
  misc_feature (969)..(971): n is a, c, g, or t
  misc_feature (973)..(974): n is a, c, g, or t
  misc_feature (976)..(979): n is a, c, g, or t
  misc_feature (992)..(997): n is a, c, g, or t
  misc_feature (999)..(999): n is a, c, g, or t
  misc_feature (1013)..(1014): n is a, c, g, or t
  misc_feature (1017)..(1024): n is a, c, g, or t
  misc_feature (1028)..(1029): n is a, c, g, or t
  misc_feature (1033)..(1035): n is a, c, g, or t
  misc_feature (1041)..(1043): n is a, c, g, or t
  misc_feature (1046)..(1047): n is a, c, g, or t
  misc_feature (1049)..(1055): n is a, c, g, or t
  misc_feature (1057)..(1071): n is a, c, g, or t
  misc_feature (1073)..(1097): n is a, c, g, or t
  misc_feature (1099)..(1100): n is a, c, g, or t
  misc_feature (1122)..(1133): n is a, c, g, or t
  misc_feature (1141)..(1153): n is a, c, g, or t
  misc_feature (1155)..(1156): n is a, c, g, or t
  misc_feature (1161)..(1170): n is a, c, g, or t
  misc_feature (1174)..(1174): n is a, c, g, or t
  misc_feature (1179)..(1181): n is a, c, g, or t
  misc_feature (1185)..(1193): n is a, c, g, or t
  misc_feature (1195)..(1195): n is a, c, g, or t
  misc_feature (1198)..(1198): n is a, c, g, or t
  misc_feature (1201)..(1203): n is a, c, g, or t
  misc_feature (1205)..(1205): n is a, c, g, or t
  misc_feature (1214)..(1220): n is a, c, g, or t
  misc_feature (1225)..(1228): n is a, c, g, or t
  misc_feature (1230)..(1234): n is a, c, g, or t
  misc_feature (1236)..(1240): n is a, c, g, or t
  misc_feature (1242)..(1243): n is a, c, g, or t
  misc_feature (1246)..(1249): n is a, c, g, or t
  misc_feature (1252)..(1254): n is a, c, g, or t
tcttactcttaagttacacataatgattttaagacttttttttattaacttattcaagttttcaacaggtattgctaatcatttgtgcagtcagtcttcatggcagaaacaaattcccagtttcaatggaagaaagaccagcaaaattcatctgtctagaacattgctcatcatccaatgcaacgtcttcctgccaaaacatataattatttccagaaatataacatagacaaggcaagagtttccatgttccaatgtagaatgcaaaagaaggaaccaaattttgttatcaattattgtctataactgtcgatcaatacaagattaaccaaagcctttttcctggctggttacacgttgatcaaacaatgtcactgttttatgaaaaaccaattctttaaatgggccatttagatctatatggtaagagcaaaatgcataaattgtgttacatcaaacatcaaatttaggcatatagcatgtccctttgctcctttgctgatatgtatttgaaaatgacaatgccatagacagtacataaacttatgatgacacctaagcttcatagtaaacactcatactgattacttagtacaagatatacgatttttaatanntaaagaatcataaatttgcaatttcttctttacaancagccaatcaatnnnnnntnnnnngttgggtcannntctgacaaacaannatgnnnnatannnnnngctnntannncnnnnnannnnnnnnnnnnngcaanntnnantatgntgttttgtttcatttttcntnnnnnnnnnnnnnaaaaaannnnnnnnaanntaaaaactnntttttnnnnngcaaaccggttngcannnttttnnnntttnnattnnnnntttgnatccttnnannnganccaaannatttttaaattttnnnnnnnttnnnnnnnnaatttttgtnnnnnaannnnnaannnntnnnnnnntnnnanntnnnnccccttgaaaagnnnnnntntccccccccccttnnggnnnnnnnngccnngggnnngggggnnnaanntnnnnnnnannnnnnnnnnnnnnntnnnnnnnnnnnnnnnnnnnnnnnnntnnttctttttttttgggcaaaatnnnnnnnnnnnnaaaaaacnnnnnnnnnnnnnannaaaannnnnnnnnnacanaaccnnntaannnnnnnnncncantcnnnanaaagtgggnnnnnnngggannnnannnnngnnnnncnnttnnnnccnnncaaaccatt

SEQ ID NO: 4878 - DNA, 422 bp, Glycine max
caaaaaaagtaacttccctttgatttcacactttgctcattttcgttttctgattttcccacataaataaatctctcccttcttcttctcttacactcttctgtttcagcaatcaatcaatttccccactattagggtttttcatttgaaatgtggagagccaacaatggagccccttgaatccgaatcggttagctcctccgccaaggacccgctattgggtgaaccatcttcctctgttcaccccctcgatcatgatcctcaaccctcagatctcaatcacgttaccccggttgatgatgcacttggtgaggagcttcaggggaagttagatttgaaggatgagggtgaaagtgataataaaggttcgaacttggaagacgggggtgaaaaattgagcgataataaaggttcgaacttgg

SEQ ID NO: 4879 - DNA, 547 bp, Glycine max
gatgaggacttgtacaagatctcaccagagcttctttatgccaaaactaggaaggtcttactctttagcccccacacaataatacccttttgcttttatctccactaaacgcattttgtgttgatctttattactttcataatgtcaaattcattgcatattcaaccctttgcttttttgcatctttagcaaaagttttgataaatttgcttttctaattttattttgcctttttgctttttgttgaatgcagaagagagggttgtgtttcttcccaagctgcttgataccaacttgcattgcttgagatacaaggaaatttgaggagccaatgtacatataagtgaaatatatgatacatacttgattggatgatatttatttaaaacgggacctagaagattatcattatatatagtcacatgattattgtggcaaggactttgttgtttattctttgactttaccgtttagtttttgttggggtgttttcaattagtctttgatgtactttggggtgaatcattggtaggacttgaactttggt

SEQ ID NO: 4880 - DNA, 380 bp, Glycine max
gaaagcttgagacaaaatgacaagttcaagctgattgagtggagaaaacaatggatttcacagtcaaacaaatggcaggaaggtaatgagctctacccagtaaaggccaaaggagatgctctgaccatctctcaagctctctatgaaaagtattttcaaaataagttgataaaccattaaactggagaatatgagtgcacagaactatttacattgttccatattcttcatacaaaagtaatattgagccccctaccatattgggctggttgtgttgtgttcttgtgatacttgcaattattttcccaatgcttgacagtagttgacattatctcagcaattgagctttcagataaatgtgcgtttcgaatgaattgtta

SEQ ID NO: 4881 - DNA, 521 bp, Glycine max
taaaatacaagtagcagaagataagaacttaagcctttttaagaaattccataacatgtgtgttgagaacacaagatgctattcggaaaccatggaatccagctcctttagccaaggccttgtactctttctctgttctctcttttccatttgggctatgacacaacatgataacatccatttgaaactcacaccttgcagctaagttagaatctggggtttctggactaatgccttcagccaaaatcacttttccagtgtcgtcaggaagggaatcataacaattcttcaacaatttcaagcattgctcatcattccagtcatggcatacccactacatacaaaaattgtattgtcatgatatttattgaaatctaacattttaacttggtttgactctttccaaatataatcaatataaaaacttgaaaatggactgattagcgaatgaacatcttcatattaataacataccttcataaaaatgacgtcaccttttggaacactaacaaacatgtctc

SEQ ID NO: 4882 - DNA, 378 bp, Glycine max
tgctctaattatctcaatactctctctctctctctcatcaattaaaacattcacaaattaaataaccccatcagtaaaaatatgaaagaaagtaaaaaagaagaagaagaagaagaaccactcagatagatagctcattaggccatagcatgcacaggacctggggtcaacagcgccgaccctggtgtgggagtgttcataggcggcgccgccacactaggaggagtcggaggggttgtttcctccggcggcggcggagactgcagaatcggcggcggcggcggcaaagatgggttattggagtaaggaggaggaggaattggatttggaagctgaggagtttgtggggtagtggggttgttgtcaattggagaaggt

SEQ ID NO: 4883 - DNA, 412 bp, Glycine max
cccataaagtttgataatggaaactactcagcagtctcaagtactgtagcaaatggtaaacaacatgttcccatgcagcaagggaaacaacaagaaggtaataataagaaacaaatggatatcaatgaccatttcaaagatttcattcaaaatacaagggagaagatgatgagaagcgtcacaaacattggttggactcatcagagcaaccatgcggctgcacctgaacatggtgaggctcagaacaagaacgaaagccatttttctgagtttattcagcgtgctaggaagaagctcagaactacaacaactgttagaaagaataataattagtccaagaaagagtaagactcaccacaaattaagaaaggttaattattagtattgatgtttgttggtttggtgttggaaa

SEQ ID NO: 4884 - DNA, 409 bp, Glycine max
tcgacaagagcgccgacatgttccccgagtcgagttccgggagtgacgtcatcatcggagtcctcgacaccggcgtctggccggagagcaagagcttcgacgacacgggacttgggcctgttccgagcacctggaaaggcgcgtgcgagacgggaacgaatttcaccgcgtcgaattgtaacagaaagctgatcggagcgaggtttttctcgaagggtgttgaagccattcttggtcctattaatgaaaccgaggagtcgagatcagcgcgcgacgacgacggccacggcacccacacggccagcacagccgcggggtcggtggtatccgacgcgagcctcttcggctacgcgtccgggacagcacgtgggatggccacgcgcgctagagttgctgcatacaaggtgtg

SEQ ID NO: 4885 - DNA, 361 bp, Glycine max
tacctcgaagaggcagcagcaccctgtgttgtattacaaacacatactacatgcacttttctttcttttctcttcttcttctatccataatttcaattccatttgctctctggaccgagtcaggcggcggcgaatcggcatgactcggcgctgctcccactgcaccaacaacggccacaactcccggacatgcccgtcgcggggagggggcggcgtcaagctgttcggggtgaggctgacggatggatcaatcataaagaagagcgctagcatggggaaccttaacctctcctcctcctcctcctccgccgccgccgcacatctgcaattccgttcatctccttcttcttccaacctccca

SEQ ID NO: 4886 - DNA, 396 bp, Glycine max
cccaatcccctgcggctgcgccaccgttgctccgccgcatccacaacctcgacaacgcaatctccctctacatccacaccctgacccgccccatcgctccacgtcccctcctccgcttcctagagcttttggcggacttccgcttcttcttccccgtctccctctccctctaccttgccgctccctcctcctcccctctccgccgcaacctcctcctccccctcatcctctgctccctcctcgacctcctcttcatcgccctcctcaaattcctcgtccgccgatcccgcccctcctactccaaccactcccaatacagcgccgtcgtttcggtcgacaacttctccttccccagcggccactcctcccgcgtctgcttcgtcgcttccgtcttct

SEQ ID NO: 4887 - DNA, 398 bp, Glycine max
agtaacctttaccacaaaatgctatatatccaaacgaagggggccctagcaactcataatgaaacactaagctcactttgccaaacatcaggagactttcttgttacttttagagtagatgccagcatgatatgcgtgcaaccttgaaagaatgaaaaaggagggctgaaagtgggaccgcagttgcctaatgtgcatgcattcaatcaccaagagagagtgcaacacttgagagaaaaaaaaaagtgtcctcatttacagcaaagaccctccactaccatctccatcacttcaatctgtgacctttaatctccaaaaaaagctacaagataatcatgttggtcaacaaattgaaaccccatatcctgcttttttccccaaccaaagggccaaagggc

SEQ ID NO: 4888 - DNA, 376 bp, Glycine max
gacgtcgccgagaccctcggcggcgccgcctccttcatctccgttatcctcgatgccctctcccttcccttccacaccgtctccaaggtgggccccaacttcgcctacaccgccgacacatcgaatcaccccccgttaataatcccaacctcccaaaccacgctcttccacgctcacttcggttcgggccacccggaccgcctcctgaaccgcgtccgatcctgcgattcaatccaacccaccgacctcccggaccaacaaccccggttcgggttcggactcgcggtcggggtcggcggtgagattctcccggagacagtggaaaaaatgctctcgatctgcgaccacgtgttcgtggacattcaggctctgattc

SEQ ID NO: 4889 - DNA, 393 bp, Glycine max
gaaatggatcagaagacacggctgatgacgtggtcattgaagcctctggcaatattggtgctgttgtaacagaaagtgggaaaactgtaacacaagagaaggctggcatgatccagtcaactgggaatttagcagattttaggaaaaatgaagcagcagggaaagctgtttacatggtcattgaggcaacaggggatgttggaggggttatagcagatagtaggaaaaatgaagcagaagagaaaactgatgacatggtcattgaaacaactggaagtattgatgcagctgaattagatagaagaaaagctgagccagaagataaggcagagaaacagccagctaatctagattcagatggtaaacaagcggaagcaaaggagaagacaaaga

SEQ ID NO: 4890 - DNA, 402 bp, Glycine max
ctcacctcgtgctggctcagaaacgagaaacacgtgctggatcgcctaggttcgtgtccgaggataattcgctgcttcggagatgactgcagtttcgagaacggcgtcgagtactacaatttgttcctcgaatacgccgccggcgggagtctcgccgacgaattgaggaaccacgatggcaggattcccgagcctcaggctcgggaatacacgagggacatcgtggagggtttgagccacgtgcacaaaaacgggtttgttcactgcgatataaagctgcagaacatcctcgtattcgaggacggaaggattaaaattgcggatttcggcctcgcgagggaggcaggggagagacaggggaagaagagtgaatgcagggggactccgatgtttatgtcgcca

SEQ ID NO: 4891 - DNA, 397 bp, Glycine max
taagaataagagatttaatggaatggatttggcaggaaatgagttgaaaattgtgaatggcatggattcaatgaggacggcagttgtgaagtcagaatttgatagctcttctcaatttgttaatgtacaagtttcaaaattgtcacttcctattggagaggaattcaagctggagatagaaatcaagtagaagggtactttaagatagcaaattcccacaaagaatttgtgctctctttatagttgcatcgttttggctcttcgttttatcactgctaaggttactatataaggatgtcattttcccaaaccacgacacaaacattcataaaatgtcatattttgtgtcaggaataaattttacagaatattgtcaacatggctatgaagttcaaga

SEQ ID NO: 4892 - DNA, 663 bp, Glycine max
tatgatcattgggtagtggcaaaaaatgaagaggaagctcagaaagaggctagccagaggtataatggaaagcagtttcatttaagccaggatcctgacgttcttgatacatggttttcttctggtctgttcccattatctgtgctgggatggcctgatgacacagaggacctgaagacattctatccaacttctgttctggaaactggccatgatatcctctttttctgggttgcccgaatggtgatgcaaggattgaagttgggtggtgatgtgccttttacgaaggtgaggttactatctcatgcagatcattttgtgagaactttatccttgtttgagcgtaaggaataatgtgttacttggtgttctcacatgtgaagtgtgaattctgatcatgcatgcctaagatttttctttttcttgttttttttaaaagaaaattcattaagacagatgaagattacaaagagatataagagatcctctgtaagagagagagtaaagaattaaatcatcatttaaggaaagctaaccaagcactcatgtataacttaaaaaatttgatcaatgaccttctcatggatgtacttacaatcctatgcagatttatttgcatcctatggttcgtgatgcacatggacgcaagatgtccaagtcctt

SEQ ID NO: 4893 - DNA, 400 bp, Glycine max
tgatatacacagcaatcggagctctgaaggagagggatggttcgagcaagcgagccataggaaagtacatagaacaagtctacaaggaccttccacccactcaccctgctttgttgactcaccatctcaaccgattgaaatcctctgccctcctcgtcctcgtcaagaaatcctacaagcttcctggatctcatcatctgcctgcgctccagccccaaaagacccgtggtcgtcctcccaagcccaagccccaccccgtctggcctgctgcagccctcaccgacagccctgctcttctatccgccaaaagaggccccggtcgtcctaaaaagattggtgtcagcccgccaggcccaaggggtcgtccacccgggactgggagatctaagctgcccaagag

SEQ ID NO: 4894 - DNA, 635 bp, Glycine max
ggatggtgtgccagtttatgggaaaaccatgtatgatttctacaatgaatattggcgtccatttggtgagcttctagtcatgatggaatctgagggaatgctagttgaccgggcttatcttgaaagcatagaaaaggtggccaaagaagagcaagaggtagctgttaatagattccgtaaatgggccactaggtattgtcctgatgcccagtatatgaatgtgggaagtgattcgcagttgcgccagctgctttttggtggcattgtgaacaggtgcacattttttaaatcttacctgtagcatttatttcaatcttaaattattgatttcctagtcaaagcgtgaaatatttatgatattcataagtttaatgtattcactattcatgaatgatggtactactactggtacctaccttgatatttatgaacttttctgtttacaacaaagtagctgaaggatatagatggaagtaaaattttcattttcacttgtcacatgcttcattacagaaaggactccaatcaaacgcttccaactgaacgaatattcaaaattcccaatgttaataatgtgattgaagaaggcaagaaggctccaaaaagattttgtgatataaagttgacgagcctag

SEQ ID NO: 4895 - DNA, 470 bp, Glycine max
gatccggtccaatcttcaagctccagctcgggagcaaactctgcatcgtgctgacttcgccgcccatggctcgcgcggtgctcaaagagaacgacaccgttttcgcaaaccgtgacgtccctgccgcgggccgggccgcgagctacggcggatccgacatagtgtggaccccatacgggcccgagtggcggatgctgcggaaggtgtgcgtggctaagatgctgagccacgccacgctggatacggtgtacgatctgcgccgcgaggaggtgcgcaaaacggtgtcgtatttgcacgaccgagtggggagtgcggtgaatataggggaacaggtgtttattttcttatggacaacgattaattgttagtttttgttatccccaacttttttcgctttctttcttaaccacttaatcaacatgcaacaggtttttctgacggtgataaatgtgataacgaacatgctgtgg

SEQ ID NO: 4896 - DNA, 412 bp, Glycine max
ttaaatcaagccaaacgcgagcccctgtgaaatccttcgccaaaggaaaacaccagataacgacgaaccatcgagcaacctccatctctcgctgcgtccaaaacaactacagtcatcgctggaacctcatcttcatcgtcactgtgagccacacctgaaaaccacctccccttccaatgcctgagacgaagagcaatcgcgcaatgtttcacaggagcaatctatcgcacccaccaaagccgccaaatgcgagcgcaccgccgtagatcgttctccttccctctcttgctcttcatcttgtattcccattagcgataaaggtagaccatcgcaatggtggcggcagcaccaccgccttgtggcgcgggtttgacagaggtgcggtggcggcacgggtttgattgttagggtt

SEQ ID NO: 4897 - DNA, 979 bp, Glycine max
  misc_feature (738)..(740): n is a, c, g, or t
  misc_feature (742)..(742): n is a, c, g, or t
  misc_feature (753)..(757): n is a, c, g, or t
  misc_feature (785)..(794): n is a, c, g, or t
  misc_feature (801)..(805): n is a, c, g, or t
  misc_feature (818)..(826): n is a, c, g, or t
  misc_feature (828)..(830): n is a, c, g, or t
  misc_feature (832)..(832): n is a, c, g, or t
  misc_feature (837)..(839): n is a, c, g, or t
  misc_feature (859)..(863): n is a, c, g, or t
  misc_feature (865)..(865): n is a, c, g, or t
  misc_feature (867)..(869): n is a, c, g, or t
  misc_feature (884)..(884): n is a, c, g, or t
  misc_feature (887)..(892): n is a, c, g, or t
  misc_feature (895)..(895): n is a, c, g, or t
  misc_feature (901)..(915): n is a, c, g, or t
  misc_feature (917)..(917): n is a, c, g, or t
  misc_feature (922)..(925): n is a, c, g, or t
  misc_feature (927)..(955): n is a, c, g, or t
  misc_feature (959)..(964): n is a, c, g, or t
  misc_feature (967)..(970): n is a, c, g, or t
  misc_feature (972)..(976): n is a, c, g, or t
gattgtgacgaatctgacatgaagcgtggagcattgttgtcagtgcttgcctgcgccttcgcggcggtgatctgggcagcgaacggcgacgacaacctcgtcccgcctcgccgggaagtgtacggcaatgggcgaatattcgacatcagtcatcggtaccaacccgagatgccggaatgggaatcgaatgacggcatagggcagttcctgtggcttcccaagagcatgaagaacggttccctcgccaacaactccgaaatgaagtttcccacccacaccggcacgcacgtcgatgcccccggtcacgtgttcgaccactacttccacgccggcttcgatgtcgacacgctcgacttggacatcctcaacggtcactcttcttttcttgttcatttctctattcgtcaatatcttagtttgcatcatattatctctgttcattaaaaagtctctcatcgcttacaagttaagatagtttataaacactctcatactttaatatcatgttgttgccgttcactaaaaatagttcacctagcttaggaacccaagtcaaagatagtttatgaatactctatttaatccacttaaataccttttaaagataaactcaaatgagcaaaaagtggacaatactcagatgaaacctaaggatgtagttgactggaaacgtgagagtacaattatgaggtggaatcccatgtcgagtaagtgagacctataaacttgagcggtttnnngntaaaatgtggnnnnnagttctcttatgtgatgtctcgtgatcnnnnnnnnnntttactnnnnnccatttttccacnnnnnnnnntnnnanaatgnnnctaccattccttaatttccnnnnnantnnntgattgtttctgtgngcnnnnnntgntatgtnnnnnnnnnnnnnnnanaaaannnnannnnnnnnnnnnnnnnnnnnnnnnnnnnnagtnnnnnnggnnnngnnnnnggg

SEQ ID NO: 4898 - DNA, 766 bp, Glycine max
ctgtactttctgataaacgcaatttgttaaatgcttatgacctcctacaggctgaaaaggagtgttcagcgataagccttgactgttgtaagcaagaaaagcaagaacttgaagcttctcttgtaaaatgcaatgaggagaagtccaaaattgaagtagagcttacattggcaaaggaattggttgagacttcccgatctcatgtgaattctctgaatgagggcaatggtgcattctcttcatttaatcctcaagaaaattctacttgtgctgcttgcagtcatgagccagagagtgcaagcatcaatatgcaatccgaggtaactgatttatttatttgtttttataaaacatctctagttaccatttcataaaagaagaaatcaccttatctctaggatgatatattgatacaataataaaaatttattttgattgcaaaaaaatgttgattatccaaacttctaaaggttactagctgttatcagagtccagcatgatattttaattaagaaaggaatcttagtctttattttagtagtagttgaattattctcaaactctggaactgagtatcatttgaagaaaaatttatgtaccttctattaatgtaatatccaatgcattcattccttcgttgatcttaagtggtaagctttaacaatttatttgtataattatttgataggatcctcttgcatttagtgttatgaatggatgccaaactcttggaactgaaaaggacttgcaactagaagaagtaatg

SEQ ID NO: 4899 - DNA, 403 bp, Glycine max
gcccttccagacttagtgaagaccagtgtactggcaagggcatggaggtatatgtggtcgtcgaccccacggcgtgaatttagagatgacttttttgagaagtgtaaccatcttggataccttgaaacttccgccattattacggaagctcttcttctccacaccggccccatacacgtctttgctgtcatccctcctccgcactatcctatcaaattagaatgcctcaacaagtggattctgtttttgtcgaggaaaggggttaaatatattgggcttgcgagtgaacaagaagatccctattgaatgccaactcatattttctcttgtagggacttgatttaccttttacttaataattttagattctcagttgcagctactttccgtggctttccaagta

SEQ ID NO: 4900 - DNA, 580 bp, Glycine max
ttcgataaagtccgatttctcggagcaagtgttcttcaattatgccatctccacttctgcttttcctttcggatcctcggctatcgttaatgtctctctctctttgaattttcggatcaaattctttatttttacttaatctatttattttaattttttttttgttttttgaaaattagatttctggtacagctgatggcgaagcttcgggcgctcaatttatattgcagtacatgccgagtcgtgataagaattgtttcatcaattatgtgtaagattcatgttctgcatttttatttttattttcattttttgcaaattactcttttcttcaattttttatgtggtctgtttgtgcattcttttaattaaaaatagaaggggggaaaaaagtattgatgttttagttattggttgggtttgttgttggctgatttggaaattggaagtaataaactcttgttttgtttgcagaaatgaatatattttggatagtggtgaaatcactactaggagtagtgatcctggtattggaagcagtgaagataataatgctgttaatgttagaattacatcatca

SEQ ID NO: 4901 - DNA, 942 bp, Glycine max
  misc_feature (880)..(885): n is a, c, g, or t
  misc_feature (893)..(895): n is a, c, g, or t
  misc_feature (933)..(934): n is a, c, g, or t
acttattaggaaacctaatattttaagcctcaccttctggcattgttcttttattatgaattttgtcaagtgcaacatggataaatatgattcttcaatcttttgctatctattttgatggaaaaatttgtgtgtgcggcaggtttagagaaaccttgtaatcataaaccatggtctaatgatctatcgacaaatcttttagttgttgttgacttgctagtcaagcaacttctctgcttctgaagtccaaagtactatatagtagcatgatttgtacaattatgcttgtagcctatttgagtagagtataataatctctagcctgtggctcacatctctgcccattttaccaaggcttttcaagaccatacttgcattgctcccaattcctttctgttgcagtttatatatcaaatgtaatcacatatcatattagtgagaatttgaggctaaatttcagaccaactgatatgtgtcaccccacaagacttattggaaatgcatttggtgcctaaatagacaaatacaaaagatagttttttattaacaaaaaatcttgcgttgcccattttatactttttcatataaagagcttggcatgttctctgcaggaaaaggatctagcactggctgctagtagatttgctgagtgccagaagaccattgcatctcttggacaacagttaaagtcccttgcaactttggaagactttctacttgattcagacaaccctatggagtcaacttgtgaagtcacaaaaggtcaccaaaatggtggtgaacatttgaaaccacatcatagtgatttgagcttgcccaaaaaagattgtgagtcacccgtttggttaaactcatcaattaccaatgagaaaagccgtannnnnnggtaagtnnnccctagaagcaaaagaggaactcactgaagggaatgtnnagaagctg

SEQ ID NO: 4902 - DNA, 496 bp, Glycine max
accctcaaaagctgattaataaaatcgtggtggaataacaaaagcaaatcacatattgtgacttgaggtttgcttcgattcttggatctcagattaaagtactaaagaagaggcttttctaaacaaaagaagaagcgtgcaatggtgggatgaagaagagagcgagagagggaacatggcgagagggaagtgggtttgttcctacaagaaaaccactctcttagtttgcttcttcaacattgccgttgctctctacgctcttcactctctctattcttctctttatatctactccggtaacgtttcccgcaacggtaagttactaactaacatcaatcaatttcctctttatgcttcattgtaattgtaataataacggttgctgcatgagggtttccttttcagttgcgttgtatagcccagatcagattcggaaaatggaactgtcaatccaaatccgcggggaatttaaacctgtggagttaattaagtgggt

SEQ ID NO: 4903 - DNA, 759 bp, Glycine max
tcaaggtagatgcattacttcttttacattatttagttccaaacggctacttgtttgatgtaaataggttaaattttaataataatgcaggttagaacctgtaattattgaacttgagcgacaacgagcacctgttgttgtgatatctcaccaggttttcacatgacttagatgtaaacttgcccttgtataggccctactatggttgatttgttttaattcttgagtttgttcattacaggcagttttgagggcattatatgcttattttactgacaggcctttgaaagaaattgcagatattgaggtaatatattcgtatttagctgagcgtgatgttcttactctcgtgtgaaacatggagttgatgaaaatgcctaattgagttcatggcaaatatttaggaaataaattttagttattttggtgttagaaaaaggaaaatctgtgaggctcaccatccattttgtgaaacgttttaatgtaaatcttgaatttgcgcaagatatctaatgtgagtttgctcatttacagatgcccctccatacgataatagaaatacaattgggagttacaggtgtcgaagagaaaagatacaaactaatggactgaaatgaataactgaaggagagaagaaactggaaggaaagaatagatttaagtcagcattttttgtttttatgagagaagaataaatgatgattatcaatttatcgtgtatattgtaatcttctaaaacaaccccttttaataaatttt

SEQ ID NO: 4904 - DNA, 736 bp, Glycine max
  misc_feature (683)..(683): n is a, c, g, or t
tcaggtataatattatcatgaaactagctcctcatttctgaggaatgggtggtgggtgggtttgtttgccctatcatgaaatgggtaatgggtatattcacatggtggatgatgagtcagtgaggaggaaatttatcacagaatctttaaattttaaaatttaaaataaaaatatgtacttaatagaaaaggaagagctcatctgaaatcatgatcttgacgtgaatcctatttcatgatagatctttgctcctaactaccctccccccaaatggcaatggcaaaaataggtagatgattgtaatgtcactgtaattaattttattgcgggtttcagaagcctacaatgattatttcttaattttgcagaatcgtcacgagaaggcagtaaaaatctatgattagagaaacgtttcatcttgaccagtcattttaatggcaccatatgccagctgcacttgaagcgttctgaaggagagaatggagaagctaccaatcttctaaagggtagtctgttgaaaaccataattttcttagctgagatggtggggggtggtgtatagccttcaatagtgattaaaactcgtcttttgagcaaacaaatctttggttgttaggaggttgaatttgaaattcccttgtcatttggtacataacattttggggttgggttttgtataganggtataggaatgtaggtatagttaaactcttttctatggcccatttcaccata

SEQ ID NO: 4905 - DNA, 357 bp, Glycine max
tctcgattttgaccctaaagcaaagggatttactcaaaagttttactggatttcgtgttttttttttcttttgattttttgcattgagtagaccgaacatgagtttgtgtcattgtgtttgagatctggggttgatattttttggtaaataaaaaaacaagataaaaatttattcttttgagattctgataactatcttatccttttcttctttattttttttaatattctcttgtgcttttctgggagcgtaaatgtctagataatttttgctgacatttaattttgggaaatgggtcagtgaatctaggctaagttcttcaacttgctgaattgggtttgatattgaaaaaaaac

SEQ ID NO: 4906 - DNA, 1152 bp, Glycine max
tgtcagcatatttaatccacaaaatgctctttttgtggcatgcccaaatgatcaaaggagatttttcccttatcctggtaactttctcctgaaattctgaatggattttttttcttccttcaatacctctgctgtttgctatgcatttggaatgccattgagccgaaaatgtttgtttgaccaaggcttgcatttttcttatatgaaaatacttatacaatatttacaaaataatctttattaggattataaaacatgaggcttaatatgatcttatttttctcacatgatccttgtgttaacgcccacatagtttagtggaagtcatctcatttagttgtgcatctttactcattagttttcttaaatgaaatgcactcctatatcctttttgtgaaatccttggatttttagtcttatgaccaagaaggacattggaagaagttgtcaagagggatcttatggtaaataatatctatatgacactttggtctttaaacgagccaaatgacattatgtgatccatttagttgatctcacctaattggataaaactttgttgttgttgttgtattatcttaagctcccttcagtcaccttattgaagtatgatgcaatggctccttgtctgttactcaaaattcacatgttccattatcacatgtaaatacgtaggtcaaaggctgttcacattaacatattcaaatttacccttgtaaaaaaaaacattcaaatttacattgtgtaaccatcatgttttaaacttgagtgcctagttagtattaatagggacttgggttgcttgtgcatggttagtgttcgtatttttctatggtgttgtatatcttgtattagttgcaatcattattatagcatgtctggataatcgagtttagcttatactttgtgtacttgcttgtagcatctaaggtacatcctctgcaccttgagtacttcagctttgctggtcgagttattgcattagctttgatgcaaagggtgcaagtgggtattgtttttgatcgtgcgtttttcttgcaattggcgggaaactctattacattagaagatataagggatgcagatccttatctgtatactagctgcaagcaaatatggatatggatgctgatttcatgatcagatcataga

SEQ ID NO: 4907 - DNA, 412 bp, Glycine max
ttcttgtaaagtacggttgcagcaaatcgatgtatgaagctagatgtacaagccataattgcttttgggcttttgcttcctgcaccccataaaaaagttaaaactccatgactagataaaattacccttaggtggcatttggtaaggggattcttttaagttttctaagaatcttagattgaaaatcttaaattcctacatttggtatgcatattttaaaaatcattctcaggaatctagcattcccaagaattgtttttaattgagttttcccagaaaacaatgtgttccgaaataggtgtttcgaaataataccttttcgaaatgcctgttaagcttacggaacatgtgttacagaatcaagtgacattttataaaggtactctgtaacacttatgccgggaattatgcc

SEQ ID NO: 4908 - DNA, 479 bp, Glycine max
tgttgatgcaaggagttttagttgggcagtggacagtgcgataaagagtgagactgcgtcaattttgggagaatcccgaatccatagtttttgttccgtagtggacaatgccataaggagtaggactgcatcagatttgggaacatctccttcccctgtccatagtcttgcttcggcagtggccaatgcaatgagcagcagtagtgctgcaccattttcacaactggaaacgtctccttctcctgtccagagtcttgcttcggcagtgcccagtgcaatgagcaggagtaaagctgcaccattttcacaactggaagtggtgcccaacgccactagacatgttcctgcacgattattcacctgggctgagcttaaagcagccaccaacaatttctcacctcacaaccggattcgtcattttggaacctttggctttgggtacagaggcaaactcgttgatggtcgtgaggtcccaatcg

SEQ ID NO: 4909 - DNA, 380 bp, Glycine max
gttcgttggtgatccccggcctccaccacgatccacaccagatcgtacggcaccagcatcagcgcgtgcatcacaccggtcaaatgcagcgtctggaacgtgcgaacgtgcgtcggcgtcaccgcgatcaccgtcctagggtttttcactccgaacagcgccctctgctctctctgcactctctcgattatgcggtgcgccttcatcacctccacgggatccggatgcggccacgggcggattcggatcccgtgccgcccgactaccacgcggctcgcggtgctcagcatcgccgtccggttcgccgccggaggaacgtcatgcggagccgcgatttccgaaccgctccggaacggcgcggtgtagaggcttgtcgagaa

SEQ ID NO: 4910 - DNA, 216 bp, Glycine max
acggctctgggtgccagtccggtggctgctacaaagacgaagacgcaacatgtaagcaaccacccaagtccgaagaagccgattcaaaaaaccctagcaatgtctgcatcaagtgcaagctcaacgacgccgtttcgggctacggcggaatcgacgatggtcgtttctgcgccgattgcttcaaaaccaacttgttcggcaagtttcgtttcaaaa

SEQ ID NO: 4911 - DNA, 390 bp, Glycine max
attgaatatataaaaaacgtatataggttgaattaagttgattagaatggtgtgggtaaaaggaaaagtgagaaatgaatggatgaattagagtagtaaagtaccttgttcaagccagggatggtggctgaaagtgcaatgaagctctgggtgagttgctgtctcctttttctttcagccataatgtgggaagctcttttagccctctttccaggttgggcctctagggtggggggggaagaaggtgctggtgttatggtggagttatcaaaagacaaaatgtatgtcatcggagcccttttgcttttggcagagcatgagacaactggtgcttgactttcactctcggaagaaaaagccggtttactaaggatgtcgcgaaggaactca

SEQ ID NO: 4912 - DNA, 400 bp, Glycine max
tctagaaaatatgggaaggataatacaacgaagaaaaatgtagcaaatgatgaactggatgttgacaatgtgtctgagtggccagacatggatgatgatgacgatgatcagaatgatctagcagagaagggtacattcaatgaaacaatttcggattatgatgctctgaacttcgaggatcccgagttggaggaaattatatcagattagtgaaggtgctttattcagtgctgatgtacctgttgacttattatggttctttgccagctccatttgacagctgcttataaagctcaaaaacaggaacagaaaaggcacgtctttctcgatactggccgaactatagtaaaaagacatctcaaaaatttaatcatacgttcatcttctgcatttctaagga

SEQ ID NO: 4913 - DNA, 981 bp, Glycine max
  misc_feature (22)..(24): n is a, c, g, or t
  misc_feature (960)..(976): n is a, c, g, or t
  misc_feature (978)..(978): n is a, c, g, or t
ctacttaaggcattgaaggaannncagaacaatacaggttagaacattgtgtaattattgttttctttatcttgtttttgtgattcctgcttcaaatcattagcaaaaatggaagaactattatcagtcccattttgaataatttgcatttgaggttaattttttgagtttagtttatatgcactaacaatcctttacagcttcaaccaattataaataatgatacgtataattttaaggtaacttttgtaaaagtcattaaacttgtcatatatgtcaatttttttattgaatgatagtataaaaactctttacactattcgtatgtagactattttctctatttttttttatgttacattaaatgatgttttatacagaattgatgcacgaaagttggaagagtgggctcgagttcaaagtccaacttctcttgttgagttttcatccaaagaaggagaagctgagaggattttaaaggacattgcagaaagggctggggggaaaggggaattcagttatagtcgtttctttgcagttggactctttcgtctagttgagttggcaaatgccacggaaccaacaattttggacaaggttaaccaattcatttaagacttattattattatgacttggatttattcaaatactcatttcattactgtattttgtttttgcaatttgaagttgaagctaccaagtctagttctcacttctcatctacacatgttttagcaaattacaaatcaagaaattccaacatattttgaagtgcttaatagattttgcctgataagttatcatccaaggatcgctctcatatcatgattgtaaaaatttctatttcatacatccaaatgaatctttggtgttaacataacagctttgtgcggctttgaacatcaacaaaagaagtgtcgatcgggacttggatgtgtatcgtatcctgcttcaaagnnnnnnnnnnnnnnnnncnccc

SEQ ID NO: 4914 - DNA, 323 bp, Glycine max
ggattgctttttacagtggctaggttcagatcactatgcaagttaaaaacaagggactaaaatcaaagtctttttaacacatggaattaacctaaaagaaaattaaaaaaaaaaagaaaaagaaaagagtaattaaaatccctctcctcccttcacccccctcctaacatgtccacaaaaaacagttcacgtgaaccgccatgaaaagctaccaaccacataataatgccaacctttagattcatgatgaattctggttgatccactgcttgtgtcccggaacccattttggacattttggactaaaatacttctccaccacc

SEQ ID NO: 4915 - DNA, 356 bp, Glycine max
  misc_feature (319)..(319): n is a, c, g, or t
  misc_feature (350)..(350): n is a, c, g, or t
tactcggcatttataatgttggaccacctgtgccaacaagagttccaaaaatgcttagttttgtggacacaaaggaaatggttaggggtcctgaggacctaccagggtattgggtggtgactggggcaaagctgtgtgtagagggtggtagaatctcaatcaaggcaaagtattcattgttgactatattgtcagaaggatgtttgctgtagtgagaagttgtaggaagttagttaatactgctattattttgctgtaaatatcttgtaccaatataccatttatttattgaagaaaaaaaaaaaatatagggggaagngtcatcttgggctaatgggcttgagaatggnaatttc

SEQ ID NO: 4916 - DNA, 599 bp, Glycine max
tgcgaagatcagaagcgcgtgcacgaaggaactttacagaagcggatgcattgcacaaacagatcattgattcaggatatcggttcgtttgtagttttccaattccttatatctatgattccaatgctccaaatttttttttctaattgtttgcttacttagggtgattccggttcaaaacgaggaaattctagccaagaagtataggattcggttaaggtaatgactctacaagcactagtgttagagtgtttaagttgttgttgtgggagacactaatgaaccctggaaacaaaataggggaattgatgcaccagaaagtgcaatgccatatggaaaggaagctaaaactgaactgaccaagattgttcaaggcaagcctttgaggatccttgtttatgaggaagatcgttatggtcgttctgtaggtgatatctattgtaatggcatttttgtacaggtattcattttatgtgtacatgttgtcatcttgctcttaatctataaatgtttctactttctaagtttctcatcttgcttttctgttgtgacaaaggaaatgatgttaaagaaaggtttagcatggcactacgtagcat

SEQ ID NO: 4917 - DNA, 1124 bp, Glycine max
  misc_feature (1110)..(1111): n is a, c, g, or t
  misc_feature (1113)..(1120): n is a, c, g, or t
gccaaaacagaaaaaaagtaaaaaaacatcaaattttacttcatagaacagaattttacagaaattgatatcaaacatgaaatgctgatgtgaaaaaaattgaacttaagggttaagaatacatgtaatataatttttacttgcacaaacccaaaaaactcattgaccaaatggcagcgcctgaaattacttctagaatgtaagtctcatttgcaaagttaccatttagagcatcctattctaaagactgctttcaacatcacacacgttaaacaatttaccttgcaagtgaaatccgaaaatcttgtctgaactgaaactcatcatcatattacaactatttcgaagttctatgattttccattccctctcccctcataaaagatttaaaacttacgtatagtttacatccttatatgtactcatacacatgaaaaatatatataccttctcaatcaaaacaaattacgaagaaacaaaaaaataaaattaccttcttatcatccacagtttccacacaagcaaggttgggcacagcagctgtgaatcatcaaacaaaacgtataagaattctcacctcgcctgaacagtgaacccaaattaataatgttgtaaataagaacacatcttcacaaaacaaaattctcaaaaatcaccaattagaaaaagtgtgctcgtgtttctaaatgaaagaagtatttttaaactctttaattgaacgaaattgagagaataagtaaacaatagataccgataagaggcttgactttgttgctctgcaaatttccgatgagatgccactggatatcgtcgggaagctgcaattgggaaaggaaatgtaagcattgatgaatggatccaaaaagcaagagatgaataacgagtttgaagtttgaactaactaacctgtggtgccttttgaaggagttcttgaacgtagttctcgccgaagcatctaaggccggcgtcgtatacctcacggagagcagaaactggcttcgtcttgctcgcagccactacacgaatctcttgcacattacggccagagcgttcggcggctgcttggacgcggtcctgcaccgccttcagcggcggcgatgggacgacacnncnnnnnnnncccc

SEQ ID NO: 4918 - DNA, 390 bp, Glycine max
ctctccctcccggtgtcttccacgaccactctccgacaagcgctgccgtcaccggtgatctcttcggcgccgacaacgtaaccccccgcgagctctccaagccaccacaaagatcagtcgggaaccaccgcaccactaccaagctccgccaccaccatcacgagatctaccagaacccaccacaagatctgtcggaacacaccgcaccgccagatctgcttcactagccacgcgaaccgccaacgcagctctgtttccaagaagaacaccgttcaaacccatggtggttgacggtgacgccgacgaaggtccgtgcggcggacgattcgtcaaagagcattgcacctcttaaattcttccccgatgatcctctttccctcaatctcatca

SEQ ID NO: 4919 - DNA, 378 bp, Glycine max
gaagtcttgatggtagattgtaatatatctttcggaggttcagattgtgtcattgatgcttaaaatgtgtttagcacagaataccctaatgttatatggagaagaaaaaaaggctggataattattctcttttattattccgctccagtctctactaaataacattaatagagttttgtttatacttttaagttgttggtaaacttggtcattgtaacttcctttgttataaattttcactagagaaaaccagctgacttcttgaactccactcgattgaattgcatgacctgatgcttcttatccaaaaagcttggcttttggcatgaaaaactgctagttggtatagcacttgctacttgccaaatgtttattgcc

SEQ ID NO: 4920 - DNA, 589 bp, Glycine max
actatgacattaacaaatatcattcaagaaaaaacttattaattaattgatatgggaggtagctgaggtaacctttaatagtaaaagtggtttgtatccatttcttatagatgaagtgaaaccttggggagtctctctggtgagtatgagtatctgacaagagaacccttgcaagaccctttttgactgccacagaatttagaaatgaaatgaagccaattaattaccattcattcgcttgtcgtcaaagaaatctccgaaatcatcaataagaacagctgcaggcaatgcatcatacaggtggaaggcagcaaagtacttgcgaatgtcttgatcatcattcacgtacctgaaaacaaagagtgaacaaatttgtagtgaatgatacagtgagtagaagggttattatgttaagggagatacttcatttgtatacggtggaatacatgagaagaaggatcaataccctgaaattaagaaaaaagaagggaaaatgtaagagggagagagatacctgagaaagaaaagggggtttggaatccaacctaaggcggtagcaaatgaagatgacgttgttattggagtggag

SEQ ID NO: 4921 - DNA, 366 bp, Glycine max
cataataatattcatctttctctctactctctagtgctgggacttgtctcacacatggaaactactacgtgcgtaggataacaaccaacaaacctagcgcacgatagccctccatcacccatgcttggagtactctgcgccactcgctccaaaccttggctcttctccctcgtccacgcctcccttcctcgcctatcccatgcccctctctcaccttccgcctcgccgccgccccgtcgccgccattccaccgcctgcaaactctttctctccgctggcggcgccgcctccatatggcacgccatcatgccccgagtgaatgacgacgacggattccgacgcggcgttgttgcgtttcatgacata

SEQ ID NO: 4922 - DNA, 300 bp, Glycine max
atgacgctggacactacatacatccgaggatccatggcggcgatcctctcggtcctccaacactcctcgtgcccgcagaacacattcttccacttcgtctgctcctcgagcgcgtccctcctacgcgccgcgatctcccactcgttcccttacctgaacttccagctatacaccttcgacgactcccaggtctcgggactcatctcaagctcaatccgctccgcactggattgccccttaaactacgcgcgctcctacttggccaacctcttgcccatctgcgtgaggcgcgtggtgtac

SEQ ID NO: 4923 - DNA, 354 bp, Glycine max
gagagacagaatcttggtaattggtatcctcagcttaaccatgaccgtcaaattaattaaacacctttttcttcttcttttatttggttctttgtgtccattagaattatgcgtaaataactagcagctaccttgtctttctctactcctttattttattttatttgttttcttctcaaaatctcaattgtggttttgatcgatattatatacagctatatacgaattagaatcctggagggttttcgtttcgacgtacgtttgtttcatcgtaatttgtgtctctatttggtaaactagagagctacatacatacaatggcagcatcatatgatcagtttgtggttcgtgtca

SEQ ID NO: 4924 - DNA, 393 bp, Glycine max
gatgatgatgggcacccagttgatgtcccaaaagggcactttgctgtttatgttggcgaaaaccgaactaggtatattgtgccaatctccttcttggctcaccctcagttccaatcactccttcgacaagccgaagaagaatttggatacgatcacgaaatgggcctcacaattccttgtgatgaagatgtcttcaggtctctaacatcctcgttaagatgaacaaaaaacatcaacaacaacaagggacgaggtttatttatttatatatgatggacggttctgactgaagaggatggccaagatgaagcacaccacttttttgcttcttttttctcccttcgtcattgccattttcattggccttcgtcctctcattaatataaaaaaaaa

SEQ ID NO: 4925 - DNA, 766 bp, Glycine max
  misc_feature (470)..(471): n is a, c, g, or t
  misc_feature (482)..(484): n is a, c, g, or t
  misc_feature (514)..(514): n is a, c, g, or t
  misc_feature (516)..(519): n is a, c, g, or t
  misc_feature (523)..(525): n is a, c, g, or t
  misc_feature (543)..(546): n is a, c, g, or t
  misc_feature (550)..(554): n is a, c, g, or t
  misc_feature (569)..(570): n is a, c, g, or t
  misc_feature (572)..(575): n is a, c, g, or t
  misc_feature (579)..(583): n is a, c, g, or t
  misc_feature (594)..(596): n is a, c, g, or t
  misc_feature (598)..(599): n is a, c, g, or t
  misc_feature (602)..(606): n is a, c, g, or t
  misc_feature (621)..(625): n is a, c, g, or t
  misc_feature (636)..(636): n is a, c, g, or t
  misc_feature (638)..(644): n is a, c, g, or t
  misc_feature (648)..(653): n is a, c, g, or t
  misc_feature (661)..(663): n is a, c, g, or t
  misc_feature (665)..(668): n is a, c, g, or t
  misc_feature (670)..(673): n is a, c, g, or t
  misc_feature (677)..(684): n is a, c, g, or t
  misc_feature (691)..(692): n is a, c, g, or t
  misc_feature (700)..(702): n is a, c, g, or t
  misc_feature (704)..(709): n is a, c, g, or t
  misc_feature (713)..(715): n is a, c, g, or t
  misc_feature (721)..(724): n is a, c, g, or t
  misc_feature (726)..(727): n is a, c, g, or t
  misc_feature (732)..(733): n is a, c, g, or t
  misc_feature (735)..(739): n is a, c, g, or t
  misc_feature (744)..(747): n is a, c, g, or t
  misc_feature (750)..(752): n is a, c, g, or t
  misc_feature (756)..(763): n is a, c, g, or t
gaaacttgattttttattacttttaaaggattgttgcaaaaaaaaactatggttagattctgctggagaccagctgcggggggtgatgatggaaatgtgaatggtcaagttgaagggcttctatggtacaaggatttggggaaccatctttatggagatttctcaatggctgtgattcaagctaatagttcattaaaggatcgtagccaacttgaatctggaccattgacttctgactatttgggtcctcaaggaacctttgtaggtgtatatgatggtcatgggggccccgcaccctcgcagtttgtcagtgacaatcttttctgcaatttcaaaggtatgttatatatgcccttaactttattttataagcatatatatgtgtatttattggaagtatagtattttttttcctcttgatccttttcaaatgaactgaaaacggcaaaaaggaattaatatgttccctnncttaacccatnnnttcaaaattataaccattcacaaccaaaantnnnnagannnatatttccaaacattttnnnncccnnnnntttttgacagaatannannnnattnnnnnttgatttatannntnnaannnnntatttaaaaacccannnnncttacccctantnnnnnnntaannnnnntgtccttnnncnnnntnnnntttnnnnnnnnaacttannaaaaaaannntnnnnnnctannnttaaannnncnngaaannannnnnaaaannnnccnnntacnnnnnnnnttt

SEQ ID NO: 4926 - DNA, 449 bp, Glycine max
agtagccatcaatacccaaacactttgtgttagctgcatcagttgcccatgaaccctcgtcaaatccaaacacggtgttgaaatacccagatggaattctcccagggattgaacttttctggttgaagagctctgacatctataagaccaaatcccagaaaccaattttcattttcattttcattttttttaacaattggcaacaaagcgtttgatgaaatgtcttacttgggtgaaggtgaggatgtcggattggtagcgggtgcgatcgcccttgtcgcatttgatgtcaacggagacatctctgatgggtctgaaacctggcaccatgagctctcgtttctctgtttcgttgagaagaaccaaacgctcttcgcctttgcagaacttgagcctgaaatctgaggccaagtcgaagccctttcctaagctgttcagcgatctctcaa

SEQ ID NO: 4927 - DNA, 879 bp, Glycine max
tggcccagagactaaaatcagttccaccaaggattagtagtggaagtttgaagggaattacaggtaagatgtttaaagaaaacaatgagttatggaagaagagagtagcatactacaagaccctggactatcagctagcagagcgtgggagataccgtaatctgcttgatatgaatgcttacttgggaggctttgcagctgcactgattgatgatcctgtgtgggtgatgaacactgttcctgttgaggctgaggtcaacacacttggtgccatatatgaacgtggattgattggaacctatatgaattggtatgccatttcttccattttctaaatagaaattggatgtgagggactttggactcattctatggaaaattagctttctgattgcctaattagattatttaacatcatatctgatgttggcagttttgaatttctggattatggataagtacatacgtgactttatttaatcttaattcaatacattgtgatcttaactagctaaaattcaagggtagagacacttttacttgtgcactttttatgaaagctcattttagaggaccttttttcttgaattatggtcaaggagtgccacctaagtaactttatgaaaaagagtttaattgctgattatctctctgcttatatgctaaactcaactcaaatgctaccaacttttgtcctttagtatagacagaacactgttctagaaatgtgagttgaaaatcaaatctttgtcaatacacttttcaatctagtaattatcaaggatttaaaaatcaaatcaatacacttttcagcacatggtagttgaatttgttactaactacttcttgtgtcctcaggtgtgaagccatgtccactta

SEQ ID NO: 4928 - DNA, 389 bp, Glycine max
atctgcagcgtagttggagagagggaccctgcgaacgtgaattcatgggtgtctaggaggggcaatttccatcctgtagtgaaatcagttggagcagcagcttcgatggcgtgtgcaactgggaaaaggatagtggcagtggagttcgcaagctttggaaaccccagtggttattgcggagactttgcaatgggaagctgcaatgctgctgccagcaagcaaatcgtggagcgagaatgcttggggcaagaagcttgcacgcttgcattggaccgtgcggtgttcaacaacaatggcgtggatgcttgcccagatttggtgaagcaacttgcagtccaagtgaggtgtgcttaggtcttgtttcgtggtttaacttggccaagtagaag

SEQ ID NO: 4929 - DNA, 1254 bp, Glycine max
  misc_feature (51)..(53): n is a, c, g, or t
  misc_feature (1248)..(1248): n is a, c, g, or t
gcagccctggcttcttacaattttcttcaatccttcctacaaagctctgcnnnttttgaagtatattgcaatggcgacttggtgagtacttggtctgtgctggctagttatttacatactttctgggtcataggacgggaggatccccttcttttggtttggttcaagagaatgggcgggtagggagtggaagggtccacttgtttggtttgcaaggggagaggagggaaagaatatactactatatccttataaatattaacggaggagaataaaaatttgcaaaaaatttagtcatcacatttttaaaattataaaccacttttcctctcaaacactgttagagtgtgtttggatggggaaattttaaattttaagaatttcaaatacttcaattgaaatttttttattttcaaaattttgtgtttggataaaaaaaattaaaattatgagggtggaaaaaaatgaatgaaaaaaagagaagatatggttggtgtgttagttatacgtgttcctctacactcacacccgatcaatgttccacgatctcaaaggtgtttcttgaagaagactgtaagaagagaatttcaatttctcaccttttagaaggaaattgaaattccagatttttagttgtttaaaattctgttttaaaatttcaaaattttaaattcttcacaagaaaacatccaaacaatgaattctaaattacagaaattcaaattctcttataaattactttcctcagttaaaattctctatccaaatacactgttagtgtattgttaaaaaaaccactatgttagtgtcctttattgatggtggtgtttacatgtatatctgctagggtgaaactctggaacttacttaagtcatgtaaatcttttgaagcattcagcttcagagcatactattgcaatagtgtttacctttattatttgaatacttttaatgactttatgatcatcttgttccttttgacatcataggttttctccaaactgaaagagaacagatttcctggtgaaattgagttgagggaacttgttgggagaagattagctaatacaagatttgtcagtggtattgaaggtggtgttgggctctagttagaccctgagaagatacatcacacaaattgaagcctgcaaaatggatgttaaagaattaaatttttagttagtgtttgtgtaatttgttttgtacactgttaggtgagcaagcatttttctccggtctcactatgancccctc

SEQ ID NO: 4930 - DNA, 394 bp, Glycine max
  misc_feature (383)..(389): n is a, c, g, or t
cagttgccacatgatgaatacaatatatccccttcaacttggggaagcaggtttgttttcttatgcttaaattgtcattctatcatttattttgtgcaactgttatttctttgtacctcgtatcctccacaagtaagatttgctttgtttttgtgtcctttctgcctgaaatataacgctatttcttttaatatttggcaaaagtatagtggtaagaaatcttctggcaagtagcagtggctctcgtggaaactgaaacttggttcttatgatttgaaaaactactaaattaaggtttgggaaaattccaggtaattaattttccccccttttttaatgaaagaaattgtattctgggtattatggatgccaatatgcactannnnnnnatctt

SEQ ID NO: 4931 - DNA, 372 bp, Glycine max
actttgttgctgatgctgctatcataactgttcctattggaatcctaaaagcgaatttgattgaatttgaaccaaaacttcctgattggaaggtttcagcaatttcagatcttggtgtgggcaatgaaaataagattgccctaagatttgacaaagtattttggcctaatgtagaactcttgggcactgttgctccgacctcttatacctgtggctattttctcaatcttcacaaagcaacaggccatcctgttcttgtctacatggtagctggaaggttcgcttacgacattgagaaactatctgatgaagcagctgcaaattttgtgatgcaacagctcaagaagatgtttccaaatgcttctaagccag

SEQ ID NO: 4932 - DNA, 1503 bp, Glycine max
  misc_feature (656)..(656): n is a, c, g, or t
  misc_feature (700)..(702): n is a, c, g, or t
  misc_feature (1485)..(1486): n is a, c, g, or t
ctgggcctctatctcgttattctcctccatttcttcaaacatcaccacttccaggtacgcactacctaaccttcattttcaaattatgaatccttgccctggtcttattaatcaaaagccccttttattttccatgtttattgtttgcctcacaattattgtacacacgagatggatattattattgtgaggcaaacaataataatagtcttatgcatgcactacctaaccttcattttcaaattatgaatccttgccctcggctaattttgaattttttttttattttcttacttgcaatgtttttttcctactggatattttttaccaattggaaaagagtttgatattccttgcattcttcataacttaattatgatttctagcttaagctaaaatgagtttgggcgttgtccaccctcaaagggggtctgttccaaagtgcctgtttattactttttcatcctaattttcttaattatatcaagttattgctatattcttttaaatatatatgaagtcacgtcgagttgctaaagctgaaatggtccaaaaaaagatcctacatgttatggaattatcaaaggttctttttgttaacttctttgtcttttgctttgaattgactttcttgttaatcgggatgcatgcataanactattattattgtcactgcattgatgcattaagcaggcccatnnntagggtggttgagcactattattttctgttcttaagtttagttatgatagaatgttgtttctactcttgctgaataactattaaagtcttttaagttattcttatgtagattgacatttttgttatggtgataatagataattgggctgtaatttttgaacaagttagttggatttcttacaaaacaatcatgatttcataattcataaaactattattattatttgacaatctgggaaagtagtatgacgggcactaatgactgattgatattttatgatgttccttggcaggctttttttaatctttcttttccatttgctactttctattttcatttagaattagttgttttgatcttactcaatgaaattagaaaatgttgcaagaatagttatgtcacatttgttgccatcgtaaaatacatgatgcatttggtgtagtacagggatggtattccttggacactgttattgcagctgaatctttggctctgatcctacaagcatttggcgatacaaaagattcaaaagagcttcttgaaaggttattacaatacttagaaacctgggaaattaattttatattctttttgcttcatttaattttgattttatacaaatgaaatcctcacttttcttttccttgcagatgtcttaatgtccggaaggacttacttcctgatgaccatattcaggtatgttctttgatagggattttggtagttccaaattccaattctatttaaatttcaaatcccatattgaatgcaaagctaatatnnctttatgcatgtcagag

SEQ ID NO: 4933 - DNA, 346 bp, Glycine max
atgtccatgttcccccacattggaatcaggttcttgtttttgtatttttggttttagtccggcatcttataggatcaggtacctatattgactagagtacttggaaaacacaaattagtggaagatctttatacaagcaagtgttattcgcatttataaacttgttattgagtccaattttcacgggaaatgttatcattcttttgtctttcttgttccaaaatttgatttaaaattacaagttgaagaagtgtaatgtgagttatactcagattcctaaacattggataatgtttgctccaagtcagaaatttgtttaatgataatcagaattgtatagcccggg

SEQ ID NO: 4934 - DNA, 482 bp, Glycine max
  misc_feature (476)..(477): n is a, c, g, or t
gctgatttccacacttactctatcacgtggaacccccagaggattatgtaagtcaaccatcattttttacactttgtttcttttttctctctatcctatctaatccttaacataattttctatactctttaattcagattctctgttgatggcactcccattagagagttcaagaacttagagcctattggggtccccttcccaaagaatcagccaatgaggatgtactctagtttgtggaatgctgatgactgggccacaagaggtggccttgtgaagacagattggacacaagctccattcacagcttcctacagaaacttcaatgctgagacttgcatatggtcttctggagcatcttcttgtgctaaaacttcttctacttccaccactagcagtggttcatggctttcaccaggaactggactctgcaggccatcagaggttgaagtgggtgcagaagaactacatgattnntgatt

SEQ ID NO: 4935 - DNA, 326 bp, Glycine max
agtgtagtcccgaccaggagaacatgccgctggccgttgattcgcttcagttcgagagcggccacgcgccatcgcggccgtccaagttttgcgtgacgattttgcccctcttggttctcttattttccgcttttgttgtgtagaaagaaagggtgggcccacttggtggggttagtgtctgtcctcttctctttctctctctctcgctatcacgtgaaacttagctactcgacaaaacatgcaaacaaacgggggtagtttgttttttacttgagagggtttttctggctgtaaattttcagagtccattgacatgtttgtgtgta

SEQ ID NO: 4936 - DNA, 381 bp, Glycine max
ccattcgaaagttaccaaaaccatcaaaatcatctctatgcaaatggctaggcaaatgaggaaaccgactatcatggaattcaccaaaacgacgtgcaactctgccctcaaaatcatctatacctgccttaccaacaagactgccagcgtgcggccccaatctccgggaggacatctcagcatattcactaacaggacttcttgaagctataccatccatatgatgtctcccatatccaggacctggttcaagataaccaggatgaagagcagaacctgatttcttaatgacatcgtcatgaataccaactggtctctttccagcatcatgtgcgcctaatgaataatttccaaatttagaaacaggctcagaattcgaag

SEQ ID NO: 4937 - DNA, 600 bp, Glycine max
tatacactcattgtacatatcattatggtgccaatactcttatttgttttgctaagtgtatttttttcctgtatcagtctctgaaaatgagtcttttgttctcttaattgaacactcccagaacagactgtacaataaaaaagcagaaaaataattaacaagatatactaaaaagaccacagtttccgtaaaaaatgtttgaaagctcactattactcttcaagaaaattataaagcatacatgaacttaccatattaagaagccttaaagcagcagtccgagtgaattttcttgcaaaaaggaagcaagtggatggtttacccttgctgctgcaccattctcttcggtattcggtttcaaaataaatattatctatttcctgcaaacaaatcatcaaacttgcacatgtttactttatatgcttgtctcaaactgagtcaattatgttgaagaatgcagcatctttgcatttgctgtcttagtatggttcaatgataagtaaactttttctttacgttcttcagcacattccttcttcctgttacccaaacttttgagttttattgtatattcagttcattatcataactgcaactact

SEQ ID NO: 4938 - DNA, 956 bp, Glycine max
  misc_feature (948)..(950): n is a, c, g, or t
caaaaccaaaactacattaccaacaattcaactgcgaggagtgctagagacacactatttttactagacactctactaatagttaaaaattattgaaaactacaaaataatgataaagactcattaagtaagtagtgggaccaatgaaaatttgtaatttccaataaatttcagacaacactcaatggtataatgttgtgttagaaagtactactttgttcctagcatttctcactcaaacaaagacattgaattgtgttgcagatcccacatcagtaataatatgaccaaaatagtaagtggaagtaacccttatcctatgagctactccctctatccctaaataaaagataattttcagaaatttgtttgtccatttttataagatcaatttctaacttttagatgcattaattatttttttccctacatatttttacttaattattctctctgcaaacatcaatgagaaacaattaagtggataaagagataaaaaaagataattttgaaatgataatacaaataattgacctattgaacccgaattaacttttagggtcaagttaggctcaaaaccgaattccgcgaaagaaacatcacataccaccatggtgagcattggatcagaaggctggaagctgttggggccttcttcccagaggtatccgtccctctccatcgtggtgatgttgccgccgacgcggtctcgggcctccgtgacgacgacgttggcattggcgtgtttggtggcgagggcctgggcgatgcagaggccgctgacgcctccgccgacgacgacgcagtccacgggggcggagtctctggttttgggcggagacgcggtggattcctccgcaatggagcagcgtagaatagggttagggcgagagcgagggaattttcgagtgggagaggtgaagaaagaggtggggaatgagggagggnnnaagaaa

SEQ ID NO: 4939 - DNA, 526 bp, Glycine max
  misc_feature (517)..(518): n is a, c, g, or t
gctgaacccctccatcttctcccacaatctcagacgatgatgatgatgaacttgaacttcccaaccaaagggaaagggataaacccgacatgtccgttttcaaaagcgcccttcaggattgccttccttacgatccccccaaaccaactaacaaacccgttattaatgttgattcccaccttgaaaagttttcgggccttcgaataaggtttctttcatttttctctattttattatattccccagctgtaagtgcctcttattctctctctctctctctctctctctctgttttcttttccaggaaccaattgttaactcctgccgagcttaaggaacatttttcagacattcgttttgttcggctgtcggttatcaagtaagtactactcttcttcacatccgcttcttcttcttgtaatgtttttttgtaaattgtaattgatatggatttggtttgttcaggaattcattagttggggatactgtttctggaagttgggccactgtggagtannccgagaag

SEQ ID NO: 4940 - DNA, 209 bp, Glycine max
tctggcaaccctttgggccttggaaaactaccaacctcctaaatcacacggtggcatccctcccctgtgtgtaacctttggttctcccttagttgggaaccacatattttcccatgccacaaggcgtgaaaattggtctcactacttttttcactatgtgatgagatatgacatagtgccacgaatcctccttgctcccctctcttccc

SEQ ID NO: 4941 - DNA, 764 bp, Glycine max
aagtttcgattgtctctctctgacaccctacgatttctgcggcagcatcattccacacgcagagtcagtgtcgttcttcttctaattcatcgctcccgatgaaacgagggtaccaggaatccccttcaagctcgttaggtccacctcattccagagctagacatgatcctcaaggtaatttttttagtgcttttggcactaccctatttgttttttccttttgatttcaccgttttggagggtatgtggatctgggcttaattggttttgacactttgggttggttgaatttttgaatgggggaaatgggtttaaagggaaagttttgggagtttttgtggctgtattgctactgaaattgtggttgcatcatgtgcatttgtctacaattttctataatatcaagaattgcaatgaaaccactaccataattgcaatttctttgcttgtggcaagcttataaggggttgtgattctggtgttaattttcatttgatgcattgtgtttaggtggtgcacactttgttgaggatgaaagcacaaagatttttgctcggaaagtagcagatcattatagtgcgagatccaaccagactttggaagaacgggaggctagtccgataattcatttgaagaaactcaataattgggtatgtgttgcattctttaatatatgatttgtttcccatggagtattatgtgatcgctgattaattgtattgttaattttgtcatttaacagattaaaagcgtcttaattcagc

SEQ ID NO: 4942 - DNA, 337 bp, Glycine max
tcctaataggaaaccttatgaaacgataaatcataagatcaaaaacctaaaatgaaaggagagagcctcagattagcattttggcacattcttcatcgcaacaacaacccgtgtaagaatacacgatgcgcacaaacgttgtcgcagctcatgccaataattctttcatcaccagctactccacttcactcaatttttaaaaaaaaacacaacaaaggccctcagttcctttcttgatttcataatccaattcaactaaagctaaatacaacgcttgccatgaaaaatgcaaaacaaagaagaaatttctcaattctgagtcttgcaaatcgcaaca

SEQ ID NO: 4943 - DNA, 535 bp, Glycine max
tgagtttaatcatgcagcaaggatagtgaagaaaatcaaattggttggttatccatgcaagatattcaagaagacagcacttatcaaggatatgtttacctcagatcttgaagtagctcgttttgaaggtgcagctattcggacagtcagtgggattagggggcaggtcaagaaggtctgttaattgtcaaattgagacaatgccatatattatactgatgatttgttttggtagtttctattggatatgtataatttaatttgccatctattttgtgctaagttattttctttaatctggcaggctgcaaaagaagagataggtaatcaagcgaaaaggaagggtgggcaaaccaaagaaggaattgctaggtgcacttttgaagacaaaattctgatgagtgacatagttttcctgcgtgcatggactcaagttgaagttcctcagttttataatccattgacaacagcattgcagcctcgtgacatgacctggaaaggaatgaaaactgttgcagaattgagaagagagcat

SEQ ID NO: 4944 - DNA, 407 bp, Glycine max
gattgcatagtgcatgacgattgccattgcttacatattaggtggggttgttcctctcgttccttacatgttcattcaaaaggcagcagaggcagttgtgttttcagttgtggttaccttggttgcattgctgatttttggctatgcaaaggggcacttcacgggcaataaaccattcaggagtgctttggaaacagctctaattggtgccatcgcctctgcagctgcttttggtttggcaaaggctttcaatccatagattctcgatactttgtacttggtggcaactaatctaataacttttgcattcttcccaaaaaaaaaaaaagtttcttttcaacttctttgttgttagttgttacttgttacatattttcatttttttgtaccatacagttacctgcaag

SEQ ID NO: 4945 - DNA, 521 bp, Glycine max
  misc_feature (480)..(480): n is a, c, g, or t
  misc_feature (504)..(517): n is a, c, g, or t
gcagctcgccgccgccggtggtcccggcggcggtgacgtgtcgctccgcaaggtcttcgtcgggaacgtccccttcgagatttcctcggagaggctcctcgacgagttcctcaagttcggagaagtcgaggaagggcctctagggtttgacaaatcgagtggcaaaagcagaggctttgccttcttcgtttacaagaccgaggaaggtgcaagggcttcgttggttgaacctttgaaaactattgaagggcaccaagtgatttgcaaattggctgtggataacaaaaagacgaaaccttttggaacggatcagcatcaacatcagcagcaacatccgcagcaacagatgcagcagcaagtttctatgatggtgcctcagtatggtggatatggtggtaatggttatggttatgatgtacttgccaatattaactatgacacattcagttttttctccctttagaactacagaaaatgagntcagatccaacctataatataaannnnnnnnnnnnnnataa

SEQ ID NO: 4946 - DNA, 480 bp, Glycine max
aactgatctttccctctgtgggacattgacttaaatggaaaagttaatggagcagtagaaacatgcagtggagaagataagttggtgatgtcaaagaggttgacaagctatttgaacttctcccaccctttaatatcccaaaattttgatcccaatgaatgtgcttgggcttatggcatgaacatttttgaccttgatgcttggaggaagaccaatataagctctacataccatcattgggttgagcaggtatatataagtactttccatcctactataatactgtcaagaaaaataagtaaattacttaagatatgttcaaaactaaaatttgagtttccatattggagaaagatagtataataatacataattggtattatgctttatgcagaatataaaatcagacctcagtttgtggcagctaggaacattaccccctggattaatagcattccatggtcatgtccacactattga

SEQ ID NO: 4947 - DNA, 1552 bp, Glycine max
  misc_feature (389)..(389): n is a, c, g, or t
  misc_feature (472)..(472): n is a, c, g, or t
  misc_feature (480)..(485): n is a, c, g, or t
  misc_feature (491)..(494): n is a, c, g, or t
  misc_feature (496)..(496): n is a, c, g, or t
  misc_feature (503)..(510): n is a, c, g, or t
  misc_feature (514)..(517): n is a, c, g, or t
  misc_feature (521)..(522): n is a, c, g, or t
  misc_feature (526)..(526): n is a, c, g, or t
  misc_feature (528)..(528): n is a, c, g, or t
  misc_feature (531)..(536): n is a, c, g, or t
  misc_feature (538)..(539): n is a, c, g, or t
  misc_feature (541)..(541): n is a, c, g, or t
  misc_feature (543)..(548): n is a, c, g, or t
  misc_feature (552)..(555): n is a, c, g, or t
  misc_feature (557)..(559): n is a, c, g, or t
  misc_feature (561)..(562): n is a, c, g, or t
  misc_feature (565)..(567): n is a, c, g, or t
  misc_feature (570)..(572): n is a, c, g, or t
  misc_feature (575)..(584): n is a, c, g, or t
  misc_feature (586)..(592): n is a, c, g, or t
  misc_feature (594)..(596): n is a, c, g, or t
  misc_feature (599)..(602): n is a, c, g, or t
  misc_feature (607)..(622): n is a, c, g, or t
  misc_feature (624)..(632): n is a, c, g, or t
  misc_feature (636)..(647): n is a, c, g, or t
  misc_feature (651)..(652): n is a, c, g, or t
  misc_feature (660)..(668): n is a, c, g, or t
  misc_feature (670)..(679): n is a, c, g, or t
  misc_feature (681)..(681): n is a, c, g, or t
  misc_feature (688)..(692): n is a, c, g, or t
  misc_feature (694)..(704): n is a, c, g, or t
  misc_feature (706)..(707): n is a, c, g, or t
  misc_feature (711)..(711): n is a, c, g, or t
  misc_feature (713)..(719): n is a, c, g, or t
  misc_feature (721)..(721): n is a, c, g, or t
  misc_feature (723)..(724): n is a, c, g, or t
  misc_feature (729)..(731): n is a, c, g, or t
  misc_feature (733)..(733): n is a, c, g, or t
  misc_feature (735)..(736): n is a, c, g, or t
  misc_feature (740)..(746): n is a, c, g, or t
  misc_feature (750)..(757): n is a, c, g, or t
  misc_feature (759)..(774): n is a, c, g, or t
  misc_feature (776)..(776): n is a, c, g, or t
  misc_feature (779)..(785): n is a, c, g, or t
  misc_feature (788)..(789): n is a, c, g, or t
  misc_feature (791)..(791): n is a, c, g, or t
  misc_feature (793)..(793): n is a, c, g, or t
  misc_feature (797)..(800): n is a, c, g, or t
  misc_feature (802)..(814): n is a, c, g, or t
  misc_feature (817)..(820): n is a, c, g, or t
  misc_feature (822)..(823): n is a, c, g, or t
  misc_feature (827)..(834): n is a, c, g, or t
  misc_feature (837)..(853): n is a, c, g, or t
  misc_feature (859)..(866): n is a, c, g, or t
  misc_feature (870)..(881): n is a, c, g, or t
  misc_feature (886)..(889): n is a, c, g, or t
  misc_feature (893)..(898): n is a, c, g, or t
  misc_feature (900)..(905): n is a, c, g, or t
  misc_feature (908)..(936): n is a, c, g, or t
  misc_feature (939)..(939): n is a, c, g, or t
  misc_feature (952)..(958): n is a, c, g, or t
  misc_feature (960)..(961): n is a, c, g, or t
  misc_feature (963)..(963): n is a, c, g, or t
  misc_feature (965)..(977): n is a, c, g, or t
  misc_feature (982)..(982): n is a, c, g, or t
  misc_feature (984)..(998): n is a, c, g, or t
  misc_feature (1002)..(1007): n is a, c, g, or t
  misc_feature (1012)..(1019): n is a, c, g, or t
  misc_feature (1021)..(1021): n is a, c, g, or t
  misc_feature (1023)..(1038): n is a, c, g, or t
  misc_feature (1043)..(1048): n is a, c, g, or t
  misc_feature (1051)..(1067): n is a, c, g, or t
  misc_feature (1069)..(1077): n is a, c, g, or t
  misc_feature (1079)..(1092): n is a, c, g, or t
  misc_feature (1098)..(1099): n is a, c, g, or t
  misc_feature (1105)..(1116): n is a, c, g, or t
  misc_feature (1118)..(1118): n is a, c, g, or t
  misc_feature (1120)..(1121): n is a, c, g, or t
  misc_feature (1124)..(1134): n is a, c, g, or t
  misc_feature (1138)..(1143): n is a, c, g, or t
  misc_feature (1145)..(1151): n is a, c, g, or t
  misc_feature (1153)..(1156): n is a, c, g, or t
  misc_feature (1162)..(1167): n is a, c, g, or t
  misc_feature (1171)..(1178): n is a, c, g, or t
  misc_feature (1180)..(1184): n is a, c, g, or t
  misc_feature (1188)..(1193): n is a, c, g, or t
  misc_feature (1196)..(1198): n is a, c, g, or t
  misc_feature (1202)..(1222): n is a, c, g, or t
  misc_feature (1225)..(1237): n is a, c, g, or t
  misc_feature (1239)..(1248): n is a, c, g, or t
  misc_feature (1256)..(1279): n is a, c, g, or t
  misc_feature (1281)..(1294): n is a, c, g, or t
  misc_feature (1296)..(1296): n is a, c, g, or t
  misc_feature (1298)..(1298): n is a, c, g, or t
  misc_feature (1300)..(1303): n is a, c, g, or t
  misc_feature (1305)..(1305): n is a, c, g, or t
  misc_feature (1307)..(1307): n is a, c, g, or t
  misc_feature (1309)..(1312): n is a, c, g, or t
  misc_feature (1315)..(1319): n is a, c, g, or t
  misc_feature (1323)..(1336): n is a, c, g, or t
  misc_feature (1338)..(1353): n is a, c, g, or t
  misc_feature (1358)..(1358): n is a, c, g, or t
  misc_feature (1360)..(1413): n is a, c, g, or t
  misc_feature (1417)..(1424): n is a, c, g, or t
  misc_feature (1426)..(1429): n is a, c, g, or t
  misc_feature (1431)..(1452): n is a, c, g, or t
  misc_feature (1457)..(1468): n is a, c, g, or t
  misc_feature (1470)..(1486): n is a, c, g, or t
  misc_feature (1489)..(1489): n is a, c, g, or t
  misc_feature (1495)..(1498): n is a, c, g, or t
  misc_feature (1501)..(1505): n is a, c, g, or t
  misc_feature (1507)..(1514): n is a, c, g, or t
  misc_feature (1518)..(1549): n is a, c, g, or t
tgccaaaccccaccacacctttctctttgacaaggaaaactccaacgccaatggctcctctgttctacccaagcccaggcctttcaggtctctttccactgacatgatcttgaagccctgctctcttgaatcccagtctctgaatctcaacatttgggactactctgactccgaatcaggtcctgcttcttcctggtccacactggccaacaagtccttgatctgtagacccttgcctttagatatcggaagctgcacttgctttatcgtcaatgaaccacctccccagggactatcaggtggcactttcttctctctaaagtattaccttccatagctttaggaagcggaggttttgtttgacgttggatgaagattcttggaggagnggattcagaatcctgagtctgcttcttgcgtaccatgacgctgctgtgacttgatcctgcttttaccactaaccaattaatanccaccaannnnnncccccnnnncntactccnnnnnnnncatnnnncctnntacncnccnnnnnnanngntnnnnnnaaannnncnnnannacnnnacnnntcnnnnnnnnnncnnnnnnntnnnccnnnnatgannnnnnnnnnnnnnnncnnnnnnnnnacannnnnnnnnnnncatnnaccctctnnnnnnnnnannnnnnnnnncncaccctnnnnncnnnnnnnnnnnannaaantnnnnnnnantnnctccnnntnanntttnnnnnnnatcnnnnnnnncnnnnnnnnnnnnnnnntntcnnnnnnncanncnancctnnnncnnnnnnnnnnnnnctnnnnanncatnnnnnnnncannnnnnnnnnnnnnnnngtatcnnnnnnnncatnnnnnnnnnnnntcccnnnnttannnnnncnnnnnnccnnnnnnnnnnnnnnnnnnnnnnnnnnnnntanaacatcctcccannnnnnncnntncnnnnnnnnnnnnnctcantnnnnnnnnnnnnnnnaccnnnnnncaccnnnnnnnncngnnnnnnnnnnnnnnnnacccnnnnnnacnnnnnnnnnnnnnnnnncnnnnnnnnncnnnnnnnnnnnnnngccctnncccctnnnnnnnnnnnncncnnctnnnnnnnnnnnccannnnnncnnnnnnncnnnntcaacnnnnnncaannnnnnnncnnnnnccannnnnntcnnnacannnnnnnnnnnnnnnnnnnnnagnnnnnnnnnnnnncnnnnnnnnnntcgctctnnnnnnnnnnnnnnnnnnnnnnnngnnnnnnnnnnnnnnangnannnngncntnnnnccnnnnncgtnnnnnnnnnnnnnncnnnnnnnnnnnnnnnnccacntnnnnnnnnnnnnnnnnnnnnnnnnnnnnnnnnnnnnnnnnnnnnnnnnnnnnnnaaannnnnnnncnnnntnnnnnnnnnnnnnnnnnnnnnncctannnnnnnnnnnncnnnnnnnnnnnnnnnnntcnactacnnnnccnnnnnannnnnnnnaacnnnnnnnnnnnnnnnnnnnnnnnnnnnnnnnnact

SEQ ID NO: 4948 - DNA, 787 bp, Glycine max
ttttatccatgttattggggatgcacatgtttaccgcaatcatgtgagacccttgcaggaacagctccagaaccaaccaaaaccttttccagtatgtgtaaatgtttaaggatttcgtttgctttaatgtagatgctcacaaatatttaccattatgcattcgtataaattgccttttccttgttgattacctaaacttctattcagattttgaagataaacccaaagaagaaagatatagattcttttgtggcagctgatttcaagctcataggatatgatcctcaccagaagatagaaatgaagatggctgtttagggatcttgtgagattctcaatccctgcttcaggccgttatgctttctgatgtgaggcaagtaatatatatttatttttccatgattttatttatgtaaaggagatttgtattatctggttgagacttgtcacctgggcagtatggcaaacccaaaaataggattttaggattcattttgaactagttttgacttgattttctgaatttaagggcacacacttaaaatacgttattaatttctctgctttttagcaaaatttatgtggagaatacgcaggtagtacaccgtacatttttttgaatatgtctaggcacttgtttttgtgtttccatattttgctcatcatactgaaacatggcattgccattttttcaggcgcaatcataggacgtatatgataaatttatggacaaataaaagaatacttgctggacatacttcaagctttgcatatgttactatagtat

SEQ ID NO: 4949 - DNA, 495 bp, Glycine max
tttggtataccatctccagaatcatctgattctgatgatgacaaagaagataatgaaactgacaacttggatcgaaggttcgcagtttttgtttctttcagatatgttcaagtgttttcttccaaattttcactaataatttcattttaacattagcaatcgtcaaagacggagacctaaacggtattcagaaagagagtttgttgaagcagtatcagataatgaggcagacttcgacagtgatgatgatattgttggagaagccgtatatgatgaagaatatctaaagaaacgcaagcagaaaaggatgtcttctagtagctctgaaggagatgaagaatatcagtgggatgaatacaatgttgaagatgaagaagaagaagatgatgatgacgatgacgattccttgagcatcagtgaggatagtgacaagcctcgtaaggtcaaacagctgcagttgcgtggtcgtacaaggagagaaaccaaactcaggac

SEQ ID NO: 4950 - DNA, 714 bp, Glycine max
ggtagtttttattggttgctgggatcatatagatattatttgatatgctgaacttgaatttcaggttctcgtgataggtgccacaaatagattggatattcttgatcctgctctattgaggaagggtcgttttgacaagatcattagagttggtttgccatcggaggatggaagatttgccattttgaaggtattttacccctgcaactattatttgctgagatcctgttttcctccagtatttcatcatctttaatttactttttctcatttctttatgatgcacactaggtgcatgcgaggaataaattttttcgctctgaggaggaaaaggagactctacttaaggaaattgctgaactgacagaagattttactggggcagagctacaaaatatactgtaaataatctttgggggatatattgctttacgaatctcttttgagaatataggctgatattatcatgaattaaatgacaggaatgaagctggaattttgacagccaggaaggatttggactacattgggcgagatgagctgcttgaggcattaaagagggttggtggtttcttagcttctttctggctgcgccataatattctctcatatgacattttcatttttcaatcttctttggtgcaattctacactgtctgataaatcttatggatttgcagcaaaagggaacatttgaaacagggcaagaggata

SEQ ID NO: 4951 - DNA, 191 bp, Glycine max
caaactcaaatgttggatcggtgtgatcacaacatccaggtaactgacatctagctgtgcaaaactgacctagctaacaaaaaacatcaaatgaagcaggatggatggcacagatcttcaccaaatagttatgctttacgagtaattaatcagagcaaggtaaaaaaattaaaagagaaaaggaaaaaaaa

SEQ ID NO: 4952 - DNA, 404 bp, Glycine max
tattatttatatactgcaaaatcctcccctccccttcctgcccttctctctctatctgtttcttctttctacaatccttaaccattcaaacttatattctaattatgtatatagtgtgcatcactgtcatatcagtcttctagatggtaatgctgtttgctagttactaccttcctcacctgtctttcttttcctctagtcatctttgtttctctttggttaactttgtatttagctaccctcagtgagggtgtagtttaccccttcatcatcttttctgttttttttcaaagaaaagtaagaagggattggtagtagtcttttgcagtatctgcttcagtttttaggattaatccatgtcactccacctactagtaaacccctgatatgtttcattccgagta

SEQ ID NO: 4953 - DNA, 331 bp, Glycine max
tctttatgcctggctttcaaagaagcgggtcattgagttgagtcaggtggagggagatgagaacaggatgagaatgttaaaccgcaattttggggtgagtttggttgggaggaagggtttaagtagtgctgctgaatctcttattgctaacataaaactttctagacccaactttaatgaagcggaaaatggccttatggctgagaaggaaaattcttagtagcatcttatagagaatatacctccgtgctcagttaactgtattaaacacatttttctgttaaattcaattagtttctgaccattttttccccattgttagccatttttc

SEQ ID NO: 4954 - DNA, 480 bp, Glycine max
  misc_feature (431)..(431): n is a, c, g, or t
  misc_feature (438)..(438): n is a, c, g, or t
  misc_feature (468)..(475): n is a, c, g, or t
ccccgacgagtactcgtggagaaagtacggtcagaagccgatcaagggttccccatacccaaggtgagtgacattgaattctgaccgttgatttagttgactttttctcatcaaagactcgttccctgacgttgtttttttttatcatcaggggttactacaagtgcagcacggtgagagggtgcccagcgaggaagcacgtggagcgcgcaccagacgatccggcgatgctgatagtgacgtacgagggggagcacaggcacgccgttcaggccgcgatgcaggagaacgcagccggggtggtggggttggtgttcgagtcaacgtagagagaaagagagagagggtccaataaaaaattggaagtggaggactttttctaaaaatatattataatttttggagagtgtagtgggaacaaaaaacgggantctgcangccatcagaggttgaagtgggtgcagaaannnnnnnngattt

SEQ ID NO: 4955 - DNA, 389 bp, Glycine max
caccgattatggcacaatcgcagggtcccgttttcacattttcatcaatgctgaaagtaccagaacaagaccacatttaatcatcatcaggtccatccccgagcgattaattaatattacattttcgtggtttaacaacaaaaataatgtggaaagcaaatgagaacacaataataggaagagggatagtgatggactcagaatgagaagagaagagaattcgatcaatagttagtggacaaaatcactgtaacgtgatccttgtacgaccttcattaaatctgttagttgtgtcaaggagcatggaagataagatggatttttttttttttgggtttcctaaggaaaaaaaaaaaaaaaaaaaagggggtttttaattggaggggtga

SEQ ID NO: 4956 - DNA, 411 bp, Glycine max
gaaaatgtggagtgaagacccacacgcagtacacaaacacagatgccggcacggcaaaatcagcacgcacgactcttccttcccacaattcctgcacattctcccattaccattactactctcacccccctcgtccttatccttcacccctgcgcaccccgctaacgtgcgccaccccactttctttccttcgcagtcctcctctgtgctcccgcagcaggactccgcgtcgtccatctccgcgccgccgcacacggttgcgccgccgcggtcttcctccgccgcgattccgccacactgcgccaaaacttgctccaaattgcagcgtagagcatttgccgtggcttcgttcgcttccgctaagttgcgccacacctgattctccatgcaaagatgcttcactttctcttc

SEQ ID NO: 4957 - DNA, 547 bp, Glycine max
  misc_feature (537)..(540): n is a, c, g, or t
  misc_feature (543)..(543): n is a, c, g, or t
cgtttagcaaaattctggatgttgtaaacagtggcaacatgtcacgggcaattgagtattattccaattttgtcagggatgctcacactgaaaaggatgtaaggcaatagtacaattcttattcattttatagttctcattaatacttgatgcattgttcctgcagctcttttgcatgaccttcctacaatgaagggattagtattgacatggttcagtatgtattttatttaagatgaaaatcattactgcagagatctttgggagatgtactacaaaacttgaagagtatgtgcgaaaatcccccatctttaaatgttgctgttgactctgagattattaatgatgttaatgttcactcaagcaaaaatgaattcgatcctgcaataaacaatgctgaaattgctgtgcctgacattgactgggatatttccgtggagagttcacaaattgattgggacattggaactgtagaagaaacggaggataatggtaatggattgggtccatatgaaatcattaatgcctctgatatcnnnnctnaaaa

SEQ ID NO: 4958 - DNA, 376 bp, Glycine max
tcatcttgcaaaggcagaggaggtgcagtagattgtagtcttggaattcagcttgcattttctggtacagacaggcatctcagagtgcttaattcatggtttgaagtggaaaacctgcggcagtactctctctatggcttgtactcaaatctaagggactctctcaccagccagtataacaaattcttttaatagcaaaaagatcttcctcttgtggattattttgtttgtttaggatggtatggtaacttttgtgactattgctctttgccttctcaattaattgttgctggaaattttattgcttgccaatttttggtttataactttacgtgaagagtgtgtacattttagtaggctgcaagtgcctttactt

SEQ ID NO: 4959 - DNA, 240 bp, Glycine max
cgttgggtacgcatcattggataatttttgttacagctcagagtttccgcggacggcgaaatattggacttgtttttttctcatttccttttacatttctttcatttgtgagttttttctttttgtcttcttctttgtagttaacagtaagaagtggaagttgttgtaatttttggttgcacgatactttgaataatcatgttttctgggcattttatttttcttttcaaagtttagtaa

SEQ ID NO: 4960 - DNA, 437 bp, Glycine max
tttctaatccgcagtatctaaagtatgtctccaacagtcacacacaaatgtcctcttctctgaaacgctgcacatcctacaccaaatacgagatcagaaagcgaaaccctgaaccaaaatcatgtgccctattggtaatcgacgtgcaaaaccacttctcatccatggccaccccaatcctccataacctcaacaccaccatctccctctgccgccgcgcctccatccccgtcatcttcactcgccactgccacaagtcaccctccgacgccggcatgctggaggagtggtggtccggggacctcatcgtcgacggcacggcggaggccgagctcctggaggctctggaccggaaaagcagcgaccttgtggtggagaagagcacctacagcgcgttcaggagcactggcttggaagagaagttggtggagatgggt

SEQ ID NO: 4961 - DNA, 398 bp, Glycine max
gcggcggcggtgagggtggcattgagtgtggtctgggacctggtgtcctgcctgaagggagcgagctgagactcggagatgtagttttggcggtagaagatggaagagcggagggcgttgtaggagacggtcatcttcttgttgccgttgcggacgaggaaggagaggtgccacgtggcggagagggattgggaggtgctggagaggttggaaacggagagggagtggagggtgaagtgggggagggaggggcggaggacgagccaggtgatgatgaggacgacgccgaagacgacggcgaggcagatcatggtggcgaagaaagcgcggaagaaggagcgggaggcgtaggagcgaggaggagggtaagtggtgttgtagtattgttgttgggcagc

SEQ ID NO: 4962 - DNA, 357 bp, Glycine max
agagttaatgaagataatggtttctttgattattcagtctcgctcctcacataccctgttgtgtatgtgggatggagcaaatgtacttttaaggcttttgtgcagcaacattaccatgccttgatcatggctgctaaccttaatgacagaagctgcaatattttccgtagtcatccgtagataattttgtaacgtcaattgtttaattagtgagataactgatttgtcggccattacttactatcggaattttatatggtggtaactattcttattcggggtgttttgttgatttattagacataattaaaaaaaagggtaatagacatctgcttctagtagacaggcttatttgtg

SEQ ID NO: 4963 - DNA, 367 bp, Glycine max
gatttgttatggttgtagaagtgaaattcttaattttaatggaagaacaatgcgaaagcataatgtacgaaacctaaattttgtccaaaaaatagaagattatgcaggcaccttagaagaatgactttgtttacggtctcttcaccagttgattcttcctttgatttgaattcattaacctgggacagctgacctgagtaactagaacctttgtctgtgcttcttgatctgattttctgatttgatgattactcatgagaagaggccaagtcttggtgcaacaataaggtcagaagatttaaattctggaaacagcccctcttcttgcagggataatatatctacccttcatcgactccactaggta

SEQ ID NO: 4964 - DNA, 410 bp, Glycine max
cctgcgcctcacccccacacaatactaaactcccactcttcgccacctccgctctctttactttctcctccatctccatccgcataaccgccgcggcctcctccctcgccgccgcatcagccgccatcatccccgtcctctcgtccttcttgctccgactcctctgcttcctcaccgccgccgccaagcacgccagcgagcaaaccagaacgaatatcccggccgagaacccaataatcagcgccctccggtcgtggcgcttcttctcgtacggctgccggataattccgttgacgccgtgaacctgcgcgttctggccgagcgcagccgtaggcggcgccacgggtccgaagaaaggctgtgcgggacggcattgtacgcggatgatttcgccgcagagttgagggttt

SEQ ID NO: 4965 - DNA, 361 bp, Glycine max
agctcatggaagggtgctccagtatgagaagttgtggtgcccaaccgcatattagataccctttgttgcttgcttgcaccctcttctcaaattcctccacaaaacctttagtttcaccttcatcagttttcccaaccacccagatgaaatcatgaccagaatcttcaagggcatgagctatttccacaagctgggtggtagggaagttgttcatgctcccaaaacacacatagagaacagagccctctttcttagaatcaagccatgcaagccaagaaccatcttttccttcttctacttgttcttctttagctttgttgtcacgtgatccccttgaagccttatccgaagcatcttgatt

SEQ ID NO: 4966 - DNA, 570 bp, Glycine max
ctatgcttcagatctattatttgttacttcttccatttatctgtaacttgtactcccctgccccttttaagaatacttatttacttattattttatttgcagtaatttcagctccttctgatgtcaaaaaacatgagcagaaagatgataaccttccagttgacatcaaattgcctgttaagcatgtattatccagagagcttcaggtttcaaaattattaagccaccatgagctattttgttttctcatcttgtggttcattttcatttgttttattgtttcttgcagctgtattttgacaaagtggccgagcttactttgagtgagtctgaatcagttctctttaaagaggcattagtaagtttggctactgattcaggacttcatccactagttccttatttcacatgctttatagctgatgaggtaataatatttgtctatttatgataatggttgataaaaatggaaaattctccttattgtagctcattacaaatgcacgcttctccattcttgtcaggtttcccgtggtttgaataattatcctcttctatttgccttgatgc

SEQ ID NO: 4967 - DNA, 897 bp, Glycine max
  misc_feature (38)..(40): n is a, c, g, or t
  misc_feature (810)..(810): n is a, c, g, or t
  misc_feature (844)..(856): n is a, c, g, or t
  misc_feature (880)..(881): n is a, c, g, or t
gggccccatcttgcacacacgtactagtactacacatnnncttttttcctttttccaaaatccctttgttgttgtagctacccttcagagcaaagagagagagagagagagagagatgtctcttccaagacccagtgagggtaaagccccttctcagctgaaagaaggagtagcacctgctgctgctgaagcctcaacctcttcttcatggaataataggctaaacacttttcctcctttatctctacacaacaagaatagcaaaattggtagggtgcacattctttttttgtgtgttatggaacacaacataacactaatcagttcttaaaaggactaaattaaagggcagttttattaggtaattttgttgttattcaattaaaactggattttcatctcggtgacctgctcgattaaggtcgacatctcggtgacctgctggattttcattagtcttctgttttctaaaatttatttgtacctacatttgaaagtatttctctctgaacacattctgctttctaaaagtttgtcctttgggcacttgatcaagataacagaagaggaagaaaaaatatctatcagctgtttttggtttttaaaacacttgttttgtaaacaatttttaaaactaaatagattttggaagagaaatcacgtgtccttaaagaactgtatctaaattttatccttcttcaaatgcatcacatataatgctagttcttttcctttctttcattttcttcaagagagttaattttaaatattaactttctttttcttctaaaaaatggaaataaagaaaanatgttacatgacaataaagagtttttgtgcagtnnnnnnnnnnnnntttatgtatgcacattaagcatgnnaactaattggggactg

SEQ ID NO: 4968 - DNA, 1161 bp, Glycine max
cttcttttgttttttcttctgattttgttggtttggtctaacaaaatagtttttcatcatgggaaacgcttgtgcaaaaggaaaaccagttgctcatgtttcttcctccaatttctctggttagtttctcttcaatttaatcatttttatctggggccctttcctttcttatttggttttatttgatgccaccatgtgtgtttcccttcatttgtgcactaatcatgtaacctggtttaaatttgactttttggtggttgtgtatgatgagtgttttcactttttctctttagtttctgaagtatataactgttgttcatgagatgtaacacttcaagattataggctgttcgatttatttgttgttgtctaatccttgggattaaaaaatgaagattctgaggttgccttgcattgaggttgcaaagtatggtgtacaattttacagtttaggagatactttatttggaatcatggttttaaattgtagtcagcaaccgcaattgcagctgcaatgtaaaggtttttttactcactatgaccacatttgcagctgtatcggccgcattttcctccaatttttcataatgtcatggattgacgaaattgcaactgtgactattgagtctatgactgctattcaaaaccatgcttggaattaattaaaatcccttccatttgctttgttgtcaagaataaggcatcaacgaataaggttattacatgttttgacgaaggcaaggaaatttatacttcagagttctgacaagttagtggagccatgtgtgtcaattttttatgtgatattgttaaagcttatactttgttgtctatgttaattgcaaattataagcactagcattgctccataacttctttgtcaattttaggataagatatttccttacactagcattacaagcttttagaaagttaatctcatagctgcttttaacttgcttttcatctaataacaggaagtaagaagcctgcaagtaagccaaagcagtattcaaattcttctgaacaacgatctgctccaacaacttcagaattaaatgttcccaaatccatctccagtaaccttaagtccttcagcttgaatgatctaaaagaggcaactaagaacttccggcgagaaaattaatcggagagggagga

SEQ ID NO: 4969 - DNA, 501 bp, Glycine max
gagactgcgttgttgatggtgcagggggtctcacagcaacggacacccgcctccttgcctgaaggaactgtgctgttgttgatggtgaagctggcctaacagcatttgtcgccattgagttccttctgacagagttttcctttccactcatgaaggcagtgtaactctttgatctaagaggagaccgtggaggcaaggaattggttattcttctcagtggcaatctcagttttgaaggattcagtggaggcttcttgtctgtcatggttttatgagctgttgatgatgagggttgaactgtaacggcagcaagagatctactttcttgctttagtctggttttcctttcttctgcaatctggttctcgaggtcccgaacctgtcgtggaatataagaaaattgtgaatcactttgcaaagaaaaaatctatcttgtctaaagttacttgagttgcagaagattatatttataccttttcctgaaggcttctacaatgatgt

SEQ ID NO: 4970 - DNA, 499 bp, Glycine max
aaaataacataagcaagtggtacagacattaatagcactacttataaacatggttgaagagcaccatataacagtatccttaggactcttcccataattccaagtgcaacaactattattttttagtctttcgtactttttactcttgcatcttcagcttatttattgctgcttgcctgaaaaaccaatcaaagattatatgatcagtgccagagtcaattaagtaaaactcatgcatgtatgctatggtggtgttgtgtgggtgtaacatgaatacaattagcatttgctaactatgaaatgagcttaaaaaagaatttgctaatatgcatgcacatattaagatatatataccttcttcctagtctggcttggaattttctttggggttggtttcgagaccggggctttggaagtgcctgaactaggtttggcagaagactctttcttcacctgtcctgcagatggttgagagcaacaagatttttcaacaggtttc

SEQ ID NO: 4971 - DNA, 394 bp, Glycine max
caagcgtcacctctcctccgtccgtgttcacgtgctccgcgccaccacgcacgccctcgcggcaccaccctccgaggaaacaatttctgctgtcctcgcggtcgggcacggcggctcccaccgtcatccacgcgcgtgcatcgacactctcatggaccgcctccacaccacgcgcagtgccaccgtggcactcaaatgcctctacactctccacaacgtcgtcgtaaagggacccttcgtattgaaagaccaactatcttgttacccttcttacggtggccacaattttcttaacctctccaccttccgagacgtctcggacttggaatcgctcgaactcagttcgtgggtgcgctggtacgccgccgtactggaacagaccttaaaccgtttc

SEQ ID NO: 4972 - DNA, 359 bp, Glycine max
ttcaaaacacttaattgatttagccttgcttgggcactaactgttcaacattgcaccataatgtcatgtcaacccccaagtctgtatattgacattttctttttatgagagaagagccagtaggaaaagggctcacaatttttttgcttatagaggagccttaaacacaagttttctgaggcctaaggtacataaccagaatgaagtcactcattgtagtaacctttctttatttcctaaatttttgattggcgtcctgctaccttctcacaagtttagagaatggattaactgaagctcaaaatttttgttagctttgaacagatgatgatgatgtcaccatttgcattaagttccct

SEQ ID NO: 4973 - DNA, 399 bp, Glycine max
  misc_feature (137)..(137): n is a, c, g, or t
  misc_feature (169)..(169): n is a, c, g, or t
  misc_feature (173)..(173): n is a, c, g, or t
gatcttgatctcaacagaagacgatgaaattagcgagaccgagtttgttgaaggctttacaaaatggatggactcaaattccagccaagctgctaactcaaaatcttcgtctcacgaaattcgtcgagtatttttcnttattcctttactcaaaatttcttttaggccnaacncttgatgaataataatataaatttacactgaaatgattgtgtgttagacctgggaagatgttgaaaaggtaatagaagagaatcaaaccaaaggaacatctgcatggttgacggctatagcatatgtggtgttgggagttactatactggctcttcttgcagaacccttaatagcaagtgtccaaaaattctctgaagaagcaggaatttcatcatttttcatctc

SEQ ID NO: 4974 - DNA, 441 bp, Glycine max
tttttgatgaaaacaagagcagagagatgtcagcagaattttcaggatcagctgaccttactttggaggggaaccaattaagtggaccagaatttccagttttcaattttagttgcatttctatagccacaaacaatttctctgaagaaaataagcttgggcaagggggttttggccctgtctacaaggtaaaaatgcttctattaagcccatcttttagtaataaaaaaagtcttgctaaaatgtaatgaaaattatttgctccatttaccagggaaagcttccaggcggagaacaaatagctgttaagaggctttcaagacggtctggccaaggcttagaggagttcaagaatgaaatgatgctgatagccaaactacaacacagaaatttagttagattaatgggttgctctattcaaggggaagagaagttgctggt

SEQ ID NO: 4975 - DNA, 381 bp, Glycine max
ttccactgaaatccaattgtcataatgggattaacttaaatctaccaatacaatacaagatcatatcaatgtcaaacatcagtgtcagctccctgtgacttttttagctttgctacaagaacccacatgttggcaagctcattttccaggtatgcttctctttgctttgattcttcaattctcctttgaagctcggcttctttatgatccctatctaaaagagcagattcgtatgaaagttccctttctttactcgaggcgagttctctcttgatatcagagtttgacccaccctgatgatcatttcgtctaacatgactttctcttcgtgcatttcggactgttccagttccactatttctaagttgagcgggagaattc

SEQ ID NO: 4976 - DNA, 385 bp, Glycine max
cgggatcggtgaaagagggtaggcttcagcagaagagggatttgaaacctgacccttcggagaatgaagatttgcatgtgttagttgaggcagagacaccggagtcgcttgaggctgctgcgggtatggtggagaagctcttgcagcctgtggatgaggtattgaatgagcataagaggcaacagcttagggagcttgctgcgttgaatgggacgatcagggatgaggagtattgcaggttgtgtggtgagcctggtcatcgccaatatgcgtgtcctactaggacatcaacgtttaagagtgaagttgtgtgtaagcattgtggggatggtggtcatccaagcatagattgtccggtgaagggtgctactgggaagaagatgga

SEQ ID NO: 4977 - DNA, 781 bp, Glycine max
  misc_feature (729)..(729): n is a, c, g, or t
  misc_feature (767)..(769): n is a, c, g, or t
  misc_feature (771)..(772): n is a, c, g, or t
tgagtaatctcccaattctctccagacctttgaatttcgcctcattttttggtgcagttttgattcgaacattttgtttttgatttattttttctagcaaatcgattctattttgtgcgtgaattcgcttttaatttgatccttgttggcttattgttccttcgtttgtgatgagtgcgcaacagaacgcgacgagtcaaatgcagcagcagaattcccgccaaaacggatcgccaggtgatggaaattcagcgccaaatgactccggcaactccgagaggttcctaatttttaattatttatttattttttgtttcgcatacttggaattggattttgcatgcttaatttttctttatgctcagttttttcttcttttatttgtgtgttgttttgacttattcatagagagtttaagcgtgtccgcgcttcaatgcactctgccatatcaatgagcaaaacagaagttctagatgacgtgcttaataacttctcggaggtaatctagttttagatttagattctgtttggataaatttctccatacgtattaataggagaagtaaacaagaaggttaaatgaatgagcttctcccctaagttaaaaatcaactcgtgtacttaacttttatataatttctttcatcaaacttctccataaacagtgcataagttgatattagcttatagagaagctcacttcatctttccttcttatttttttattcnattagtgtttagggaaaagtttatccaaatacaacctnnntnncaatgaaaa

SEQ ID NO: 4978 - DNA, 378 bp, Glycine max
tctgtgaggcattacagcttttagaacctcatgacttgtaatgcttctatgttgtcttctgcacttccgtcttgttgtttccccaaacctccagttaaactctctagtctctacagctcttccagtcttttgatcccaccataaagtgatcacctcatcatatcatacctgtgacatagtcaaaaccaaataataatctctttagcagccaataccattggaacctagagatagtcttgtagttccttttgaagtttttatttattcattcgttcctcattgctctttggttccatgttcctcccaactcccttttgtcgattttctttgtcttatccactccttttcagttcaataggacagctgttcttgtaccca

SEQ ID NO: 4979 - DNA, 703 bp, Glycine max
  misc_feature (38)..(40): n is a, c, g, or t
  misc_feature (597)..(597): n is a, c, g, or t
gataaacaaatcaaattcaactgaaagactgaaacaannnaactagcacatggcttatcaaaatcttgcttaaattcatcatcatggtccttaaggatgactggatgctttatgctcaccctctaattgtaactttaaatctttttatatataatttagaagccacagtttttgggtgcacttaggtaaacaacttaatctcttattcaacagctcttatcacatgaaggtttatgccataaattttgatcatgaaattttattgaaataagttaaaaagagcttattttgataagttacatcaagaaactcgttaccatgggctgtaaacaacttatgaaagtcatgagctattttaataagctcggaaaaacttcccataagaaagatgatctaacttcactgtaagaaaattcattaacctgcaaagatgttactcctccccaagccttcaagaagtcaccctcctctagaagcttgagttgaggcacagttggtgaatgatcagaacttaataggtcaatgtgtccctcctgaaatgaagaataaaacatgtaaaaagctgatgaggtcataaatgattagagtaagacaatnctttgtatttgggagaggaagcatactaatacagcctcccataatttttctctgttgtatgcatcacgaatgggcggggaacacttaaaacgagtatctccatttg

SEQ ID NO: 4980 - DNA, 370 bp, Glycine max
ctctttcagtacttagtgatgtggacaggtgagacaccaatgtcattttgtgtaatataaaatcttgtgagcgaaataataaagttggcttgtatggttgtcggcgttgttcttcgtttttcttaataatatgagaggtttacttctgtctttagcatttttgctggacaagggtagaaggaactgttgtcctctaactgaagattttgcatattggcatgtcttctacaagttaagacagacaagtgaatggttttgtatttgagagcgcaagtagctgtttcaaatcgatgatgggaaaagcatatgtgcctgtctgcacttagagaacaagtcttgaatagatttcgatagttataaatgctcttgt

SEQ ID NO: 4981 - DNA, 571 bp, Glycine max
tggctggctcgagcggacaactgtagaagacatggatatagcagtccgagcccatctgaatggatggaaatttatctttctcaatgatgtaaaggtaatcattttgttaccgtagaagacatgttttgtttggccttttggttttaatccaagctaatccactcagtatgtatcaatttctatttgcctataaaactgactaacagttttagtatttattgatttggaaaggtaggatgaacttgaattgggtgaagtaattatctgcagtaattgaaagacatgctacactaattttggggtgaaaaactgttgatgtgtacaatttaggttgcagttttagtctaaagaaacttctttcaggtgctttgtgagcttccggaatcatatgaagcttataggaaacaacaacatcgatggcattctggtcctatgcaactctttcgtttgtgccttccagcgattataacctctaaggtggtgtattttctttattgtcagtctatgcactgttttgaagtaaaatacaatctaaacatgttctgatttcataacattgcagattgctttc

SEQ ID NO: 4982 - DNA, 490 bp, Glycine max
taatccctttggggtccaagagtgtgccacacacacacatttctgcagagaaaaaataacaaaatgtgtcctctgcgattaattctgatattcttgtccgcaaccctcgccggtttcttcgttctcagaaacctcagatctcagcctcagatcgaagaagacgacgctgttgttcctcccaaccccaaaatctctgactcctccgacgcttcctcaaatggaacttccaaggttgacccatttcacccttttgcctcaatttcacaaaaacgttcgctttttcttataaccctaatttttgcggatgcaggttcgcgctgtggtagagtctggattctggaccttcgtggatatggctagtgggcgttacctttggaggcatttggtctctaattcttccaagagatcgtgatgatgtgattgtatgttgttgtaattgttcggttccatgatctctgtgggcccaaattgggtgattaaacgttgcctc

SEQ ID NO: 4983 - DNA, 400 bp, Glycine max
tagcttcagcttaagtcgaattggaagaagtttcagtttcaaagaggggcccacgctgccacaatatagttccgtgtatgttagtgcaaagtctggtccggtgacgcctcaatcttctgttcgttgggataatccaagcaaagagaaggttaatagtcatatcagaaaccggtccagccccttgcggaggttgttagaccctttattgaagcacaaggcatcagataaacacaattcagctcaaagcagtcaggcactagagggtggaagtgcaaattcaagcttcaggactattggtgtcaatgaatcactgctggctgaaaagagcaaaggatcatcagttcaaggcctcttgcagcttacaataaaaaatggagtgcccttgtttaaatttgtgaaa

SEQ ID NO: 4984 - DNA, 400 bp, Glycine max
ctctcgttgattccaagaggcaggatggcttactccatacaccttgtggcacacctgcttatgttgctcccgaagtcatcaaaaggaagggatatgatggtaccaaagctgatatatggtcttgtggaattgttttgtttgtcttgttggcaggttatctcccttttcacgacccgaatttgatagagatgtataggaagataagcaaagcagaattaaaatgtcctaattggttcccaccagaagtatgtgagctattgggcatgatgttgaatccaaatcctgaaactaggattccaatatctactattagagaaaatagttggtttaagaaaggacaaaatattaaaaacaaaagacctgtagtggaaaacaacactgtctcttcttcaagtactga

SEQ ID NO: 4985 - DNA, 743 bp, Glycine max
gacaattcttgataaggtgtgtgggaggctccactgatcaaagagacatgcaagccctaaggtctcttgaggttgactctcagagtattattcgagcaattactcctgcccttgatcctaccagacataaaggccaggcaggtataacatatgatcctttcttttatttttgggctcaagataaagaagaaacgtctaatgtttccttcacttatgttttaaatcaggaaatatagctgttattggaggttgccgtgaatacacaggtgctccatatttttctgcaatttcggccttaaaaattgttagtacctgcacaactttcatatttagccttttccctttcatactgaattctctacatgaaaccacgaaagaaagaaaaaaaaaactgttttgtcaattcagattatcctattattattgttcactttcaaaaacaaaattatcctattattttcccacccgtgcagggtgcagatctgtcccatgttttttgtacaacagatgctgctcctgtcatcaaaagctacagtcctgagttgattgtgcaccctgttttggaagaatcttataatgttgggtataacttcaagtcttctagttaatcttcatctattggtatgaacatttcaaaccaagtcgatgttttttagtgagagactaatttcagggaggaacacaagagttccatagcaagcaaggttcttgctgaagttgataaatggttggaaagatttgac

SEQ ID NO: 4986 - DNA, 170 bp, Glycine max
actacaaaagctagcgatatctcaattaaactaagctactcataaagtacatagtgattgttttgtttgactcactcaccaaattacctaagaaacatgtcttcttaagttactattggtatttgataacaagtattataaccttaggtttttatgatatctgcttgttc

SEQ ID NO: 4987 - DNA, 391 bp, Glycine max
cttctcagaactgaagactcttctccatcagagtaaatgcttctcctaacaccgttcacctctaaaagggtatcaggactaagaggaatatgattgagagagagaaactctggggtggattcatcaacctgaatgccacacactctcacataaaacactcttagatcaaaccaaggtgatgatgatatcatggtgcagggtttataaggagagtatttaatgatctgaaggcttttgttaccagcttctccattgcatgataaatcataaggtccttccatattcatatccactcactcaatcactggaatcctctgtggtgtggtataattgataaattgaaagcatcctgggaagtagaagaacctccaaagcctacatcagattcatc

SEQ ID NO: 4988 - DNA, 1251 bp, Glycine max
  misc_feature (1246)..(1247): n is a, c, g, or t
cctgtgtgcatgtagctgtggacccaaaaaccttgagtactgactaagcacctctttgttttctgtttatagtttattattgcttttccccttgtgcattagccattagcttcgaatctcttttttgggtgtgaagtgaaaaacgggcattgtagagtttgagaaggtgctgcctgttactaatgtttttaatgttgttgctttttacgcagtttgtactgtatgccggcttctctggctgtttcttgctccagcatgcaatgtagaggcagcaaccttatgcttgggaatgttacagtgcagcagactagtggtggttgcaatgttacgtcttgcaattatgatggcattgttaatggcagcattgtaacaacgtatgtttatcctctgtctgcatacctgctgcattttctgatttacatattctagtaatgtctattttgcttaactggtctttgaattgaagcttgtttaacatttcttgacaccctgcaggttgtccccctctcttcagcctcgatgtccaggttagtgttatacacgcgcacacaccctaaatgcattgtataattcatttactaatctttgtattccattataaagatttaaattaaatagattgtgcatatctttgttttacttttcattctggatgatttatttactgagatgtgttggagatcctacattggctagtgatatggacaaaacagtgtatatatggggttgagcaagggaggtgtgttggagatgacaactttgaatgtctgaaatttcaatatgctagagatacaaagagtgaatcatggttacccatcatgctttttctatgtgctatgcatattgtcagcaactgtatgcaaattctgagtttaaaatatagagtttatttgcagaactagaatttagttaggtttgatatcgtgtggcattattataattataattcagactaaagtgatggcaagaagcataacaatctgctttttgttctagggtcatcagagatgttctagttgcaattcctaatttaacctactcccatcacccctagcccccaaaagaaaatttggtgacactcagtatttagtaattcatgaatggccttctaaatatattttaaatgatgttgcagggctgcaggaattccctccccttgttgctccacctacaaccgttgcaagggacacagtgtttgcaccagcaccagcaccactgttcgatggagctggtccagcatcacccnnaatc

SEQ ID NO: 4989 - DNA, 397 bp, Glycine max
ttgtagatgccaagaacaactttccttcttttctgcccctttccattggaactttcattatcataacttaatttttctgttgtaatggacaggctaaaaagaataagaagctctttgggtggctgcaatttctcctatgatctctgttataatgtctaccttttgtgttggaaccttgtgcatgtagcattgtacactccatatactaactagaagtgactaatatgacaatttaagaaccttgtgatgtcttttggaactcggaaacaattattactatgacattggaggtgggaaccttttggaatcaagtgttttcatggataagttttaggataaaacttaaatgttgtatgttaagtgcttttgttactgttttctaacgagtttcaccttg

SEQ ID NO: 4990 - DNA, 395 bp, Glycine max
ccaacaggatcagtttcatatggaagtgcattttctggcgatttgtctggcagcactggctgataaaatattttcaaaccacttcttgaaggcctaagtaaattaaaagaccttccatgagctcatacagcattatgcatttgcctattgcctatttgataagttgtgaacacgatatatattcactattcaggttcctgcctccattatcatgcctatggccctatagagtcttatggacaaggcaataggactataatctttgcatgagtacgacctcagctcttgggaggattaatacttcaaaaggagcttggacttgcatggaagaaccatacttgtctctgaagtgttaagagtataaactggtattctaaaactgttttcccatgcag

SEQ ID NO: 4991 - DNA, 628 bp, Glycine max
  misc_feature (543)..(544): n is a, c, g, or t
  misc_feature (546)..(547): n is a, c, g, or t
  misc_feature (549)..(550): n is a, c, g, or t
  misc_feature (555)..(557): n is a, c, g, or t
  misc_feature (559)..(559): n is a, c, g, or t
  misc_feature (565)..(568): n is a, c, g, or t
  misc_feature (576)..(578): n is a, c, g, or t
  misc_feature (584)..(588): n is a, c, g, or t
  misc_feature (605)..(606): n is a, c, g, or t
gtcctctacattccggttagactttgttagacctttacttttgtcatattaatgataaagcaaaatactggtagtgtatcatgatttgtgtggttacaagcagatgtcttttgttggtaaccaatcaattaaaaggttatactctttcaggaaatttctgtcaaatttaaagttgattgatctggaattattggagcccgtaattttttgctttcactgatcatcccttgtgggattctgagttctgactgttgccaagtttgaatgcttcatgtcatattgtctcttcctgatttatgaacagctgacttatatatcatcttcatcattttcaggttgaaatctgtttgacgtcaaacctcaggacattgtctgttccaacaatagatgcacatcattttggtaggttcttttgtttattttttgaagttgatgatccaaaaataggataataaaagaactttactgtttgttcaactttacaggagattttataggcttgaaagtgattttagattttgattaacttttgttcttctttgnnanncnnttatnnntnaatttnnnntttttgtnnngaaaannnnngttatactaccccaaannttctctcctttataaataaaaa

SEQ ID NO: 4992 - DNA, 404 bp, Glycine max
tgaaaagttctacagtgatttcagaatctactgccccattaacataccctcaacatcagaagctgcaggggtacgtatcatgagaaacatgtgcaatttcggattgtactacacactctttgtgtggatcatactcttcataaccctcatccctcagcgtaaggtgtcattgattctgtttgtcatcatgacctatgtgacaaccctttattttttactcttgagggcatttccaaactctgttgtgcttcacagaatcatagacaaaagagttgtgctggctttgctagcaattgcaactgcagtgcagctgattttgactaaggcaggtatacatcttgcagtgactttggctagcagtgtgcctgtgcttttggttcatgctgttctgtgggctagttatg

SEQ ID NO: 4993 - DNA, 837 bp, Glycine max
tgctccaaatggcacctcccagcatcccaactactgctttgaacaaatgcttgagacaggttgttactttttcttggtcaaaatgtgttttgcaccacttacatatacatttgttttgaaatttccggtttaatcaaataaaggatagtttagtttcaaatttatttttgggaagtggtgtttttatcacagatccaatcttggggctggggggtgataggtgcattttgctcactttagtctgttatttaatttgatacgtcaatgtgtcacttctaaatatatattctgttcagatttctgctcgggaagatgtaatggaagtctcccaggctcgtttttgggaattagtgcctggttatgtggttggttcacttataatacaggtaatttatgatgtgttctcctttcctttatcaatactggtgctaactagtgggagcaaaaaactgaaacttgattagttatttgtctggattcacatccctctaacgcttagtcttgttcaattgggcacccaagttaaatgttgttcatctattgtatagagacctaatttcattttcaaattttgattatgttagtgcggcatgtttccttttctttttatttagtagctttaatctagatactgacttttagtgggtcattctgacaggtaaagaaagggacgaacgatcggccaatactagaatttgtgcatggtctataccatgatttgggtgtacaggacctcacggtgcaaactgatgatgcatgagactatcttaacacttttatgctaatagttattaccaaggattgtatacgcattaatgtcattgtttattactggtg

SEQ ID NO: 4994 - DNA, 760 bp, Glycine max
gctcttgggagagttacatccttcgtcactgttttgctcttccccaaggttttcgtgtgccaaacacagtatgttatgttatttgttgatgttgacctttatagcatttgtgattgagatattgcaatagactatgatgaaattcctgtcagatttatacagtgccatagtatttggttgtcaatatgacccaggatcatatatgccttcttcgatattgatgtatgaaattaataatatatgcaccatagaggagtaggattctgagaagattacataactacataagcagcattgactatggtggatgtctcttttgaagtgcataccagaaaaccagacttctaaatcctaaatgcatgatacataggaaagatatcataatgctaaagaaacttgttctgtattatttcatgctgttttggcacaaagttttttaattttttttctctcctgccaggtatatatgcaatttaatatgacaagtatatgttctagttgagaaatattgcttccttagtatagattttcattcttggttgattatctgaccttggaagaatgtgtacttccaggatgatgcaaatgagaatgctcttgattcaggcgctccttttgatccagatatagatgcccagttggattcattgagagaaaaactaattgaggtaactgcaatgctgattgctaaattctttcttttgcagaattgatactattgctgcttctcatttaatttatcttgatactgattactgtc

SEQ ID NO: 4995 - DNA, 1039 bp, Glycine max
tccttctcttccggctcttgcagtacgacccactcgatgaacatagcttaatacataaaaaataaataaataaattatcaggaatcccatacagagaaagagatcatgttaaggtgagatcaacatttatcatttacgtagcaacaaaggaaagtgacaaaaactgcaggaagacaataacacacaacatttcaagcagagttactaccaatatggatcatagattatacctggtaagatcacgtggacatgcaaagttgataactgtttgaacaccaataatgtcaaggccctataaataaagtcacatgcaacagtgtcagatctatatccaaaatccaaaatgcgaaaaggaaaagatttaataattgtatgttccccttaagataaaacagttttattggatcaaaaagggggtgtttgagataataataccattcaaattcaaagtgagtaaagaagaaataaacatcaaggattgactcttacacgggcagccacatctgttgcaaccaaaaaatccacttgctgcttcctgaactgttccaaagcctaaatagacaatcagaagtcagaaaatcttatgacaaccacaatcaatgcggaaaatcctttcaacaagaaaataaataacaaatgatccaaatgaacaccatcattttagtatcccaaaaatgttgatagtaacacaactacaaaggcaacccaagagctaaaatacacaaataaacacatcaatattagcaagtagcaacatacttcaaggcgctgggcttgagtaagatttccatgaagctcagcagcttttaagccagctaatccaaatataatcttcaatctatgtgcagcttgctttgttccactgcacatcaaaatgatagattaaacagttggttagaggtagtagaatagtggcagaagggaaataataatcataaagcagtgcaaatgaaggagcagacttaaaatctgaaataaaaagacttgtagatgatgaaatgaaaacctgaagatgatgacttggaagtaaaagtttgag

SEQ ID NO: 4996 - DNA, 342 bp, Glycine max
atcatatcttctaaagctggcgtgcaatatcttgggcctgatttggatgctatgaaagccattgcagatgctcattctaagcgatctctgaagttattcgaaattgctttgcgagactacaaggctcagttggaggaagatccaattgtccacaggcacctgtcatccctgtatgattctctcatggagcagaacctttggagattgattgaaccatacgcaagggttgagattgcacacattgctgaactaattaaacttcctgttgatcacgtggagcaaaagttgtctcagatgattttggacaagaagttcgttgggacattggatcaaggagctgga

SEQ ID NO: 4997 - DNA, 813 bp, Glycine max
  misc_feature (768)..(775): n is a, c, g, or t
  misc_feature (777)..(810): n is a, c, g, or t
agagtaggagagcatgaggccatgaggaagattaaaaatgaattcatgacacactgggatgggctattaactggacctaatgagcaaattttggttctcgcagcaaccaacaggccatttgaccttgatgaagctatcataagacggtttgagcgcaggtaggactacacctttgtcttattgtttccaagatcatgtgttgcttctattcagccacaacatttttgtcatcaaagactgcattttctctatcattatgatgagcaaatgtgtgtccataagaaaaaaagaaaattcataacaagtggtcatttcatcaatttccttttgaggtgtccaacagttcctgcctctttggcatttaaattgtccacaaattgagtctatcagatgtcatttatggatacaataagatcaagtgttgttttcaactgtgcaatatcaatattcaatgcttttcagttcaattattattgctcttgtaacttgtgcatcataactcttttacctttatattgttgagcaggatcttggttggtcttccatctgttgagaacagggaaatgatcttgaagactcttttggctaaagagaaacatgaaaacttagacttcaaagagctggcaaccatgacagaaggatatactggaagcgatcttaaggtgaattttggtggtgatttactggttttatttttttggggaaaatctgttgatgttaatttctgtgaacagaatttgtgcatcactgcggcttatcgacctgttnnnnnnnnannnnnnnnnnnnnnnnnnnnnnnnnnnnnnnnnnttt

SEQ ID NO: 4998 - DNA, 375 bp, Glycine max
actacttttttacattgaggctctatgttgaagggataaatactggttgtggtaatttaatttacagtttgagtgagtgagaggtttccgttggcctttggctaatacaaaaaagagttatagagcactgagcttcactaatttttgagagcatatttaagcagggatagattagatagctaatttttatgtatccttggcaattctaagagagataaagttgagtccgaatactcgttggaggcatcaaggttattgagatattgctttagcatttatttgcgtctattgtattttatgggaaatgttggaccaagacaacagtaaagaaattattttgcaacttgtgactagtatgtatggcattgtttttcc

SEQ ID NO: 4999 - DNA, 383 bp, Glycine max
ttgctattagacgtctccagaaccccagagagaatgcaattctccttatcataaacctcaaacttcatgctcccggtaaaacgtatactatcagtgttcacaaaggtagcttcctcagatttcttatccactctatcccttctcagaactgaagactcttctccatcagagtaaatgctgctcctaacaccattcacctctaaaagggtatcaggactaagaggaatatggttgagagagagaaactctggggtggattcatcaacctgaatgccacacactctcacataaaacactcttagaacaaaccaaggtgatgataatgatatcatggtgcagggtttataaggagagtatttaatgatctgaaggctttcgttacc

SEQ ID NO: 5000 - DNA, 363 bp, Glycine max
tacttcctcactcattccattgccgactctctctattactccatctatttattacatataaagcctacttctaaaactttcctacactatcaaattcaaaaccccaccatcatcatttggtgcttcttgacaacacaaaatcactttcaaaggcttgaaaaagaaaactgaaaccaaaccaactttcccctttcactgatcatggcttcttctctcataatttccccaagaaagcttcgctctgatttgtactcctactcctaccaagaggatcattacagcaccccattggtgatcaatgttctggcttcactgattgagaggagcatggccagaacagaaaggatcgtgaagaatggttca

SEQ ID NO: 5001 - DNA, 646 bp, Glycine max
gaactttgtaagtatctttttataaatcataacatacttttgaacaaatcacagtaggaggcaaagaggcaagtgctattgcaggaaactgcagtgtagtacatctgaaataaccatttactcttggaactgcagggggtatatggctcctgaatacctagctcatggtcagttaacagaaaaggcagacgtatatagttttggagtgttgctgctagagatagtcactgctagacagaacaacaggagcaaagcatcagaatattcagacagcttagttacagtggtcagttgcagattcccttggttgttttgttctgattgttgttcaactgtacattgattgtggtaagataagataaattactgatgaaacaattctgttctttcttttttaaccgatatattcgggtaacatcaggcatggaagcattttcaggcagggactgctgaacaattatttgatccaaacctagacttgcaggaagatcacaatagcaatgttaatgttaaggatgagattttaagagtggttcacataggacttctatgcacccaagaggtctcttctttacgaccaagcatgtcaaaggcactgcaaatgctaacaaagaaagaggaggatcttgttgctccctctaatcca

SEQ ID NO: 5002 - DNA, 510 bp, Glycine max
acgtactgatagatcttttgctgcattagagacacaaagaaatgatgccaagccaattttatatcttgatgagcaagggtatgctgttctattttgttacttatttgactatgactttttaaacttgtgatttgcatgtaatatttgcagattcttaccttctcgctctgctgctaatgggattggggatatcctcaagaggaattttactgatccctggccatcatggaaaaagataccaattagcacaagaaactcttggtttgaagagtttttggttaagtttcttatattaattattacatttgatttggatatgtatatttagtctacttttagctaacttgttgcctgtatatataggaaaacttctctgtttctccaccggattacaattgggctaaaaagaattttgaaatgcgaggttcagtattgatgaaaaattatctaaacaaggctcgaaccacaatggataaaccacattggattaaagatgttgtctgggagaga

SEQ ID NO: 5003 - DNA, 870 bp, Glycine max
  misc_feature (807)..(809): n is a, c, g, or t
gacgcgacacgggatccaacaaagacatggtcgttttggtctctgatggtgtctctgattatgccaatacccttctccaggtactcttttcctttgcgaaatgtattaacgcggaaccagaaatgaaattttgtgatcactttatattaaatttgatattaatgtttcattttatatgaatcctaaattttgttagttataacttattttaagtgatattgttgattatagaactcgtgggtagggtaaagggttttatgattgctttttgtgtaggctgatgggtggatagttgagaagattagtttactggcaaatcctaatcaagtacgtccaaagagattttggggtgtctatacaaagctcaaaatatttaacatgactgactacaagaaaggtatagtatttatgttttttgtgtcgggttatggaagttgtggaggatgctctaaactttccatttaggttattgcctttcaaatgggatgtagcttctcatgtttatgccctatgatttattggctgtcttgaatatgtatgtgcagttgtttatcttgatgctgatactattgtggttaagaatattgaagaacttttcaaatgtggaaaattctgtgctaatttaaagcattctgagaggttgaattccggagtcatggtggtgcagccatctgctactgttttcaatgacatgatgagcaaagtaaaaactctaccatcttacactggaggtattattgttttttcttttttctcttttttgtactaatattatatgccattattttattcatttggatttccttnnnggaagcattttgtattagatgtggatttgaatctgataggttgaacaatgacatctctctc

SEQ ID NO: 5004 - DNA, 440 bp, Glycine max
gagcgtggcagtgaacgtgttgtgtttggccatagtttgcagtgcgatcgagtcaccgcaacacacagtagtacactccgagtccgatttcgagatcaggctctatcgtacctctgtttggatgtccgctcctgccctcgacatttccttccaaaaagccacctggaatggcttccacaggtattcaattcattttttttttaattattccactgcgcatagtaatcctatgactattcccgtgtttcccaatctggcaggttgttccagttcacagaaggtgccaacttgaatttctctcgaattccaatgactattcccgtgttgacaaccgcggtccccggagcgggtcctcttcaatcccaaggctattacgttagtttgtacttacccgttaagttccaaggggatcctccggtgcctcttccaaaactcaatat

SEQ ID NO: 5005 - DNA, 775 bp, Glycine max
tctgcagttcttcagcctgaaaatattgtcaaagagaaccaaagggtcacgtgcacaaccatatatagttgtgagaatttctcggtatgtcttgtaacctcaaattttagtcattgttcaccaaagcaattcctagttagatgtgtgtacttaattttaaagggcatttttttctcttttgtgcatgcagctctgcctctttttcctacctgcaaagggagtcattcccctccacaaccacccagaaatgactgttttcagtaaacttcttttgggtcaaatgcatattaagtcctacgattgggttgattctgaggtctctcataatttgttgcaccaaccatctcagtgtgagtatcatatctctatcaaaattaaattaaatggtaaaatatgtttttagtccttatatatatatatactgtctagttgaaaatcttacttttagtctccaaaaaattagctagtaagctcaggaactaaaaatattttttttataaagttcataaattacgcaaatatcaaaatgttcaggagctaaagacaagattcataaaaaatatagagattaaaaacatattttactctaacttaaatgaatctgaattcatgggatatattagtattttaaatttgaccaatcatgcacttgctgtttttgcagtcagattggcaaggttaaaagctaataatgtgttcacagcaccctgcgacacttcagttctgtatccacaaagggaggcaacatccatgaattcacagctataactccatg

SEQ ID NO: 5006 - DNA, 718 bp, Glycine max
  misc_feature (584)..(584): n is a, c, g, or t
  misc_feature (586)..(591): n is a, c, g, or t
  misc_feature (611)..(614): n is a, c, g, or t
  misc_feature (627)..(628): n is a, c, g, or t
  misc_feature (631)..(640): n is a, c, g, or t
  misc_feature (660)..(662): n is a, c, g, or t
  misc_feature (665)..(666): n is a, c, g, or t
  misc_feature (669)..(678): n is a, c, g, or t
  misc_feature (680)..(700): n is a, c, g, or t
  misc_feature (702)..(702): n is a, c, g, or t
  misc_feature (706)..(715): n is a, c, g, or t
cctctattggggctattatagcagattcctttgctggacgtttttggaccattaccgttgcttctctcatttatgaactggtctcttaccctctcctttccaatttaatctaagtctctcatttgattaagctcgtgaactttcctataaaagtattttaaatttttaaatagaaattatttcaatcatattagttaatagcacttaatggttcatacatattttaatatgaaaatcagaaacgagtatatatatatatattcatttagtagctagctaacatattaattacttatactttaagtgtttttttataattcacaaactactatgatctaattatatgttgtaacctaaataaaggtttgatatcaaacactttttatttattaaaaaatgattgatcgactaggtgagcagtacacttcatcaaaactattatttttatgttaatttgtccttatgtattgctaggagacttaacaaaaacttgtttgtgtaccaagaacttttcttataattaaaattaacggcctttcacttcgaggtatcaagcaaacacaaatgagatcacaaagaaaatnannnnnntacatggaatatagattttnnnngtaactcttttcnnctnnnnnnnnnnctctcatacttttatttgannntcnngtnnnnnnnnnntnnnnnnnnnnnnnnnnnnnnntnctcnnnnnnnnnnaaa

SEQ ID NO: 5007 - DNA, 369 bp, Glycine max
ctgtttttgagaccgatagtggcagtgggtcatcatctgttacggggtcggattattcttctgaaagtagttcaggttacagttcatcttctgattcagaggaggaacggagacggaggagaaagaagaagcagaagagaggaagacgcaagaggtacagttcatcagaatcatctgattcagattctgcttcagactctgattctgatgatgaaaggagccggagaaagaagaggcataatcgaagacactgaatgagactgaagaatgcctggagcaacaaaggggttggtgagtgggggggacatgttggatcgttaccaagtccatgtatacaatcatgaagtttcagcagctatgtccacttga

SEQ ID NO: 5008 - DNA, 399 bp, Glycine max
ccgcagattgatgtgcgagtttggaagccgaaggtacatacatttgaatgtgcaacaaatactacacaaagctgcagttagtaataactgagattttggatataaacattgcatgaagcgtgagaaaacttgcagcaatatgttatatacaagattgtcaaaagatgtacctcgcactgaactccaacaaaccacacgagtgagaaaactcgtatgtcacatcatatccaagtttcacgaatcaaccaacaaattacactcatttttcacgtaaatatcaataaaagaacactgcacaatacaccaattttaacgatccatgcaggaaaaatcaaaatctcatcgtagtagtgttactaaaattcagttgttgctcccacatttgactaatttgactaa

SEQ ID NO: 5009 - DNA, 470 bp, Glycine max
ctttgatagcttgtttggtccagttctgcatcaagagcaatgcagaagacaaatagagaaaaaggaatagttatagaagaattagactctgatgatgaggggggtgataatggccctgaaattggagacaaagattttgataagaaaaaatctaaatcgaccacggaaccatcggttgagcatccagatgatgatgttgatggtaatgttctctttctgttcatgttttatattgttctattattgttaggtttttctgaggttttaaattgcggttatggccatgtttttgttagaaaattgccgacaaattttgttgatgtggccacaattgtggttgtgtagaaattttaaggttaacttagtggttgaagagagaaggggaaggaagaggttgtggatttgaatccctcccactgatattctaacacaaaagctaacaattaacatttgtcgacaaaaaaaaaaaa

SEQ ID NO: 5010 - DNA, 1029 bp, Glycine max
  misc_feature (1002)..(1003): n is a, c, g, or t
gtgtgaccctcccaatcaccattttgatctttctcaacctgtgtttcagcaaattgcccaatacagagctggtattgtgcctgtagtttacagaaggtaattcagaaatcttatgttttctttatccttcaagatacttgcacattgtattgtatgcagtatgtgagggtgtgtgcataattcagaccactaacaaaaataatatagagcttttttccagaaactctcaaaagtacttttagtcttgtatccaaacagactctagaaacaatatgactaagtgttgtcaaataacttatatacaagtatataagcagtgtacgtgtgctaatgtacttaatctgtacaagcataattacttttaaggtgaaacttaaatgcagttctttgaattgatttttgtactattctccgatcacaattaaagtttcacttcacaaattaccctgaccttaaatgttgacctctattctactagttgccgagcttaaactaataaactctaattttaatgggagaacacgtgaaatgaatgtaatcaagttttgattttaattgttattaaaaaaataattatatgattaaccaatcaaaaatcatagttgatatgatttttaacttttaagtttattaatataaaagttaacaaatttattatacataacaacaaattggatcacagttacacgatcagggcatacactagttactctatgttttacccttactttttattttttggtctagaagctaacatttttatcttgatggattttgtttgaagggtacggtgcatgagaagaggtggaatcaggttcaccatcaatggtcattcatacttcaatttagtccttgtgactaatgttggaggtgctggtgatgtgcattctgtggccataaaaggttcaagaaccagatggcaacccatgtcaaggaattggggccaaaactggcagagcaactcctaccttaatggacagagtctttcctttttggtcaccnnatagtgatggtcgcagtgtgctctca

SEQ ID NO: 5011 - DNA, 721 bp, Glycine max
gactctattttctatgccctcttcaaaggaaacaccaagcaattcactttttccaaagccacaaacctcttgcagttgcagccacgcataactgttttctcttctttaaaggatgcaggctccagtgacaacacaccaaggtttgcgtttttcgttggtttttgtttacttattcttttttggcaaatgggttggttgaaatgtggaattttggcattggtttgagcaaaaagtacatttttttattattattttgtttttggcagcaacttttgcattattgaggggccagagacgattgaggattttgtgcagatgcagctgcaggaaattcaagacaacataaagagcaggcgcaataagatctttcttctcatggaagaggttagcttataataatggcgtaccaatgttagttgtttgtttattttagaatgttagtgtgggattcgaacccccgacctctcctctcccttcttccttcatcccttaaaccccccttttgatcaaccaatgttagttgttagtttttggaatagtgccaatttgcctatctatgaagatttggtctttaattgagttgaatacctgtgtgattcatgtagccgacctcatttagtgggataagaattttgttattgttattgtattgagcatggcaggtaaggagattacgtgtgcagcagcgcacaagaaggggtaaaaaagttgtcaatgaaga

SEQ ID NO: 5012 - DNA, 373 bp, Glycine max
gcgtcatggttttctaccccattctttgttatcgttctcccggtggccgtggctgcgcttctctaccggctcgaaccattcaagccggttcttttgccggtccagctgggccggtccaccgtggcggttccggctcgtaacggccacatgcaagatggatcggaacgtgtgggtgagggacacttggagggcccggaagacttggcctacgacgctgcggcacgtgtcgtttataccgggtgtgaggatgggtggatcaagcgagtcacggtgaatgactcggtggttgactcggcggttgaagattgggtcaacacaggaggaaggccacttggactagttttgaagccgaatggagaactcatagtaaaaa

SEQ ID NO: 5013 - DNA, 399 bp, Glycine max
tcatcgccatctgcctgatgaactgccactcccaactccaactcctactccagtggaggaggaggaccacttgaatcctttgcagtggtttttcctccgacttggaaggttctgttgtgcaccttgtggtggtgtgtaggttttctgcattaatttctttttcattttcgttaattcattgtagaatagattttgtaggttgcacagtgttttgctttggtatttcattcattctgtcaagtctctagcgtgagggcttgactaacagttaatattgagtattgtgtatatttgattcccccccggataggttctatgattagtgatagattaagagatataaagagttgggtaacatcattcatgtagcggctgctccaaatactttgcttctgtgaa

SEQ ID NO: 5014 - DNA, 397 bp, Glycine max
caaaatgtagtactcattactcaaattcaagttctatataaaatccggcaaagttctaaacatatgacattttcgctaagctttatagattttaataaaatgggaaggcaggcccagaatacctcttaattccagctagagggccaaaagccgtgaatcccatacccagtcttccaattatccaagtaaacaacctgcttgacagccaaaaacgaaaccaagagcgcgaagatcatgaccaccctctgcacgctgacgttgctaaccctaacgagtccgtgggtcataaacgccaagagcaggcccacgacggtgtacaagaagcccacagcgaagccctctgcaccaagctgcatccctgagccctggtaaaaaaacacaagcttggaaggggcgt

SEQ ID NO: 5015 - DNA, 762 bp, Glycine max
  misc_feature (746)..(746): n is a, c, g, or t
  misc_feature (757)..(759): n is a, c, g, or t
cgacagcaagctgtcatagttgagcacattctcatatggcaggaaaatcccatcctaaataacaaggaaacaaagaggcaaaaggaatacagttaacatcattgataatttcattgatttcatcaattacaacatatactacctccagactgaaatataagcaaaaaaaattgtgatgtactaaaatataagcaaaaaaattctgtgatgtactaaaatataagcaaattttaactaactctcctatttaatgataccatctctaaaatacctcttcatttaattagagttttatttccaacaacctttttttgtcctatgtaactaaatgtaaagggtaccttttaatgggtgtgaattagttttttttgtttatatttctgttcggagggtgtaaaagactattaacatgaaaatggaagaaacttaaataaataagctactttcatcactaatcaatagctgcgaatcatttctaaagtactcgtgagatttaaagtgaaaaaaaattctgaagatgaaccacaaaaaattccaatacacattaatgacattatgaatcaccattctgttaacatccatttgtttgttgaattcaaatgtataggatttgtcagctaaccaagtgacttaaacctccttggcagtgacaaagccagggcactagatcaaaaacctagctggcaacttgatattaatgataagatttgtacaaacccattttttaatttattctgttgggggcnaatatcaaatnnnaaa

SEQ ID NO: 5016 - DNA, 711 bp, Glycine max
agaacagttaaggctgctgctgagggatgacgaggaagccaggatttttatgggggcaaatgggtttgttgaagcacttttgcagtttttgcaatcagctgtgcgtgaaggtagtttgatggctctggaaagtggagcaatggctctcttcaacctggctgtgaataataacaggtctgctttatgtttctagttttaatcattaagtaaaactgctttatgattacaaaatcaaaataattcttgctatttgagaatcacaaccttgtgttttagccaaagccattgattatcaaaactgatcattgagatttgcatagtgctagtggatgtaaaaaattgatcactgcccacattgaattttgttcgttcagttaatatgttccaataataaatctggcttaaatttaccaatatggtagagttaatgtttcattagctccttttaaattcacataacttttgttttttttaacctctgcaaactattaacttgaagttgatctttacttttcaacagaaataaggaaattatgttatcggctggagtattatcattgttggaggaaatgattcctaaaactagttcttatggttgtacaactgctctttatttgagtctctcttgccttgaagaagccaagcctatgattggcatgagtcaggctgtccagttcctaatccagcttcttcaatcggactctgatgttc

SEQ ID NO: 5017 - DNA, 383 bp, Glycine max
cacacgttcctctataaatgggacattgaactctttaatttatgtcaccacacacccttcttcatctctctttgatacccttttgttctttttggtgctttaatttgcactagcaagggggttggttttatttctgtttgcttgcaacaatggctgtggctaataagttactttctgttttgatcattgccctcattgccatttccatgcttcaaacagtggttggtcttttatgtaggaaaacacacacatgcacagagtatacacttttaaatctggtttgaaactgttgtggttttaaaaggttcttacattgttttatcttggtttggttttgtaggttatggcatctcatggacatggaggccaccactacaatgaca

SEQ ID NO: 5018 - DNA, 326 bp, Glycine max
ttcttgtccatggtgccacctgttatcattccggatcgtttacaaggggaatcttaaatatccttgcaagaacttcttccttctctggatggttgagagcctgaatggtgataggcataaagtcttttccacttgcacagacaaccaaccaatctggtctcccaagtgcaaccttctgggaagccaagttactaattgtaacctaagaagggcctcagtaagtccttgttctagattgttgggatctaaccgcgatgttcgtgacaatgatggagaaacacaccacttttcccttcataaatccctcgatttcttccttcacttta

SEQ ID NO: 5019 - DNA, 377 bp, Glycine max
  misc_feature (51)..(51): n is a, c, g, or t
  misc_feature (368)..(370): n is a, c, g, or t
cttcctgcccctacaagacaggcaacacttgagacccttggatacatctgngaagaagtttcccctgatgtagtagaccaggatcatgtaaataagatactcactgctgttgttcaagggatgaattcaacagaagaaaacaatgatgtcaggcttgctgccataaaagcattgtacaatgcattgggttttgctcaggcgaatttttctaatgacatggagcgggattatatcatgagaattgtgtgtgagacaacacaatctcctgaattgaagattcgacgagcagcttttgagtgcttggtagctatttcttcgacatactatgaaaagttagctccttatatccaagatatcttcaacatcannngccaagg

SEQ ID NO: 5020 - DNA, 319 bp, Glycine max
agctcaatatgtttgctcaatcccaatatgcagcaggacttgctggtcaaaatcaaatcgcatttgggatgggttcacccttcccacagagtcagccacctatatttgctgcacagcagggttttccatccactgaattgtgttcagaaagaaacctgaattttcattctaatggcgccccctctcaatttcatccgcgtccaaatgctaatcgtgggagaaaaacatttcatggtgcaggtaggaaagggtggcgtccacccaagtgaaggttgttattatttattttgtgctctactgcacactgaactaaatttct

SEQ ID NO: 5021 - DNA, 427 bp, Glycine max
tgaaatcctcagcagttagttcagttatggttgcagagattcctttcaaacacaaaagaacctcagattttggttcctaattgacaaccatggcgggtgcgtgcagagcacccatttgccatcttcctccgcagaagcccaaaaccagaatccagaattctcacagcagaagagctcaacttccaaataggcgtttgttcctcttctctctgcctctctctagtttccttctccttcctgttccaagctttggtgatggtaacaatgcaatcattattgataaacttcaaagtgggccatcttcatttgctgccacaatgtatgacccagtaagtgcggctgaaagagaagcaagtgctttggtttcagagagagtgtctcaggcagtggagttgctggagaaagggagggaattgcagactcaggg

SEQ ID NO: 5022 - DNA, 956 bp, Glycine max
cagcaggtctgtcggttgaatcgaggatatccgcgatgctgaagagtccaaagctgttgatgagttccgtcaagctcttgtcttggacgagctactccctgagaagcacgatgactatcacatgttgcttaggtgatcaccttaattatcttgcttaactcctactaatgaggcacaagattttgatataatttagaattcacctaaagattgaacaaggttggtcatctatttatcagattggttgaggctattcatctttgtaagagtgaataacaatgctacctaattttaaaatctgcattaatgagtccattctaactatctgttgtttttccattcaaatttgcattcatgggttattcctacaaataattgttatggagtaaatatataatttggaccccaattatgttacttgttattttgatccttgaatgtttttgtctttacaagttggtgactggagggatgaatttgttagctccttgataaatttagaaatcaattcgtattggcagagatttttagagaggaaagcaatagaaaaaacattttaagggaccaaatattatattgattcaattggttatgagtaggaacttgacacatttcctgcattacttgcattttgttgaacagattcttgaaggccaggaaatttgaccttgagaaatctaagcaaatgtggtctgacatgcttcaatggaggaaggaatttggtgctgacaccatcactgaggtatttttgttttatatataacaatgatatttgtgagaaatgaggggatttattactagttttatcatatacttgacccttttccccacttgtttatagtattgctcctccttctgtttactaattttgtgccttttatactaggattttgaattcaaggaactcgatgaagtcctgcaatattatcctcaaggacatcatggagtgataaaga

SEQ ID NO: 5023 - DNA, 342 bp, Glycine max
atgaggagggcttcgactctcttggcgtcgcgttggagcctgaggtggaagttttggaattgtggtgatagatggtagctagtgtaggtgtgagcttatcaatggcctgcggcattccattacgtctctccgctttcccaagcaccacaattagggctacacttccccatttacacgcgccttctatctccagccgcccgagtcctctcagctccaactcaatgagtcaacccgccacaacgaatcacgcggatgttgtagtgcagtacgtggtgctccgccgagaccttatcgacacgtggccgctagggagcgtggtcactcaaggttgccacgcttctg

SEQ ID NO: 5024 - DNA, 504 bp, Glycine max
aggcatatatcttgtatagcttaatgtccatgttctcgttagataatcttcttttccctctgcatgttaatatcatagaactaataagacattttgcagtggtaaagcattcaattgggaccagttgaaactgccaaacattaaaagcaagtatggttggctcttagcaggagggatccatcctgagaatgtttctgaggctctatctactctcaggcctgaaggggtggatgtcagcagtggcatttgtgcatcagatggtatccgtaaggatcaatcaagaatagcttctttcatgaatgcagtgcattcttttcagtattgatttaccttaaattattatgagtctcaagaaaagaaatattgtgatttggaaaaatcctcatgttgtattgttgcaattttgttttcaaatccgattgtatatctgaagttcttccttgggacctgttttctaggcatgagaatattataatggcgggggacaatgcatcagtacgatct

SEQ ID NO: 5025 - DNA, 356 bp, Glycine max
cgtcttcattatcacactcatcattctctaatttctctaacatggcttcaaccgcttctgaggttagccaacaagtccaatccaacaacaacagaccaattttcaaaagcgtgaaagcactaactgaatcaccagaactcacttccctcccaccctcttacacctacaccaccaactcagatgatgaaatagtggcagacccagatgaagatgatccaattcctattattgactattccctcttggtcactggaacacctgatcagagggccatgaccatccacgacttgggcaaggcttgtgaggagtgggggttcttcatgctcatcaaccactttgtgtcaaagaccatcatg

SEQ ID NO: 5026 - DNA, 780 bp, Glycine max
tgagtggtgagtcctgttaaagttatatttcatctcttcctcctttttccttggtgttgctattgacttgtattttgcctgctcagaggagaatttgatgcaccgtcccagataatagtcattagtttggactatgttgataaccaagtctgccaactacttattttttggttttggtcttgattctttcttttccagggaagaagtgcagactctttgtcccagtactttggagaggatccagctagatgcccttttgaacaaggtctgatagtctctacaatctagacacatgcacaacacctgagtttttttaacattgtttttggtagcaatgattaattatatagaagggcccttgttttgcgttgggttttatgaaattcaaaatcttgcattgcttaagcagtgtgaatatgcctggaggaagagaatagccacttgactgcaacagtaaagctgagttttggtttcttttatgaagattatgttgactgctaaagttgtggtcttgttgcagtgacacaaatccttgttgtctttgtcaagatgttcaacaagtcaagggaggaaaatgaaaggcaggcggatgctgaaaaaaagaaattagagaaagaagccttgaaggaaaggacagcaaataacttgcattccaaaaaagatggtgttcgataggatgcctatacaagcaagccgcatggttactttcagttcaaacaaactgcgctatacattttggactatctcaaatgcatatttgcatgcacctttgggattttt

SEQ ID NO: 5027 - DNA, 409 bp, Glycine max
ggggcagtttcgggaaatacacggtggagaagcccgcaccggattccgaagcgcgtgtttcaaattcggatagtcgcgatggaatgcgcgtggtgatggagccgcgcgagaagcgcgagattcaggcgtttcggagaatggaggcgaggaagaagagggagcgcttgagggaaccgtccgagcccgaatcgcaattacgggattttaagagggagaaaacggaatgcggtaacggcgttagtggctcgtggacagcggcgacgacgacgccgtatcgcatgcaccagttcgcgacggtgcagtacttgccgttgaataacggctttccgttaccgtgctgggtcggaggggaaaagaatgtgggtggagtagacggcgttgacggcattaacggtggaggagataggaa

SEQ ID NO: 5028 - DNA, 780 bp, Glycine max
tctgattcatgtcaggttcattgtcgatgatcttggccttctgctaagagaaaaaggatttaattatcacggtttggaggttctatatagtggtgtttatggaacggaactaacatgtgagatatttattggacctgtttattatcaacggctgcgtcacatggtttcagacaaatttcaggtgaactaattcactgttttgacttcctatataaccaccagcaaaatgatacttctccatgttttctgaaaatgttaggctttctagatagtggttgtgatagtgttcaagtgttgttagttgacagtgtaaaaaacttcatagggtatattaaatttaaactcaataaattgttagggtttttatgctgatgggagtggaacagtataacttctgttctttgttctattgaattgctttctgctgacaacaaattcaaagacattttgataaacaacggttccaatattgactcttgtggatgagtagattgcttgatatttttattcactttcccccttaattgcaataaagggttatcttgctactgcctaactaaatggtttttaataccaagttctttttctctgttataggttcgatctactggcacaattgaccaggtcacccggcagccaataaaaggacgaaagcgtggtgggggaattcgatttggagaaatggaacgcgactctctgcttgcacatggagctgcatatcttctgcatgataggttgcacacctgttctgattatcacattgctgatgtttgttcactt

SEQ ID NO: 5029 - DNA, 390 bp, Glycine max
ctcccctcaagggcttgctgatgaatctgattcttactataagccaccagtttacaagaaaccaccagtgtacaagcccaagcccaagccacccattcacaagcccaagccacccgtttacaagcccaagccacccgtttacaagaaacccccttatggtaagtacccaccagttcaagacaacgatcacttctaaaccatgcaacaaggcatgttaatgttaactatctactaaaataaagaggttcagttaacctactacgtacgttgctccttttaattcctaaatcgtaatttacaactttgtagggatgagacattcttggctagctctgcacttcaatcctttatttgtacaatgctatggccaagtcaataccatgcatctta

SEQ ID NO: 5030 - DNA, 1135 bp, Glycine max
  misc_feature (434)..(455): n is a, c, g, or t
  misc_feature (459)..(459): n is a, c, g, or t
  misc_feature (465)..(496): n is a, c, g, or t
  misc_feature (498)..(498): n is a, c, g, or t
  misc_feature (504)..(508): n is a, c, g, or t
  misc_feature (512)..(513): n is a, c, g, or t
  misc_feature (519)..(519): n is a, c, g, or t
  misc_feature (524)..(533): n is a, c, g, or t
  misc_feature (537)..(543): n is a, c, g, or t
  misc_feature (547)..(547): n is a, c, g, or t
  misc_feature (549)..(549): n is a, c, g, or t
  misc_feature (551)..(551): n is a, c, g, or t
  misc_feature (553)..(553): n is a, c, g, or t
  misc_feature (561)..(561): n is a, c, g, or t
  misc_feature (565)..(568): n is a, c, g, or t
  misc_feature (578)..(580): n is a, c, g, or t
  misc_feature (591)..(595): n is a, c, g, or t
  misc_feature (599)..(602): n is a, c, g, or t
  misc_feature (610)..(613): n is a, c, g, or t
  misc_feature (616)..(619): n is a, c, g, or t
  misc_feature (629)..(635): n is a, c, g, or t
  misc_feature (640)..(640): n is a, c, g, or t
  misc_feature (646)..(651): n is a, c, g, or t
  misc_feature (660)..(666): n is a, c, g, or t
  misc_feature (669)..(671): n is a, c, g, or t
  misc_feature (673)..(674): n is a, c, g, or t
  misc_feature (692)..(697): n is a, c, g, or t
  misc_feature (709)..(723): n is a, c, g, or t
  misc_feature (725)..(729): n is a, c, g, or t
  misc_feature (737)..(737): n is a, c, g, or t
  misc_feature (739)..(743): n is a, c, g, or t
  misc_feature (752)..(766): n is a, c, g, or t
  misc_feature (768)..(789): n is a, c, g, or t
  misc_feature (793)..(795): n is a, c, g, or t
  misc_feature (798)..(799): n is a, c, g, or t
  misc_feature (805)..(815): n is a, c, g, or t
  misc_feature (819)..(837): n is a, c, g, or t
  misc_feature (842)..(842): n is a, c, g, or t
  misc_feature (844)..(844): n is a, c, g, or t
  misc_feature (846)..(846): n is a, c, g, or t
  misc_feature (848)..(852): n is a, c, g, or t
  misc_feature (862)..(862): n is a, c, g, or t
  misc_feature (864)..(864): n is a, c, g, or t
  misc_feature (871)..(872): n is a, c, g, or t
  misc_feature (876)..(879): n is a, c, g, or t
  misc_feature (881)..(886): n is a, c, g, or t
  misc_feature (896)..(897): n is a, c, g, or t
  misc_feature (899)..(901): n is a, c, g, or t
  misc_feature (904)..(905): n is a, c, g, or t
  misc_feature (909)..(926): n is a, c, g, or t
  misc_feature (934)..(934): n is a, c, g, or t
  misc_feature (936)..(937): n is a, c, g, or t
  misc_feature (954)..(961): n is a, c, g, or t
  misc_feature (964)..(970): n is a, c, g, or t
  misc_feature (974)..(977): n is a, c, g, or t
  misc_feature (979)..(981): n is a, c, g, or t
  misc_feature (983)..(983): n is a, c, g, or t
  misc_feature (990)..(994): n is a, c, g, or t
  misc_feature (1000)..(1002): n is a, c, g, or t
  misc_feature (1004)..(1011): n is a, c, g, or t
  misc_feature (1013)..(1016): n is a, c, g, or t
  misc_feature (1019)..(1023): n is a, c, g, or t
  misc_feature (1025)..(1029): n is a, c, g, or t
  misc_feature (1033)..(1051): n is a, c, g, or t
  misc_feature (1055)..(1056): n is a, c, g, or t
  misc_feature (1060)..(1068): n is a, c, g, or t
  misc_feature (1070)..(1074): n is a, c, g, or t
  misc_feature (1076)..(1078): n is a, c, g, or t
  misc_feature (1085)..(1085): n is a, c, g, or t
  misc_feature (1089)..(1095): n is a, c, g, or t
  misc_feature (1102)..(1118): n is a, c, g, or t
  misc_feature (1121)..(1124): n is a, c, g, or t
  misc_feature (1128)..(1129): n is a, c, g, or t
  misc_feature (1131)..(1131): n is a, c, g, or t
cttttgttatcgcccagctggtgagtgaattcaacacacaacactacttttggcctatttacattgtaaatatagtagtgataataacttgtccatttgctttcatgagcagatagctaccttaattgcagtttatgcaaattggagtttcgctgctattgaagggattggatggggttgggctggtgttgtttggctttacaacctcatcttttatatcccacttgactttatcaagttcataattcgatatgccttgagtggaagggcttgggatcttgttattgaacaaagggtatgtgttccctatctatcaaaaagactagttcaacatttgaaccgttgcttactctgtaatatgaaatctttgtcagattgcttttacaaggaaaaaagattttggaaaggaagaacgtgaacttaaatgggcacannnnnnnnnnnnnnnnnnnnnncccncccccnnnnnnnnnnnnnnnnnnnnnnnnnnnnnnnncnccctcnnnnnttcnntctctntcctnnnnnnnnnntccnnnnnnntttncncncnttttcctncccnnnnccctttcctnnnttttttttttnnnnnttcnnnncccctctnnnnttnnnnttcttccctnnnnnnntttcnctttcnnnnnnccccctttnnnnnnnttnnntnnctttccttcttttctttnnnnnncttttttccttnnnnnnnnnnnnnnntnnnnnttcctctncnnnnnctttttttnnnnnnnnnnnnnnntnnnnnnnnnnnnnnnnnnnnnnttcnnnctnntttttnnnnnnnnnnntctnnnnnnnnnnnnnnnnnnnctctntntntnnnnntttttttccncncttctcnnttcnnnntnnnnnnttttcccccnncnnnctnntttnnnnnnnnnnnnnnnnnntttttttntnncttttccctcttccccnnnnnnnnccnnnnnnncccnnnntnnntnttttctnnnnnttttcnnncnnnnnnnntnnnntcnnnnncnnnnnttcnnnnnnnnnnnnnnnnnnntttnncccnnnnnnnnntnnnnncnnnccctttntttnnnnnnnccccctnnnnnnnnnnnnnnnnnccnnnncccnntntttt

SEQ ID NO: 5031 - DNA, 434 bp, Glycine max
tcggcgaagggggtgatagtgtgccatcgccaccaatcctcggaagcaacgaaggcgaagtgggtggagatcgatggagtgaagctgttggaggagcacgtccagcgtgttatggtgaagaaggccacacccgattggcttcccttcctccccggttcctccttctgggtcccacctcctccttccccctttcttcacaaattctccatcccctctcatcccttcttccttcaaggtctttcttctctaactcacttttacttttacttgtaatttatctaaatcctattctttaacatacaattcactattgtttatggccatttagatgacgaatctgggaattctattgccacccctcgagggacagaggttactgtgcaactcaaggttatgacacccgctgaacacgtgtctctctctgaagatgagga

SEQ ID NO: 5032 - DNA, 545 bp, Glycine max
  misc_feature (383)..(385): n is a, c, g, or t
  misc_feature (515)..(516): n is a, c, g, or t
aaatgtttataattgtttccacaacttccacttgcttgcttttgaataactcagcttcttcacctttgcttctgtcttgttgtatcgattcagttaaatatggctcgtttgctcttcccaagtttgaaagaagaagaagaagcaaatggagagccgttgatgggagtggcgagaagcaatcagctgttaccgtagcagcaactaccacaagtacttttgatgatgataacgacgttgttgactcagcttcagctgtgttgaagaatttctatggaggaatcaatgcgcatgacgtggattctgtagagtaccttatcgctgagaattgtgtgtatgaagatcttgtctttccccgaccctttgttggtcgtaaggaaattcannnaggacagccctcacttgatcaatcccatatgctattcttcaacggaggtatgtttcatattgtttcatacattagtgttttgcatgacattaaactaatcgaaaatcctaaatttcattatttgtgatcnnacaggtactaattctcgaaagagaggaag

SEQ ID NO: 5033 - DNA, 706 bp, Glycine max
ttcctgctttcttcatttccttcatttttctgcccttagcaaccaattcaagtgaagcagtgtcagctataatttttgctagtcgtgataagaggcaaactgcctcattaactttctctgaggtttgttttctggtttttactctgtctctttagggcattagcatgcaagaattgattatgacctataaactattaagcttttgaaatcaactctttcactcaaattatgttgcatgatctattcattcagaacttagctaaataacatgggtgaattgactatgatttattcaggatgatgtttatagttaattcagttattatttaacgtgatgtacatgactaaggctggcttattttataagctttgcagttttttttataagcctttcaacacatgcacatgtataattagtgtaattttttcccctccttaagtcatttaaaaatgatttctattgtttttgcagctatatggagcagtgacaatgaataatgtgctttgcctatcagttttcttggcccttgtctatgcgaggggattgacatgggacttctcttcagaagtgttggtaattctcgtcgtttgcattgtcgttggcgtctttgccagcttgcgcactgtcttccctctatggacagctattctggccatcctactctatcccttctctttggcattggtgtacgttcttgattatgta

SEQ ID NO: 5034 - DNA, 410 bp, Glycine max
  misc_feature (161)..(161): n is a, c, g, or t
  misc_feature (164)..(165): n is a, c, g, or t
ttgtacggttgcactctgatatttaaataatttattttcccccaaagtttatgattagatttccatttttcgtctgtatgtgcgtctgtatatgtacatgcatatagactgcatgaatagataattagaacaattagcacatatactgctcatgttctaantanntcgtgtgaaatgtaaagcagaaaacaaattaagagatgcgagtggatcaagagacattggattgtttcagcttaaccaatggtcttgaatttgagttctagacatgttgttcaatgagagttttgttatccataatgatgattctatccaattcaggttgcctcctatggaaaatacatttggttcaagcaatatatctgtgacatacattgcagttttccccaagggtgtgtttgacaatgaga

SEQ ID NO: 5035 - DNA, 322 bp, Glycine max
ccctggttattatacttctcaattgaaagcagctaaatactatgtaatatggccaacaactttcactcattgctcccatatctaaaagttgattgatccttagaatcttatcttctacatgaggaatagatactgtgcccacttccgttggtgaatggaactcttgattctattcaatctcccttctccaaccctctattatatatcctgcaacctgctttgtttcttgtagtgttctaatcattttggctttggctttccaatcctcctgatttcctcttctacgattgtaaaatatcgcaaatggcatccaagagaatac

SEQ ID NO: 5036 - DNA, 376 bp, Glycine max
ccttgtgaggaaatgcttctttgcagatctcattgaaggccttaacaatgacgtggtggtgacactgcgcattcagctgaagaaagcattgcaaaaggtcttgaagatcgtcctctgactcgatctccttttcaaagatcatttggagcatggaatgcctgaaatcatgatacggattcgacgaatccttctcaatcgccacgctattcacaagggggcttcgtttgagtacaacgttgtcgtcgttgttgttgttgttgtgatcgtgaaatgtctcggattcggagattgtggtggaagtgaactcctcttcatcaacttgctcaggggaagtggtggaagaagccatgctgctaaggttgtggttgttgttgtt

SEQ ID NO: 5037 - DNA, 300 bp, Glycine max
ttgctagttgctatgaagtaataatttgatgattcgggatatctatgatggggttatatttaaaatggatgtgtggcgtcgtgtggtgtttgaaatggtagttcatcacgcaaggcacgtctccaccaacattttactgaatatagacaaaaaagagtttgtaccccatccccctccacacacattaaatataaaatacatgcttgcaaaatagaagttaaaaaaaaagcaaagaaacaattaaaaaaattgtaatagaaaataatacttgtaattttcaattattttgcacaaatactt

SEQ ID NO: 5038 - DNA, 868 bp, Glycine max
  misc_feature (806)..(808): n is a, c, g, or t
  misc_feature (814)..(826): n is a, c, g, or t
  misc_feature (833)..(834): n is a, c, g, or t
  misc_feature (839)..(840): n is a, c, g, or t
  misc_feature (846)..(848): n is a, c, g, or t
  misc_feature (850)..(853): n is a, c, g, or t
  misc_feature (860)..(862): n is a, c, g, or t
  misc_feature (864)..(865): n is a, c, g, or t
tatttgcacacaaccatagggcaaggcagtgccctcacatcttcattgaaattctcatcactggctaatgctataactttgaagaagttgataaggaaggggatacccccagttcttaggcctaagatttggttttccttgtcaggggcagccaagaaaaagtccactgtgcctgacagttattatgatgatttgaccaaagcagtggaagggaaggtcacccctgctacccggcagatagatcatgtgagcaactcacccccccttttttttttcatgatcatcacacattgggtttgcttttgaatttgattacaagtttcttaattgtggttgtgggcatcaccctttatttgacaggtgcttgcaggtgtgtggatcattttcaaatgaatttgatgcaggaattactttgtctagactttacattgtgttacttgtgaaaagattttcagacaaaattttgctgcagatttagatggatgattgtgggtgtgtttttttgtttttcttccaacgagcaaaacttattatttatgaatgatttggagagttaaggaagatctaagagttgaagcatttcttatccctatgtttgtaacctttacaatcataggttctgttagccatattgacgtatcccatttaaataatttatatgttcttgagtgcacggaatttaggttaggaaaaacgaagctttgagtaaatgctgattagaaagaaattgtaaattgggtggtatttgatacggtttgacatcagggtgtttgatgagatccttaaaatggtgattggttcttgtnnnttgttnnnnnnnnnnnnnttgaacnntgtcnnacatgnnnannnntgttcannnannata

SEQ ID NO: 5039 - DNA, 1546 bp, Glycine max
  misc_feature (1539)..(1540): n is a, c, g, or t
tgggtcttctccttcatcatgctttgtgattaatttccttctcaagtttcaatctttcaaagaggaagaagaaaaagaggctcgtgggactggattcgcttgaatttcgtgttgggtatggcgtttgagagataaaaacttcatttttttaaagccctgaaagaaagatggacagagttattcaacctcctttggtaattagcttattctgcactttttttccttttactagtttatatgccatttcatgtttagtttatgaggtcaagtggaaatccaatgctagtttagtttgagttcccttttttgtgtagctcttgatgttctaattgttgattttttgcgtcgccctaatgttgttgtttcgattggtctagtggtgaagggagaagggaaggggggagaggcgggttcaaatccctcctcctaacaaaaactaacaatactaacaactaacatttggcgttaaaaaaaaatgttgttgtttcgaaggagcttagaaaatgtttgtctaaaaaggagctgcaagacctctttttaaggtattgtggggattaatgaagggaagactttaagaattgatgcttggaagattctggtggttttaaggagctctgattttattctatactgcatgccattactcactgaacatatcttttgttacccttctatgatatatgatgcattttaacctctacgaaatttctgtgtcattttctttgaatcactgaaatgttgttactggctttgggggcataatagatgagaaatgcttacagttaaattttctaatccaggtttttagataaggatagtattttgaataatctaactgccaaattctcagtaatgtgagatcatttgtgcttttatcctaaaaagttaagcatgttgttcatcctgaattttggggatcggtggacccaaaactagtggattaattgttttttaacatggaccaatcggttttgaggtttgaggtctgtgtaccatgatgcatttcctaggtctcattacgtaagaccttcaaatgccttatcatattgtgagtgccaacttatgcagttcaatattattcaaaatgtcataaagcttgttgtagattattttttcatgatttataaattggtgattagcttatgtgtatatatgactttatctgaaaccgaaagattgctctccctaattaatgtttaatttattagtaaatgaggttctctatcttttgcatctcaagtattatctgcattatatgctgagggacatcaatgtttcatgtttgattccatggatcataacttcacagtttacagaaaaaagggatgtgctttcattttaattaaagagtagataaacaatttttttttttattcaaatgtgtttgtgcaggttgatacgactgcgtgtttatgcagagtagatacaggcctaaaaactgttgcaggagcaaagaaatatgtccctggaacaaagctctgtcttcggcctgacattaaaccatccattcacccaactagaaacaagccagcacgtgtnnagaagc

SEQ ID NO: 5040 - DNA, 761 bp, Glycine max
acatctagactgtacagttttgcagcaatactttagagaattcaccattacattatccttttcaactgtaggatttcatcgaggctacccgagaaggaagtctttcctttgtgttagctaagtttgatggattacttgggcttgggtttcaggagatctcagttgaaaatgctgtgccagtatggtatgtttcttcctgtcctttgttaattcatttgcatctggttcccatatcagaaggacaaatgacaagtcttttaatttactgctccattataaattacaggtacaatatggtgaagcaaaatcttgtaagcgaacaggtgttctctttttggctcaatggtgatccaaaagcgaaagatggtggtgaactaatttttggaggtattgatcctaaacacttcaaaggagatcatatttatgtcccagttactaaaaagggctactggcaggttagcaaaacaagatttagtttttatctggaattttctttaaatgtatattatattgttgaaaagctcacatgaatattttctttttcagattgaaatgggagatttttttattggaggtctctcaacaggtgacttcattgttcttcaatgctagaagatagttttagttgttttttggggagttatttagaaataattgagtgattgagttgttgaaaggatttagaatatggtataaggagcaaacttggtgtgtatttttcccctccttactgtagtatattttaaagaaacatgatctgt

SEQ ID NO: 5041 - DNA, 1362 bp, Glycine max
atttttaatttcatttttatataaaagaagaagaatcatcatctgtatacattactagccattagctaaacagacaaatgtgtttcagagtattattaggagtttctcttcttatcttgatttatctcattaatcttgctcctgcatatcctcttcaccacaccttgctttcaggtactatcctaactcctctctcttttaattaacttagaaaatgtcctaagttttaactcaatttttatcttgccaatccctttccctctagcttttttgatttgggttcttttttaattttcttcactattgcttatagttatagccctttactgcatttgttggtacctgttgagtgtatgctagctaataggtatcatgttcaataaacgtaggatatcttatcaagattgtggaaaatgaccataataataacataagctgcacatgcataagcttattgtttaatagaattattattacagggtcatcaagccaagttttctaattgtggaactgccgagtaaccctcttttccggtgctaaacactttctattctgtatcaagagtttctgatattttagtatagtattattccaaatctattattacagtccttttttccttaaccatgccattctttcatgtatcgcataagtctaaagattgaatttttgcatagattattaccgtccctttccaatgttccttgtctcccactattagaaaaatctcagatgctataactgctttttgctcaaattcctttgcaatacaaggcgtatgaactttactacaggtcggttggggaaggaaaaaaaataacgcttttgaaagatgttttaccagacagcagttcccattggtcgttgtctttcaatgttagtgatctataggggtatccaataccaaattatgaacttcgatatcgtgtgtgcttttgtatagtctacaaatctttaacaactgaaagtatttagaattattacctttatttgcttacagcatcctgtgagagggttcataattgaagaggtctactttgcagtcagtacttcaacataagctgggaatatagttattgttattgcactagtatttaccagtaggatgtgagtacaaatctttgtaataaataaccacatcattttcttctgcgattttcatttgggcagagtttataagcaatactaggggaattaaccttgttaatttctttcttaagcatgtagtaagacaattttttttaaacagaaattgtgcagaatagcaagttcgaagataagggaatactatatggaagtaggataggaggcgctggtcatggaggcagttcacacggaaatggaaatggaaattcaggatca

SEQ ID NO: 5042 - DNA, 475 bp, Glycine max
tggatccattcaaggcaagcaggctgtccactagtttcaacgtgaatagtgagaaggtttccagctggagggacttcttgagacttcactgtcaccctatagaggattacataaaggaatggccctccaaccctccatctttaaggtaagagaaggtaataggcatatataaaattaaagggtaggccatatataattaattttggtatgtatatatatggtgagcagagaagatgttgcagaatactgcaggaagatgagaggagtatcattgaaattggtggaggcaatttctgaaagcttaggtttggagagggattacattaacagggtagttggagggaagaaggggcaggaacaacagcacttggcaatgaactactatccagcgtgtccagagccagagctgacatatgggttgccagggcatactgatccgacggtgataaccatactcctccaagatgaggtaccg

SEQ ID NO: 5043 - DNA, 394 bp, Glycine max
actctcaatccatgcttgtgctcatgcttcccaaaatgacaggttacccctcagagttgttcttcaagtgctcttctttgaacaactgcatttgagaacagcattaaccagatgtctcaatgcattggacggtgaaattgctccggcagctcctgttcctataactgccctgggcaacacggcaggtgaaattgtacaaagagatggatgggtgactgttgtgcgtgaaaatcaggttttaaaggtggatatggataggatgagttctagagttggagaacttgaagaagagtttggtaaaataaagcaagaaatgaaaagtgcgacaaaatctcacagttcccgaagctcacctcggttggttgccaggaaaattgggtgtaagcttgttcca

SEQ ID NO: 5044 - DNA, 352 bp, Glycine max
  misc_feature (182)..(182): n is a, c, g, or t
tttgtattttgggtcaatgctgtcatgttctctgcaaattagggtttcaatccgtgctccggagtgattgattctgtttcatgtgttgaaaaggaatgtagctggaaaagattgtgtttgttctgaataataaaaatttcatcttcattgttggggatgctacggattttgtaaatttagcnccttttttttttctttttttgatttggcccttatcctggatttgtttccttaatccccttttgcggctaatcggatgaatatattggtaaatcccattggatttgagtggattctccaataaaggttggaaattttttatctgctggacccctttgggcacaaaattggt

SEQ ID NO: 5045 - DNA, 368 bp, Glycine max
tgtgcttggtctaaatcatacatatccatcatgggatgcttctttcgcttgatccaagctgaggcacacctttattcaaggagggctaaacttgactattctatgcactatacaatggtaattttccaacaaagttggaattaagactaccaaggtaaaggtggtcctcaaactccacagctgaagtcacaaaattaatcaccttcccatcactatcatcaagctttcttattatcctgccattagttgccacattcaccaccgttgctttcttcttgcagccattgacaaggttaattagccttggaaacgatgcaaccaagtgcttagttatcttgtagttgtggacaaactcaaatccttcagaa

SEQ ID NO: 5046 - DNA, 232 bp, Glycine max
aattgttgtctacaggtagatctgccttatatctcaaacttctgttgaaattttgaaatctaagaagcaaactatttttcaggagagccagaaacaaatcaaaagaagaacgaggaatatatgtgaagcatttcaaaaacattccaatggctgatatggaaatagttcttgtgagttacctcatttgtgaagcttttaatgaacattctaatttttattactaactttcccc

SEQ ID NO: 5047 - DNA, 368 bp, Glycine max
tgcctatgccggtacgctacgctttcaatttcttaaatagaaaatacttggatttgatttttaatagaaacgcctttgcaggactatgcttgttttgtctttacatctttgccgagtgctctcaatcaattaccttcttcgggagaactactgaaactgaagaacaagacaccatcatctaattgtaacataactactcattttcgctattgtatgtcttccccgtcaagaataaatcatctttgctgcactattcttttcaggtaagcctttactttccaacgatcaaactaagcattttatgataaaaaataaaatactgcttgtatttccgatgactaaatcaaacaccttctatttcaaggatg

SEQ ID NO: 5048 - DNA, 346 bp, Glycine max
cagagcatccaaaattcgttagaaccaagaatcaagtttttagtagatgtaatggggagacaagttgacgaagtcattgattatccttgcttctttcgtcatggtctgaagagaagaatagaaccacggtacaaacttctaaaggagaggagtttaaattgtagcttgagtgaaatgttggattgtaataggaagaagttcttcatgaaatttggcttgttagaagggcatgccttgagtaactaggtctcatccctattttatttttatttttgattgattttcataattagttaaatagtttatcaatatttctgtcctctgatgtggagtaccggtaactttc

SEQ ID NO: 5049 - DNA, 894 bp, Glycine max
  misc_feature (887)..(891): n is a, c, g, or t
gatggttagcaacaaaggattttgtggtgccattcagccgcatcagttcttttgcagaggcaaagtaatatctctatataaaagaaacaattaggttagtatgtttactttccaataagagtattttaaatatatgaaaaattattacgaagtttccaaaagaaaaaaggataaaagggcttccatattttgaattttctatatgattattttctgatgaacagaactttttgtgtatcaatgtatgactacccatttcctgtacatgtgtttccttaatttgtaagtcaaaccatggttaaatcaaacactttgcaattgttattttaaacttcaatcttttctagatagaataagtttcaaaaacctacattgtctactaatacaggtatgaagtctatttatgtcatgtattcatctactgtcaaacaataacaatgtgtcgttaaatgatgctattctcaaattaagttagaaagaaacaccaaattatccatgcaatgtaatccaaagaagaatttgctcattacctgcaggctgattgcaaaataaatcattggtatggagacaaacaagacttgccaagtaacaacagctaaaacggttagattagcatagcaattcatagtggctcccacagcaaaaacaaagccaaatgggacatcaaggtccacaatgctgagatctgaggagacctgaacaaggaaataacagtcaaagcataaaggcttccattcatcgcattgcactgtaaggggaaagaaaaaactgtttaatatgcttaccctactaagtatccttcctaaaggagtggagtcataaaatgacatgggggcacgaaaaagggagttcagtaactgtgaaaacaaagactttgatgattgaannnnnaaa

SEQ ID NO: 5050 - DNA, 385 bp, Glycine max
tgtcaaaacggataacataacggcaccttccgcttcgtttggatgcatggcgcaagataactaccacgacttatttccttctttggtcttagagaatgatccattttttagcaccctttcccaaacatcctcgttatctgcaaacacacctgaatcaaattattttgtgtctccgactttcctcgaacatgaattcgatggggtctgtaacaagccctgccctgattctgaacttgcccggctggtttcagctgatacatcaatcaccagttctccaattttcgactttaatttctcgctcgatgcagtgggaattgattatccaaatttccccttcaatatatgaaaatatggttagcatttgcagaaattgcacttgagaatg

SEQ ID NO: 5051 - DNA, 822 bp, Glycine max
  misc_feature (59)..(61): n is a, c, g, or t
  misc_feature (623)..(625): n is a, c, g, or t
  misc_feature (694)..(701): n is a, c, g, or t
  misc_feature (714)..(717): n is a, c, g, or t
  misc_feature (719)..(722): n is a, c, g, or t
  misc_feature (728)..(732): n is a, c, g, or t
  misc_feature (735)..(739): n is a, c, g, or t
  misc_feature (741)..(752): n is a, c, g, or t
  misc_feature (758)..(761): n is a, c, g, or t
  misc_feature (763)..(763): n is a, c, g, or t
  misc_feature (771)..(771): n is a, c, g, or t
  misc_feature (774)..(776): n is a, c, g, or t
  misc_feature (794)..(794): n is a, c, g, or t
  misc_feature (811)..(816): n is a, c, g, or t
ttaaagatcaagcttgtgttactgaggcaaaagttgaagttaacttccattctaaaacnnnaggtatgattcagatctctgagctttcaattttaaaacaatgtgtcttgtgcagtgaatgtaacttgtggaaggtgattagcttgataaaattcacattttaatccgtattgcttttgtttttatttataattgcttgctgttgaagtccatgacctctttataacttgatgcaaagttgatgaattgacaatattttagcaattcaatattgttacttccaaccatatcttgtaaggattaaatgctatgtttactcgagagtcataatcagcattcatcaattcaatagaagtttattgtgcttggtaatagatttcgtatttggaggaatgggcccttctagatagagatcactccagttctttgcttggagcaactgaagctttgaaggccagtaccctccgtcttccagttgttgaaaaagcaatagtatgttctacttttcttttttgatttttttatactttgcgcactttttctaaattagactgttaaatattaaactgtttttctttatcaagctgatgtaccaaatctaaaggatgctttggggtctgcannngatgtgatgcaggcaatggcatcctcaatatactctctttcttcaaaggggattttttttatatcttcnnnnnnnntattttttgtaannnncnnnnctcttnnnnnttnnnnngnnnnnnnnnnnnctatcnnnnantcactaanaannnatccttacctttttatgnttattttttaaaaaaannnnnncaaaaa

SEQ ID NO: 5052 - DNA, 260 bp, Glycine max
tgaacagtgcaagcagagccattgggagtgctactctccatatcttcactgtctccgttcgcaaaacaaacataacatccttcaagctttccaccggcaaatagtcgggttctgaagtatgcttttggatcactaatggggtttccatttgaggagttctttttcttccctcaacactcagtttctttctaactgaagtttgttataaacttccaatcatacaacaaggagtcataaggatggcttggttgttgaatgca

SEQ ID NO: 5053 - DNA, 750 bp, Glycine max
  misc_feature (736)..(736): n is a, c, g, or t
  misc_feature (738)..(738): n is a, c, g, or t
aaggaacgtgatatcatgatgctgtaaagagagagagatatgagataattcacaattcctcctttatcttgtttcatagcagtgaagaaaaaaacagagaaagcatgggcgtggacttctacaagattcttcaggtagatagaagcgccaaagatgaggatctcaagaaagcatatcgaaggctagccatgaagtggcaccctgataagaaccctaacaacaagagagaggctgaagctaaattcaagcaaatctctgaagcttatgatgtatgtcaattcaatatatatacatgcccttttgagtctgtttgtttgttttccccttgaaagttgtgattttgttgaagggttcgtatgaaaactgttttccatttgtggggttttcctgttttgccctaatttgaatgttatagagctgagtgtttcagaacgcaattcgaatttgatgtcgtcttatttcgtacgaagttgcaattttttgtggaggattttcaattttgagtttgtggggttttctaatttcaatctgaaagtccgaggtaggcttttggtttatcactgttggtaatttgatgttcaaaggtttttcaattttcagttattctgaggttgattattttattttatttttttgcttatttgaattgtgaaacaggttttgagtgatccacagaagcgaggagtgtatgatcagtatggtgaggaggggctgaatggggtgccgatgggcgcancntggtttcctggt

SEQ ID NO: 5054 - DNA, 615 bp, Glycine max
tgaccactcatgaattctagttaaagagcaaattgaaattcacagttgctgttacacagatagagaaagaaaagctatcaccaaaattcacctcactcaggaacatcagccactttgtaggattctgcagtgatctcagccagccataaaccaggaaaaagtgtctgcaataaattgaaccaaaaaaacaatgtgagaagagcaaaatgacaacactgaaaaaaaacctaattgaaatacactaacaatataaagattttttaagttataattcaatcacaaatagctatggtaggttcgctgactattataataactagtaacttccttaaaactcaggttttctacattatcatttaaccacagattggtaagtgttctggaccagccttcaacggttcaacctactgccttcctccgctccaccgccttacatgttggccacgaaagccagattcaggacattgttaagtcttggattcaggagtgacattgaagcaagttcgtcttctttggccgacctttctggccaacatgtgtcttaccgaggaccccaaactgacctcgacctattcacgcatcttgtgtgcagcctaatcgtcttgtcacgtggcc

SEQ ID NO: 5055 - DNA, 373 bp, Glycine max
tttcttatttcattatattggaactattcctttccccacgttttgatcctttttttgtatagtgtattactatcgatgagagtaaaataacatgtcgttttagtttttggaattataaaagaaaaattgactctaaattagttaatgttggtaatttagcttgacattcgacaacattatttcccttatttgtttgataggaaattaggaaggagaaagtgataaaatgccatgggcctcaatgttagaacaaaactcttgaagagcatgaagtccctagtttagttttgttttgataattttgtaatgcctaacatgttttgatagatgagacatttatattagttgttttagtctaggcatgtgtgtctga

SEQ ID NO: 5056 - DNA, 491 bp, Glycine max
  misc_feature (404)..(414): n is a, c, g, or t
  misc_feature (416)..(418): n is a, c, g, or t
  misc_feature (420)..(435): n is a, c, g, or t
  misc_feature (439)..(439): n is a, c, g, or t
  misc_feature (446)..(450): n is a, c, g, or t
  misc_feature (455)..(465): n is a, c, g, or t
  misc_feature (467)..(468): n is a, c, g, or t
  misc_feature (472)..(474): n is a, c, g, or t
  misc_feature (476)..(479): n is a, c, g, or t
  misc_feature (483)..(485): n is a, c, g, or t
ctaaaattatttatatcaccacaacaataagaagatgaaagtggcaaatacaactcaatatgtctttgtaaaaagtctgtcacatgaagattaaaaaacaagagtttattgaagattaccaacttttttcataagcaaaattttaatagattttggagagtacaaggagtactctaatccattaacaagatacaaagtaggtcaacactaagagatacaatagaaaggttcaatataccattctgaatagtaagaaccctctaatttttctcaaaaccaaaaccataactagaccctaataagatccaagatagaagtagtatcaattgaccctcccctaaatacattctcattcctcaaaatcacacaaaagaactcacttattctgcggtttctctttgcannnnnnnnnnncnnncnnnnnnnnnnnnnnnntccnccccctnnnnnttatnnnnnnnnnnntnntccnnncnnnncctnnntccccc

SEQ ID NO: 5057 - DNA, 626 bp, Glycine max
  misc_feature (588)..(590): n is a, c, g, or t
  misc_feature (610)..(622): n is a, c, g, or t
caatgtatgtatgtcaataccgcttcaaaattgtcttttttcaactctaatctcatgtaataatagcttttgcactccttcaaatctcagcagtataattttgttggccgaattctcggacctcgtgggaactccttgaaaagagtcgaagccatgactgaatgtagggtttacattcggggctgtggctctgtcaaggattctattaaggtatgcttacttgctatctaactataccccaccccacctttacaactttttttctcaactgcttcttctttataggaagaaaagcttaaagagaaacccggatatgagcaccttaaagaaccattgcatgtgttggtggaggcagagtttccagaggatataatcaatgctcgcttggatcatgcagtggcaatactagagaatcttttgaagcctgtggtatatgttgttatagtgtgtgtgtgtgtgtgtgtgtgttattgcataataaataaattgtgccatgggctatcatgctaatcttcgttaacctgccactgccaggatgaatcccttgatcactataagaagcagcaattgagggaactggctatgctnnnatggtacttgagggagaaannnnnnnnnnnnncccc

SEQ ID NO: 5058 - DNA, 1188 bp, Glycine max
  misc_feature (1171)..(1171): n is a, c, g, or t
  misc_feature (1181)..(1181): n is a, c, g, or t
  misc_feature (1185)..(1185): n is a, c, g, or t
aatcctctcggtatgatcactcaaagggtaacttcttgcttttgctgccttttcattattatttattttattttcaatagtcatgttattttgctttgattagtttacatttctaatggttctaagcttttgtttcctctctccctgccaaaaatcttctaacttgtagatctatgtttacatcgaagtgcctctgctgcatccaatgataacaagccttatgatcccttctctatgaccagtcatgattctgaactggatcagctcagagactataaaggtactagattgttagtattaggttggagttctatacagaaatttgccaaaccattcttgaaccttcatactcttacttatccttttatccaagacagacaggattgattgcttaaattgtttccctctattaggagataactattatcttttgctatgtttttttatcaacctgcagaattgacaggcctctattactgaggcatatggtattctgaaggggatgggatgtaaaaggttaatgtatgcaggcatggatgaagaggacacctaatagtaaataaatggaaaattcatgctgttaagtctggagcataactgaatgctgggctgcaaggaatagtggaggaggtggtaaatctgttgaggagaaatgagaatattaaaggaaggataggcactggtactgcatggtaggcttgaattgagaggaaaaggggatgggcttggtctgggttgagtaatttgtagaaaacttaccttttttcaggatgtggtaatttgtagaatgacaatcattgctgtgccttgtctttcgttgttctgcaccttaatattgttataaagataatttgtttcttcccagtcccgggtatttgggttgtgcactgttttttgtcatattctaacaatctaacttctagaagataaattggtggtgacttagtaatgtagaaataagttagtcttcagattttctgaatgctccttcttttgaattcacagagaatgagactttatccatcagttccactggaaagtaccacggtgtggagagagcctcttctgttaagagttctaatgcttctcagatcaaccgaatattgacatgtaatcggttggaaagttcgctatccatttctgaaactcccagcacttcaactactgatcntatcactaangacnacg

SEQ ID NO: 5059 - DNA, 1014 bp, Glycine max
ttatactcatagcagcatttaccttcgtttctgtggctagatctgcgtctgatcatttcttcgaaaacgatggcgtttcactggcagttgctgcaacgcccggacctccacctctcatggtccccctcactcttattcagggagctgcttccaaaggagccggtgaaattatttcttttgcatttgtaattctttcttaaagctatgttctctgtgttgtaatgatttaaatgctgccttcaccattaagccactttgttattattatcctccgtacttagcattactctttccctttgtacccccgaatgctctctttatcatttccgactctttttttctttttcaaatgcgtgtgattagatgagcgtttgcaaaattaattttgaattaacttgattttgaagtgaagtgatttatagttgggtgtttttattctcaaagtaaattagtagtggaacttaatattattttctttttctgacacaaaagttacctagagttgctatgactcaaaaatcaattatggaccagaatctattcgtcaacatgggattaaacatgtgaacttttatctaaactcaacgtgaaatcaaacatgcacaaatctctcactccacttcaattgcatactcaagatttatatttttgttttgtcctgtattgccagtctgtttggatggaacattgcctggttaccactttcatcctggatttggatctggggcaaatagttggctcattcaattggaggtatgtaaaagaatatccaagtgttttgacatcgagtctcaataagaaattaaaaatactttcaagattttacaatttcttaaagtttgaaaatctgtatgcaactgtgataatttataggcatgctattatatcatatacctctgagtacttgtctacctgtcttgcttttttataccttactgcagggaggaggatggtgtaataccatcagaagttgtgtctttagaaaaactactcgtcgtggtcctcaaaatacag

SEQ ID NO: 5060 - DNA, 956 bp, Glycine max
cagttggcctggtcagctgcttggtgtctctgatcttaattttattactgcattagaattcataaaattaatattttcatataaaaatgtaaatgttgctttggttttaattgccaggtaggcttacactgaccaattactctctttactttgaggcttccggagtaataaggtatgaagatgctctcaaaatagacctctccaagaatattgagcagagtgttgaacctgctgccacaggtccatggggagcacaactttatgacaaagccataatctatgattcaactgatttgtaaggacactactagcatagcagcttttattatcatcaatacctactatggagttatgtatgttaaaaatgcacatggaaatatccagtatggatttaatcttcataaaatatatgtgcatgcttgtatatttacagaagcacttggcttctaagatttcatcaacgtaaccctttcagtttttggtgaagctcaaacctcagacttaccaccacaatcttttaaatgaacacgattctgaagaatcatagaattttcggaattctacatctgatgtgtatcaaaatggtctgacctaaaagcttatgaacgggagaaatcaatatgttctctctaatattttgagtgttatttcttattttttatggctttgacgtaatcatatcttggttctgattaagtttgttagtaccatctcaatgtaatatcaaatatagaaatgtatctaatcttcacttctgtcattaagttttttttttcacttctgtcattaatacgagtaaatttttcttctcaattttgtagatcagagacagttgtactggagtttccagagcttacgagttccacgagacgtgatcattggcttgcactagtcagagaaataatgtttctccaccagtttttatcaaagtaccagataaaatgtccaatcaaaca

SEQ ID NO: 5061 - DNA, 245 bp, Glycine max
ttttattgaaatttaggtgttacaagttctctttcgactttctttacccattgtatgtcagggtaggtgtgtcttaatgtgttctctgtaccgaaatacaattcagattgtgtttggtgggttcatatttggatttgaggaggtttgaatctccttaagaaataaagttacgatgttctgatatgaatgtgaaataggttctacttgaaatgtgtttctcaattcttatttgttgagatctactc

SEQ ID NO: 5062 - DNA, 436 bp, Glycine max
ggttcaattcccagctagcttagatcgatctgtttcttaaaatttcaactacaaagtgtcaattaatgaatgaatgcaggtttatgttccaagactggatgatcctggttcaggtacattcgagcggtgctctacggatacatttgagatatacggtccatgtacgtaccagacatgttatctgtatctataccggagtggatacgacggttggatgccagagaaagtgaccgtatacagctattactaccaacctgttacattttactacaacacttacatacctaatgatatttggtatggctttgactattgtcgcggttatttaccctccggtactgccgcacagtagaggctagagtagtgtgtacccttctcagttctcatcacaaattactacaataaaacaagtacaagtccaaatatgaaaccctgc

SEQ ID NO: 5063 - DNA, 573 bp, Glycine max
  misc_feature (60)..(60): n is a, c, g, or t
  misc_feature (62)..(63): n is a, c, g, or t
ctaccccgctgcaccagatcccacctccctcccttcaccaaatccccaaaaccgagaaancnncaacgattcatcgtctaagacgcttcatttctcatacccctccgccgttacttccttcgtctcctccctcaccggcgacgccgccgacaacaaacaaccatccccggcggccacgaccacgacctcccactttcagatcacgagcctctctcacgtgtcgtccgcggggaagcctccgctttcgtcttcctctttcaagagaaagtgcagctctgagaatttaggttctggaaagtgcggtagctcctctagccgctgtcattgttccaaaaagaggtatctcgatttcggttttttttccataactaaatttagagtcgtaaaaatctaaatatcgaatttttaaagattacatgtaattaattttgattttgcttgtaacatgttctttttaaaaataaataaaggtgatttattttagcaattttgttctcatgatatctatatatattttcgcgtgactctgtaggaaaatgaggttgaagagggtagtgaggaaggggaaggggg

SEQ ID NO: 5064 - DNA, 751 bp, Glycine max
  misc_feature (669)..(676): n is a, c, g, or t
  misc_feature (704)..(717): n is a, c, g, or t
  misc_feature (724)..(726): n is a, c, g, or t
agtgggacgtgaagacccaagaaggttgatccatgcattcaaagtgggtttgtctcttactcttgtttctttgttgtatttgttggagcccctttacaaggggattggacagagtgctatttgggctgtcatgaccgtggttgttgtgttggaattcaccgcaggcaagttattctcttaaatatatcaaatatactataatcaaaattaattactcttactactgcatggcatgtgttggatgatcttaatatttttatttcttttggttccaggggcaactttatgcaaaggactcaacagaggattggggacattgttagcgggattattggcatttcttgttgggtatattgcaagtgcatctggccgagtctgtcaagctattatcatcggagctgcagttttttctataggtgtatagattaatttggtttacaaatttaatttataacaaatcagccaaaaaataaaatcaagacttaaaagtcgaggttccctgataaaaggactattttttaattattctaccaatgttaaacactgtgactaattcacttcatttttagttttaaaaacttatatcacaataattaatccattcaatgaagataacaaattaaattattattagcatggatggatgtattgacaaatgacaagcttgtnnnnnnnntgatgactaaatataactcttgaaatannnnnnnnnnnnnngtgatgnnntttcttaacaaaggtacatcaattt

SEQ ID NO: 5065 - DNA, 774 bp, Glycine max
gtgttccggcgctgactacacaatcacattttgtccttcttctccaaggtaaacaaaacacacatttcgatcctaaggtcaagattctaaggtatctgcaattctaattgtgatcaatgcatatgggtcatgatatattgcagatatcctaaaccaagatcatgattacattacaactaccctaaaaaatgttgacgttatggcgtaaattattacaattttgatcataacgtcaagatttcaaagatatctacaattgtaattatgattgatggacgatgtttatcggttataattatagttgcagatatcctgaataacaattataattgcagacatatattaccacagaaatcatgtccatagacccttttttaaaactttgattgtaattatctacgatcatgtcaagatcacaatttaaaaaccttaggtaaaatgttagtaattcaattcacataagatgcttagtgattgaagttcatttttttgcagtttaaagtcttcaacggattcaagtccaaagggaatagatggagggtcagggtctgtgggaggttcatcggttgagcaatctgaattagcttctacttcgtggttagccgacatggcaacagctacaggggcctcaacacgaacacggcctcttgttgcatcaaaggtctctttttctgtggtggtggttttcattctctctcttttggtcgcttagcttctgggtccccctctcctagtgacgtctcaactacatccttatcttccttcttcccttca

SEQ ID NO: 5066 - DNA, 447 bp, Glycine max
  misc_feature (352)..(352): n is a, c, g, or t
  misc_feature (367)..(371): n is a, c, g, or t
  misc_feature (373)..(373): n is a, c, g, or t
  misc_feature (380)..(383): n is a, c, g, or t
  misc_feature (386)..(391): n is a, c, g, or t
  misc_feature (433)..(435): n is a, c, g, or t
  misc_feature (437)..(437): n is a, c, g, or t
  misc_feature (439)..(439): n is a, c, g, or t
aagatgattaatccaaatgacaccaaggaaaattcggacatagtttcttctgctgacctaccccattcaaaacccagagttcattcagaggatccatctggaaagggatcagtgagaacaacacatgagttacaaaagagtagggaggatggtgatcctaaacaatttactgactctccagctcgccatggtggcggtgattcttcccatcgaggtcatggagtaggttctgctgacaaccgtaaaagaccttcaagacaaagtactgggcctgagcacaacattgaccgttcaccccttcatcgccaggcaaaaacccctggcagagatagtccttcttgggaagatagtnaacaataccaacagnnnnngntaaattnnnncannnnnnttatctccctattcatcctcatccccaataaggaacagcttnnntngncctggttc

SEQ ID NO: 5067 - DNA, 343 bp, Glycine max
  misc_feature (231)..(231): n is a, c, g, or t
  misc_feature (272)..(274): n is a, c, g, or t
  misc_feature (325)..(325): n is a, c, g, or t
  misc_feature (334)..(334): n is a, c, g, or t
  misc_feature (337)..(338): n is a, c, g, or t
  misc_feature (340)..(340): n is a, c, g, or t
gtgcttttggttctagatttgatgtccatcgaacaatatagtttcattagcttatgagtacaggtggcaagttgtgcggttgaaggtttactagctgctattactaaaggcatgcaacgtcgtacagcaaataaaaattcggcttgccaccaataaggttttttttttaagagctagcctcctatgagttggtttatatcattctatgtttctttccttcgttacatgggngtaggggaagatgactcctcttagtagaagaacatccaaannntgtagtgaaagtatttataggaatgacatggtgactgacaatctcttgccnataaagggnacnntnttt

SEQ ID NO: 5068 - DNA, 380 bp, Glycine max
gcccttttcttcaaaccaaacaccaacccatattccacacactctccccaattcccctgacacaaaaacccacttttcttcgagccacagactcgaacatcgacgcccccatttccctccccgagggcgcgtccttcgtttccatcccagaaatcatcgagaaggactggtccgtgcttgattgcgccgaacaccgaaccactgaccgcattatagcttccggaaacatcgaacagagttcgagggttttggtctcaactgggtcagaagactttgttgattccttagcgggtttaactccctctgtgtttgttgttcatgactcgcttctgacactggcttgcattaaagaaaaatatgacagggttaagtgttggcaa

SEQ ID NO: 5069 - DNA, 487 bp, Glycine max
aaaatggttgacagtgagcataaccctaacactcaccgccgtttccatctctggtaggtattcattcatatatgctatttcaattcctattcctattcactcaccatgctcatctctctctctcgctgaaattaattttgcagcgtacgtattaaagagaaaatggaatcatctgaactccaaaattgaggagcttgaggcatctctcaagtctttctcagacaattgcgcctccgaaagacaaggccgaattagagctcaacaggccttgagaaaagaagtaacacagtcgcaacctaattctcaaaagcttaacctcacttcttatcccatgatgccaattggtgtcgtccactcgtgcttctccaccaggaacgggacgccgaggcaaccgttactcgtcccacttgctagggcgtgtttggttttcaacacaactcgcgttccaccggcgtctctggagggtttggaggaatattccctttga

SEQ ID NO: 5070 - DNA, 612 bp, Glycine max
  misc_feature (62)..(67): n is a, c, g, or t
  misc_feature (591)..(593): n is a, c, g, or t
aatgagctcaatgccttcgtgagagttaaaacaaattagagatgatcgtgatcgccaattgnnnnnnagtacatgctttaactggagaaatagcaaagtacaaagaatatacagggaaaacatgtacacaattggatacgttgatgattaaaacaaatgctcttgaggtttgttgttttgttttgttctgtttctaccttttataattttgttcttttcttacataaatccaccgatttatgtaatgtggggtttctttataggagacttgttcatctcaaaaagagcaaatacatatactgcagcagcagttgtttgctgaaaaggaaaagtttaaggtaatgcagttggcttttattcttaacatggagcagtggcttaccattattattatttttagaaataaatgacaaaatggtattcggtgattttttcttccagcgatttagttttttgacaactagacctgacacaaaactttattttctttctgttagaatgctgatttatcttcttcagaaacaagaacaatgtttgaagagcagaagagaatgatccgtgaactacaggatcgattggcagataaagaannncaagttatgaaggagagag

SEQ ID NO: 5071 - DNA, 755 bp, Glycine max
  misc_feature (51)..(51): n is a, c, g, or t
  misc_feature (371)..(384): n is a, c, g, or t
  misc_feature (386)..(396): n is a, c, g, or t
  misc_feature (399)..(406): n is a, c, g, or t
  misc_feature (409)..(409): n is a, c, g, or t
  misc_feature (412)..(413): n is a, c, g, or t
  misc_feature (420)..(423): n is a, c, g, or t
  misc_feature (426)..(434): n is a, c, g, or t
  misc_feature (443)..(443): n is a, c, g, or t
  misc_feature (445)..(450): n is a, c, g, or t
  misc_feature (457)..(463): n is a, c, g, or t
  misc_feature (465)..(481): n is a, c, g, or t
  misc_feature (483)..(489): n is a, c, g, or t
  misc_feature (495)..(495): n is a, c, g, or t
  misc_feature (499)..(503): n is a, c, g, or t
  misc_feature (507)..(517): n is a, c, g, or t
  misc_feature (524)..(524): n is a, c, g, or t
  misc_feature (526)..(528): n is a, c, g, or t
  misc_feature (535)..(536): n is a, c, g, or t
  misc_feature (538)..(538): n is a, c, g, or t
  misc_feature (550)..(552): n is a, c, g, or t
  misc_feature (556)..(556): n is a, c, g, or t
  misc_feature (558)..(561): n is a, c, g, or t
  misc_feature (564)..(578): n is a, c, g, or t
  misc_feature (582)..(584): n is a, c, g, or t
  misc_feature (587)..(592): n is a, c, g, or t
  misc_feature (595)..(603): n is a, c, g, or t
  misc_feature (610)..(617): n is a, c, g, or t
  misc_feature (622)..(628): n is a, c, g, or t
  misc_feature (639)..(641): n is a, c, g, or t
  misc_feature (645)..(645): n is a, c, g, or t
  misc_feature (650)..(653): n is a, c, g, or t
  misc_feature (655)..(666): n is a, c, g, or t
  misc_feature (669)..(669): n is a, c, g, or t
  misc_feature (671)..(682): n is a, c, g, or t
  misc_feature (689)..(689): n is a, c, g, or t
  misc_feature (694)..(703): n is a, c, g, or t
  misc_feature (709)..(714): n is a, c, g, or t
  misc_feature (720)..(725): n is a, c, g, or t
  misc_feature (745)..(745): n is a, c, g, or t
  misc_feature (747)..(752): n is a, c, g, or t
gcagcaagttgtcacaatacaactttaatggcctagaaatagagtccacanctttaaggccagatatgaaactcttcaaccatacaccatgcgaggtagcctcaaaacaagaaacgaactcagcctccatagtggaagtagcagtcaaggtttgtttggcacttctccaagatacagctccactggctaacataaaaatataaccagatgttgatcttcgtgaatcaacgcaaccagcaaagtctgagtcggagtagccaatcacttccagacaatcagtttgtctgtacatgagcatgtaatcctttgttccttgaagatatctcatcactttctttgcagctttccagtggtcaatacctggattaaannnnnnnnnnnnnntnnnnnnnnnnnatnnnnnnnnttnctnntttcacnnnntcnnnnnnnnntaattaaantnnnnnnttttctnnnnnnntnnnnnnnnnnnnnnnnntnnnnnnnctcccntttnnnnncccnnnnnnnnnnntccctcntnnntcttttnncncccccctctttnnntttncnnnnttnnnnnnnnnnnnnnncttnnntannnnnncannnnnnnnnccccctnnnnnnnnttttnnnnnnncttttttttcnnntttnattcnnnncnnnnnnnnnnnntancnnnnnnnnnnnntttttanttttnnnnnnnnnnatcttnnnnnncccttnnnnnntccctcctccccttctcttncnnnnnnttc

SEQ ID NO: 5072 - DNA, 1384 bp, Glycine max
  misc_feature (289)..(289): n is a, c, g, or t
  misc_feature (328)..(328): n is a, c, g, or t
  misc_feature (330)..(331): n is a, c, g, or t
  misc_feature (362)..(369): n is a, c, g, or t
  misc_feature (391)..(395): n is a, c, g, or t
  misc_feature (404)..(406): n is a, c, g, or t
  misc_feature (411)..(414): n is a, c, g, or t
  misc_feature (416)..(416): n is a, c, g, or t
  misc_feature (422)..(432): n is a, c, g, or t
  misc_feature (434)..(439): n is a, c, g, or t
  misc_feature (441)..(441): n is a, c, g, or t
  misc_feature (443)..(445): n is a, c, g, or t
  misc_feature (451)..(451): n is a, c, g, or t
  misc_feature (453)..(455): n is a, c, g, or t
  misc_feature (459)..(465): n is a, c, g, or t
  misc_feature (468)..(475): n is a, c, g, or t
  misc_feature (477)..(480): n is a, c, g, or t
  misc_feature (483)..(492): n is a, c, g, or t
  misc_feature (495)..(497): n is a, c, g, or t
  misc_feature (499)..(499): n is a, c, g, or t
  misc_feature (504)..(505): n is a, c, g, or t
  misc_feature (507)..(508): n is a, c, g, or t
  misc_feature (510)..(530): n is a, c, g, or t
  misc_feature (532)..(549): n is a, c, g, or t
  misc_feature (551)..(557): n is a, c, g, or t
  misc_feature (560)..(565): n is a, c, g, or t
  misc_feature (567)..(577): n is a, c, g, or t
  misc_feature (582)..(590): n is a, c, g, or t
  misc_feature (601)..(606): n is a, c, g, or t
  misc_feature (609)..(609): n is a, c, g, or t
  misc_feature (613)..(615): n is a, c, g, or t
  misc_feature (617)..(620): n is a, c, g, or t
  misc_feature (622)..(624): n is a, c, g, or t
  misc_feature (627)..(629): n is a, c, g, or t
  misc_feature (631)..(631): n is a, c, g, or t
  misc_feature (633)..(635): n is a, c, g, or t
  misc_feature (638)..(643): n is a, c, g, or t
  misc_feature (645)..(647): n is a, c, g, or t
  misc_feature (649)..(669): n is a, c, g, or t
  misc_feature (671)..(671): n is a, c, g, or t
  misc_feature (673)..(673): n is a, c, g, or t
  misc_feature (676)..(682): n is a, c, g, or t
  misc_feature (690)..(701): n is a, c, g, or t
  misc_feature (703)..(712): n is a, c, g, or t
  misc_feature (717)..(717): n is a, c, g, or t
  misc_feature (722)..(731): n is a, c, g, or t
  misc_feature (734)..(767): n is a, c, g, or t
  misc_feature (769)..(784): n is a, c, g, or t
  misc_feature (787)..(798): n is a, c, g, or t
  misc_feature (801)..(801): n is a, c, g, or t
  misc_feature (803)..(808): n is a, c, g, or t
  misc_feature (811)..(811): n is a, c, g, or t
  misc_feature (815)..(822): n is a, c, g, or t
  misc_feature (824)..(831): n is a, c, g, or t
  misc_feature (835)..(844): n is a, c, g, or t
  misc_feature (846)..(846): n is a, c, g, or t
  misc_feature (848)..(855): n is a, c, g, or t
  misc_feature (857)..(878): n is a, c, g, or t
  misc_feature (880)..(880): n is a, c, g, or t
  misc_feature (892)..(895): n is a, c, g, or t
  misc_feature (899)..(909): n is a, c, g, or t
  misc_feature (911)..(916): n is a, c, g, or t
  misc_feature (918)..(923): n is a, c, g, or t
  misc_feature (928)..(931): n is a, c, g, or t
  misc_feature (935)..(941): n is a, c, g, or t
  misc_feature (943)..(943): n is a, c, g, or t
  misc_feature (947)..(947): n is a, c, g, or t
  misc_feature (949)..(951): n is a, c, g, or t
  misc_feature (956)..(957): n is a, c, g, or t
  misc_feature (960)..(974): n is a, c, g, or t
  misc_feature (977)..(1005): n is a, c, g, or t
  misc_feature (1017)..(1024): n is a, c, g, or t
  misc_feature (1026)..(1040): n is a, c, g, or t
  misc_feature (1042)..(1048): n is a, c, g, or t
  misc_feature (1054)..(1065): n is a, c, g, or t
  misc_feature (1068)..(1079): n is a, c, g, or t
  misc_feature (1081)..(1081): n is a, c, g, or t
  misc_feature (1083)..(1087): n is a, c, g, or t
  misc_feature (1090)..(1094): n is a, c, g, or t
  misc_feature (1098)..(1098): n is a, c, g, or t
  misc_feature (1100)..(1100): n is a, c, g, or t
  misc_feature (1108)..(1118): n is a, c, g, or t
  misc_feature (1121)..(1125): n is a, c, g, or t
  misc_feature (1130)..(1132): n is a, c, g, or t
  misc_feature (1134)..(1136): n is a, c, g, or t
  misc_feature (1143)..(1176): n is a, c, g, or t
  misc_feature (1178)..(1178): n is a, c, g, or t
  misc_feature (1182)..(1188): n is a, c, g, or t
  misc_feature (1190)..(1197): n is a, c, g, or t
  misc_feature (1199)..(1212): n is a, c, g, or t
  misc_feature (1219)..(1222): n is a, c, g, or t
  misc_feature (1224)..(1232): n is a, c, g, or t
  misc_feature (1238)..(1240): n is a, c, g, or t
  misc_feature (1242)..(1242): n is a, c, g, or t
  misc_feature (1245)..(1253): n is a, c, g, or t
  misc_feature (1255)..(1262): n is a, c, g, or t
  misc_feature (1269)..(1281): n is a, c, g, or t
  misc_feature (1284)..(1287): n is a, c, g, or t
  misc_feature (1292)..(1293): n is a, c, g, or t
  misc_feature (1297)..(1298): n is a, c, g, or t
  misc_feature (1304)..(1306): n is a, c, g, or t
  misc_feature (1309)..(1312): n is a, c, g, or t
  misc_feature (1319)..(1336): n is a, c, g, or t
  misc_feature (1338)..(1338): n is a, c, g, or t
  misc_feature (1348)..(1350): n is a, c, g, or t
  misc_feature (1352)..(1360): n is a, c, g, or t
  misc_feature (1363)..(1365): n is a, c, g, or t
  misc_feature (1367)..(1370): n is a, c, g, or t
  misc_feature (1373)..(1376): n is a, c, g, or t
tctaccccatcacttgttccagcaattagatccatgtcatctgcaaagctttttgtcgccgttactttagctgatcatgctgaaattttttcagaattgaacatagcttcaaattttcaattttcattgcaggtatttcttacagcactgatgatatgagtttgcgagagtcttttgctcgctatggagaagtaatagatggtattttcttacttactcagtctcctttttttttctttttttttcaggtaaaggaaataatatcatactaaaaagaaaataacaaaantctaattggaaacttttttccccaaattcaacaaagggngnnaaagaatcccatatgtggcccacaatgaaannnnnnnnttaaaggggttaacattttttnnnnngataaaatnnngggtnnnncntttatnnnnnnnnnnntnnnnnncngnnncttctngnnnctgnnnnnnnttnnnnnnnntnnnnctnnnnnnnnnnacnnncncctanncnnannnnnnnnnnnnnnnnnnnnncnnnnnnnnnnnnnnnnnntnnnnnnntcnnnnnntnnnnnnnnnnnttccnnnnnnnnnttttcatgtcnnnnnnctnttcnnntnnnnannncannngntnnntannnnnncnnntnnnnnnnnnnnnnnnnnnnnntntnctnnnnnnntctctcannnnnnnnnnnntnnnnnnnnnntctcnattcnnnnnnnnnnatnnnnnnnnnnnnnnnnnnnnnnnnnnnnnnnnnnannnnnnnnnnnnnnnncannnnnnnnnnnnttntnnnnnnttnctcnnnnnnnngnnnnnnnntgtnnnnnnnnnnancnnnnnnnntnnnnnnnnnnnnnnnnnnnnnncncccccccccccnnnnctcnnnnnnnnnnncnnnnnntnnnnnnccccnnnncccnnnnnnntntctncnnntctcnntcnnnnnnnnnnnnnnnccnnnnnnnnnnnnnnnnnnnnnnnnnnnnncgctctccctcnnnnnnnncnnnnnnnnnnnnnnncnnnnnnnatcctnnnnnnnnnnnnagnnnnnnnnnnnngnannnnnacnnnnntttntnggtgcttnnnnnnnnnnngcnnnnncgcgnnncnnnctcaatnnnnnnnnnnnnnnnnnnnnnnnnnnnnnnnnnnanactnnnnnnncnnnnnnnntnnnnnnnnnnnnnnttacccnnnncnnnnnnnnnttttcnnncntcnnnnnnnnntnnnnnnnnttctctnnnnnnnnnnnnntcnnnncctcnntgtnncccccnnnctnnnntcctctnnnnnnnnnnnnnnnnnntntatcatcatnnncnnnnnnnnntcnnncnnnnatnnnnatcattcc

SEQ ID NO: 5073 - DNA, 379 bp, Glycine max
atcctcacgtacgcgtcccgaacccacagcaccatcttcttcggcgatgggattttcctgattcggatcttgggtgcgagtctgatcctccacctccagaaccgacccttcccggttcgggtgctcccaagctccacccggttccttctcctccggcccgacccgtttagcctcttgtaccccttcctcctccaatactccttcacgcccctgcacacgctggcggtgatgccttccatctcctttctttttttttttttttttaaaaaaaaaagaaaggggggggggggaaaaaaaaaagggaaattaggggcatggaaaaaaaaaaaaaaaggggaggggatggggaaagcccccctggggaaccctcctaatttaa

SEQ ID NO: 5074 - DNA, 1069 bp, Glycine max
cttatgtcctttttcgacttattcccctgtccatttcaggtttgcttaactttcaaaccgactaacctagacttgtatctttattcgcataaatttttttgtctataattttctaatggtgaactcagttatgctgcctcctacaataaatttattagggttgataaaacgacatttgtgtaaacttaaactaaatctatactgtcacttgaatttgtacaagatttttcctttcactacaccttttggcaagcattttttatttctagattgtatttatttttgaggcgtagcataaattttaagacacaaagacagtaatacttgccgcctcttaaggaccttccatttaacagatgcatattctttactgacttatcacattaactgctttactgcattactgcattactgcattactgcattgtaggtggaattgatggcttcaggtttccaactcttcctcttctaataattctaatgttagctgtcatcttatccattgaatgctagggaaaactaaattttaaacaaatcataaatctacatacgttatttgtgcattattctttctcatttatattgctgcttgtgcatattttttgtggcttgtttcatgtctagcttacctagtggaataaagttttgttgttgttgtggtattaatttctgtatggttcttttttgagcaaactgtcaaaacctttttagcaactccttctatagctgcaatgagtcaatgactaacatgtggaagaagatatgaatgagtcatgaacacatttggtggatgtaacaggggtggtaactggaatactggtggtggttgtcacttggaaacattacctgatttaggctccttgccaccagtatctgacatccatttcagaaatgtcgttgatatcttgtcagaacgcatgaataaatcagaagttttgaatctggacttgcttaatgtcacgcaaatgtcaatacatagaagagatggccatccatctatttactatcttggaccaggcaggacatcctctatgtggcggcaagactgtagtcattggtgcctacctgg

SEQ ID NO: 5075 - DNA, 363 bp, Glycine max
gaagtgcccatgtctagtgaaggcagatcgtgattcttagcagcaccttcactacagattagtgtcatccatagcttcaataagcatttgtcagcctattgccttacggtatcacacaattgttgccccctcatactccattgtagaacttggatgggctccgatttgagaaacagcccgaggaatggaagagggcacttcgtcacaaggcgaataaaatccacaacagtcatcattgattcccgtactctggcatatcttggggttgacgagttttaacttggtacaccttcatgttctgcttatcataagttccccccaatgcagtttcttgatgcccagcatatattccattcgtatccg

SEQ ID NO: 5076 - DNA, 648 bp, Glycine max
tggctcaattttcacaattttcttactgggcatttgtgcatgcagtttcctttcaaacagttctatctgtaagtgtgaagtattttttttcacatacattccacttaggttgtcaaggatgttttacatagtcattgtgtttttcactcaattttttttgtcagtggtggaatggaaagtatcaaattttcttttgagcacatctggaattgtgacattacaccaatcagttatccaggggaagctgctaatagaagtatgtattttgtttattttttttcttctttgtctaaaagcttagtattatatgttaacttccttacattctaaggcatgtgtgccaatagaagttttgttgaaattctaattaaatggctcttgaacttgattatcatttcttcagagcattgggttccttattttgagcactttgtgccgatttgcaattgaagttgggctgtccaagcaggctgccacatctgctttcatgaaagactttacctcatggatcatcaacatagcctcaggtttacctgtatgggactatgcagctgaagttataccaatggtagttctgattctgctggcagcttggctttacaaggccgccagtggcagcttctttgattggccatggaagtatgtcat

SEQ ID NO: 5077 - DNA, 500 bp, Glycine max
cgacggcgcgcgggtccgccagagccggaggagctccggcagggggacgtggtggacggtggaggaagtggcggcggaaggagggattaataataaggttcgcctgaggagctgccacgggaggctcttaacggcgacagagacgccgtttctgctaggcatgacggggaagacggtgctgcaaacggagttcgaggccggcgcggatttcaagcacgagtgggaagtgatacgcgacggatttcaggttcttttaaaaaaatttatacacaaatgttactttgttagtgaaaagattggaaccacaacttcttctctcttcattcttttttttatcaataagtcaatcttataactcctttcgatgggtttcaggtgaggttgcggagctggagcgggaagtttctgagggccaacggagggacgccgccgtggcgcaacaccgtgacagtggacgaaccgcacagctcggcgacgagggattgggttctgtgggacgt

SEQ ID NO: 5078 - DNA, 399 bp, Glycine max
cctcccttcagtttcagctcatggcccatatgcatgggatggggaggccacatataaattcactacttaccaccctggccaaaactacaaaggtttatccaatgtcaaaaactacttccaccatctcggctacatccccaatgcaccacacttcgacgacaacttcgatgacaccctcgtatctgccatcaaaacctaccaaaagaattacaacctcaacgtcaccggcaagttcgacatcaacactcttaaacaaatcatgacaccccggtgtggcgtccccgacataataatcaacacaaacaaaaccacatcgtttggcatgatctcggactataccttcttcaaagacatgccgcggtggcaagctggaaccacacaactcacctacgctttctc

SEQ ID NO: 5079 - DNA, 476 bp, Glycine max
gattagtctagattaagtggtcgtgatcatcaagtggcacataactaacaatcttatcttgtctgtgaacactctcacaagtaaatgcattttcttctttcgatggtgtctttcacttttcaccatgaaaagttgaaaacatacactgacacgatccctatggcccagtctttttcctcccatcacatttcccccatctaccaagcccagcaaaaatttctgaaattcaatggaatgctactttcgttacttatcctttcgctttctactgagcaactggtttgaatgagaactgaattacataactcattcatcactatcatgtaagagggcccctcttattctagtcctgtggaaaaaagggtgaatgaagtatactatgatgataacagtatgcagtaataccagaaccaaggttaataagctagtaagaaaacttgcctgcgataagctggcaccttacgattcttgactta

SEQ ID NO: 5080 - DNA, 412 bp, Glycine max
ccttcaacaaaaactaacattggacaaagaatttgagagaaaggtaaaaatgttggagagggaagagcaaaagatgcacaaagtgatgcgggctcatgagaaaaagatggttacagttggcagagaagaatctgatgcactgttacgtggagatgctgtgcaccatgctgatgtcgttgacactactaacctacaatcaggtttgaagcagatctttggtgccatggagaagttcactgactccactgttcgcttatatgaagaactttgccaacaaattaagcaagaggagaaaccaacaaaaattaactagctttacactttttagattggatgaattttgtaggattgaagttatcacaattttctgaacctaatttttatgtatacggcatctcataaagtttcttcg

SEQ ID NO: 5081 - DNA, 661 bp, Glycine max
aaatggggatcactgttgttacttcctcacaagtaagaatctattattactgaaaaaaattaaaattttatcatggtaaattggagaaataagagcagttcactagtaagttattccttgtttctcactacaattgggatttggtaagcattttgaacttgcttcgtttggtaagagattccgtatgagattatgcagtacattccttatctgcacaaatctatttaatttttatatagttctatcttaaccatttaacttctccaaactgaaaatgcataataaccatccacattccatcaaactaatttgcctttgctcctgtcctctcagcgtcctgctttaataccatttcattccatggaattgcgtctgattgatggtgagggtaattgggaacttcgttcgaacaagcaatgactttcgcacctgcagattctcattgttactattttagatgttgctgagtctttgaacatacagaatgattgcaagcagatattaggcttgccatgatggtcattcctttatatttttttttcttcttttttcttttttcattttgggtttaccatattctccaagcttgctccgtcgacttgtggggacaaacaaacaaaaacagcatcgatagccaaaatgattgatagtaagttggagg

SEQ ID NO: 5082 - DNA, 343 bp, Glycine max
gtactatttgaacttgattgagttttagtcctctaccatcttttctctgcttcctgtattagttctctttttttttatatatatttttagttcaaaaatggtttatgctacagcagagatgctgcagcttctcctatctctgttaagacagtcaaaaccttcgatccttaccgcagctggtgtgtgaccaaatttctttggaacacaaccacgagctgaagaagaggatgcctcggtaaatggaataaaattcccattaccaaactgctcatcttggattagagggttagaggccctgctaggaggagatccagagaaaaatggtggtgatgatgctacctct

SEQ ID NO: 5083 - DNA, 448 bp, Glycine max
tgcaattttaaggatgacatattactggtatgacattttaaaaatggttaaattatctttgattttgtgcatctgaaaatcatttctgcaaatctgattgaactgcttttcaggtataactttatgccactgtctaggggatcggcaggggttggatttatagttatgctgggtttgttacttgctgccaacatggagttcacaggaagcatcccacagggtttgcaggttgattgggaagccattttgaacttggatccaaactcgtttgtggattcggttaaaacgtggctgtatccatctctgaaggtcacaacctcatggaaagactaccctgatattgcttcaacatttgcaacaacagggtcggccattgctgctttgaacttttcttttgatgattgaactcctgtctgtaattatgaccgtgagttagttgcatattaac

SEQ ID NO: 5084 - DNA, 824 bp, Glycine max
  misc_feature (796)..(799): n is a, c, g, or t
cataccctgttcagaaaataagaaatactaataaatataacaatgattcatcacacattttaattgattgccatcagcttatagtaatctcttgaaaaagtgcaaatacctatgagcttcactgagtactttctctatgtgtgtaacatttctaatcccgaatgcaatagtataaccatccattgaatcattttggaaactcaagctttcagcatttccctccacccatacaagggaaccatcttctccaaaacctattataataagcagaaaatattcattccttgcaaatgaagatatattaaaccaaaattctttatgaaagattgaaaaattgttgacagtttaagacattctcatttacccttctctgaggcccgctgtttgccaacatttaacatcttagggttaatgtcacatacatatatctgagtttctgcctctaaagtatcttgaaaagcacctcgaagtcctctcagcttaactttgtgtatgttctccaagattctaaaagcaacatcccctgtaaaataaaaaactttaagcttgatacaaaaacccttaaaccccatgcagcatcagcagcatcacttcaattccaggaacattactgaggagaagcaaactttatattaaataaatacaacaaatacatcttacaacaatattccttaagttaattgtatatgaagtcatacaacttacttttgaacaagttatgacttctacagcctatgaacatgatgatgcctaaatattgttcaaactatatttgctttatgacttctttagcccnnnnacaaattgctcaacaataaacataa

SEQ ID NO: 5085 - DNA, 275 bp, Glycine max
tttcttcttctatccatcttcaactttcctttctttcctttcctcttctttttctccctccaagaacacatttttctttgacccttttgttccctctccacccacttcccctttaagacaatttcatgcttctctgtctcggatcctagatcttgctgtcggtgggttgatcggagtagatgtcgccgtcaaacgggttgcataacggcggcggcggcggcagcggtggtggcggaggtaatggggtgagttatatagagcaccaggtttcaaaa

SEQ ID NO: 5086 - DNA, 410 bp, Glycine max
actcccacacccaacaacacggcaagaaacttgaaataggctgagtcaacctttgttggtatgtggggcatgtacccttttgccaacagatggtttactgatacatagataaatactccacaagccagacccattgatatggcaaagatccaatccgccacatgaccctgagttgtggcatccaatataattccaatggccacaccaattggactcgagatggcaaaagcaaaagcataggctgcacacgacacaaggggacggttaggaatcattctgaggagagcaattcccatggcaatggctgcaaatatcttgtgcagacagattgtccataaggctttccatgcatttgctttggtctcagcaactccaattgctaagccctcaaacacagaatgtgcacaaag

SEQ ID NO: 5087 - DNA, 376 bp, Glycine max
cttctgtaattggttcctagatatgaataaggctgagatgtgtcaatttccacagtcttaatgtggtctctttgatcagttgaagcccttcctctattctcccatggctttgtggccatccaccgatctagccattttggtctctcttccaactcatcttcatttccaattgatgatgtcctaccattcctccaaatctattatgcatcacaatcaattaaccaaaccaagtcaaggaaattaattcaatttcaaagatcaattaaacacacttcagtcaattatcaaaccaagtcaaggaaattaattcaatttcaaagaatcaataaatacacttcacatttcacaatcaattaccacaccaagtcaaggaaaa

SEQ ID NO: 5088 - DNA, 536 bp, Glycine max
tcaattatagtgcttgtcacaccaacagacacatcccaagtgcaactcatccctttgggaaacacaaccaagtcaccagcagcaatttcaactgactcattcgacccactaggaaagaccttcacttttccttccagaagatagcaagtctctttggcttcatatgtccatgggaacttacttggagggcaaccccatctgttataataacatcaaatggatgtcacaccaagtgagagagagatcaaacacatttgaaaggagaaaataaaacatatatttgattgagaacatttacttccaagataaaaagcctgtatattgcaacttctgtagagtcaattagaaagatagctacattctttcatgtccacttaattttgttaaatggctaagaagtaagaacctcttaaatttcttaacaacatcctttcctacgatacaaacaacacaacaaaatcaatctcaatcccatggcatttgtataactcagagaaaaggccataaaaacggatttggatcctctcccatccaaa

SEQ ID NO: 5089 - DNA, 519 bp, Glycine max
atacatcatatctttgttgactttaaactttctttttatctccattttacagatttgcaacttaggtcttactcaactgtttcttgaataactttgtttcaaatgattttggttcctgttgatctgagaacggttacttttaagagaaattaatcaatctctccatgatcctcccccttgatttttcaactcgttgaccttgcagattctacaagacagtggagctagaaagatagctacaacatctgggaaagaaattcaactgaaggaagaagtatcctatgatttgcaaaagcttgcaacagagggtcttgtacttgacagtattattcagctcgaaggcgctgatatagaaaagaagaagcatgtccataaagatgatgatgaggacgaggacgatagagtgaagaaaggaatgggatttgacaaagaagaagatgaggaggaggataaagatgaacacaaaaagatggttggaaaggatgtgcatggttataagccatctcacaaacacatgga

SEQ ID NO: 5090 - DNA, 582 bp, Glycine max
acacattcacctttatgttatcattgctaattgcagtgtttctagtttaatcatgtttcttatttttcaaatatttgaagttttaatgcatatttttcgtttctgatcgttacatcagctgctatcatagatcattctcatgtagcatgaaaaacaaaccatatcctgatctttttcttgatggacatgtaaaggaaccagaagatgcacaaaagcaaaggcaagctccacctagtaaatttccaacacatagttcaatgccaatatataatgatcacaatctttctgttgagaacaaaaataaagcagaagatgcactttcagctgagtatatggagagtttgatcctcttgacttcgaaatctgatggctcttgtgcatcagaagaggaaatagtagacctgactgagcctaggtttgaatcattttgcatcacaaatggcaatgtcccatgaaaacataagaccaggcacgggcagatgtgcagatggcagaaatctgaggagtttatgttgtgtgaactggtgatacacctctgttgcttgttctaccaccggttactgtacatggctgcattgagaa

SEQ ID NO: 5091 - DNA, 353 bp, Glycine max
tattgatgctgtgatgataatgctaccttgtattatttaaactgatgtcaagtccatgtggtgttttagttggccactggttatagaacaatcccaagcaaagggagaaaaaatgctagaatttttgttaccaactggatggaaaattggcatgaactgaattctaattcagcaacatccaaatacatcatgtaaccagattgacaatttggcaaaacgtgggaagtcactattcacaagtgtatcctatatttcgtttagttgaactgtattcccaccatcaagatagatgttatgcaatttccttaattatttgatctagttctccccgttgggaatatgaatatagtcaa

SEQ ID NO: 5092 - DNA, 497 bp, Glycine max
ggctcgagcccgccgttcttgccgttgatgtggaccccactgggcctgccaatgctgcgtccgctgtccaatgtttgtttcaaggcagtgtggctcttgccgaaccagtcaccgatgagcacccagtactcatcggcgggatcagcatagggcactgggatcaacagacggctgaagatccttaaacccccgaagccacccactgcgcgttgcaagccggtggtcgggtagtagaagtaagttccaatttgatccttaacctgaagaatagaattttaacatggacaactttgttattaaaatatataaaaaaagacgatgatgcaaatggaagaatataagaatatacctgaaagcggtaggtgtagttggtgcctggggcgatagggcactgggcacccaatgtgccatcttgccaagagttcttcctctgttggacaccatgccatgtgaacaagagaggctcatcgaggttgttgaagacattgatgaccacg

SEQ ID NO: 5093 - DNA, 336 bp, Glycine max
agagcaataataccacagcacaccgtgcgaaactctaacggggcaagtgagaacacaaatttgaaggtgtaagtcactcatggagtaataatactatgtatgaaaatgtgaaacgtttgaacagttgttgcggttgttatgttgtcttcttcattatcgtatattatcgtgcatgggtgtacgtagctcagtacctgctttgaggataaaagctttactaggcttgaatatgaatatcttcagcagtttgtattgataaatgactcatatatgtattaattgtaagtgctacaactttgtacttttgtgataccacatgtttatgttcttcgttct

SEQ ID NO: 5094 - DNA, 323 bp, Glycine max
gacggtgatgatgaagagtgttatgttgatggtgtagggttgtcacttgatgagctatgtgctgggatgaacaacattagcgtgaatgagaacaagaacaagggttgtgggaagcacacgaggtttgtgtacgacagtgaggatgatgagattgtggagaaagtagtggaatgttgtgctgagtctgatgtgatgcgtttgaaggggttgcctacacccaaaggaaagcaccttcgttttcctgaggaggaagaaaattctgacttgtgattttgatgctgtgagtgttgtttgcttttggttgtctttcttgacaccaatgt

SEQ ID NO: 5095 - DNA, 415 bp, Glycine max
tctctaatctctatgatttacttttattatgttaagttggtccttgagtcttatatgaagaagaagagagtggatcacaccccttttacttttattattattaactattttcattagtcatttcaccattgtcaaaccgtgttgtggtcaaatcgagtcttaatttgattaaatgtgccatctgtaaccagaatgaacatatgtagtgtcaagagccttgtagactccgccctctgccctctctttattggatttttgtgcttcaagtggtcaaaaacttgtttcttaattaattcccctttattataagaaaccaatcaaggtctttaatgtgatttgttacataaattgatgatccttgaatctgttcttgttattatgggtagcatttagcttccttctatggctggataaa

SEQ ID NO: 5096 - DNA, 491 bp, Glycine max
aaaggcgatttgagaaagatcgtcaccgaaagcctttcctctctcggttacgattcttccatttgcacatcgaaatgggacaaaaccccaacctaccctgccggtactcctttttcttttatttttccccaatttttctggatatatcacagtcgatttgttttttagttaattgtggagaagtgaatgttgtggttttgattgattcaggtgaatatgaatacatcgatgtggttgtggaaggtgagaggttgataattgatatcgattttcgatcggagttcgagatagctcgatcgacgggaacctacaaggcgatccttcagtctctgccgttcattttcgttggaaaatcggatcgactctgccagatcgtcgccgccgtgtcggaggcggccaagcagagcttgaagaagaaagggatgcacgttccgccgtggaggaaggcggagtacatgttggcgaagtggttatcaagttcctgcactagg

SEQ ID NO: 5097 - DNA, 479 bp, Glycine max
gccgtctccaacaccttcgacgacaattccacctcccaaaacgacaccggcggaaccaaatacctcatcaccgaattcgacccttccaaacccgctcccacctccgtccccaaaaccctaattcccccaatccaaaaccaatggcaacccttcaagaagatgaagaatctccacctccccaccgccgccgacgtcgaatccctcgccttcgaactccacaccgacggggaccaacccgaatccgacatctcctacggcctcaacgtccgtgccgacaataatccagaaggaaacaacaaagacgacagtgatgctgccgcgccacggcgtcgagttccgctggaggccacggcgctgcagaagctgaaaagcgatctggagaggctgccggaggaccaggggatggaggagttcaaggatgtcgccgtcgagggttacggcgcggcactgctcgctggctatggctggaaggaaggaat

SEQ ID NO: 5098 - DNA, 366 bp, Glycine max
tgttcccttctctgctggagaacaactgaaggaaaataagaaaagggttgctttctggaactgcttgaaattggatgaacattctctcaaggctattgagctgaatgcacaaattaacatgatgaaatttgcacaccaacatttgtccacatttggtgatgcccatcaaggtacctatgtgtacccgggaagcaaagttccagaatggttggtgcataagacaatacagcgtgattacgtgactattgatctctcttttgttcttgctccacactcctctgatcacttgggcttcatttttggcttcgttgttccggaagtccctaatgagggtttggttttggaatttaagataagcactggagg

SEQ ID NO: 5099 - DNA, 375 bp, Glycine max
acttttttgtttctgatgcgtgtcattgaggcttattttttagcatcagttggagggtggaaacttgataaatttgatcttttaatggtaacaattagaaatggctagggaaggtagattaataggaaaaattcaagtgtataggttagtcacatacaaatcagcaagaaacaggtttcattagtaacattgtaacattatccagagaaaaaagttacatagtaacggggggtatagatgcatagatactatcatttgttacctagctgcaaatcagtacacttctgtacatagactcaaactatgtcatagatcatttaccaattaacagttttctctgtccctctctgcgtttcttccacttgtgtgaacctg

SEQ ID NO: 5100 - DNA, 614 bp, Glycine max
cagaggcaaggataagtttaggtttcctgggggtggtacgcaatttatacatggagcagatcaatacttggaccatatttctgaggttggtatatattatatgctttggttttgcttttaaggaaagtgtaggtgcatcttctttgatgattctggtgtttttatgtcatggttttgtagatggttcctgatattaagtttgggcaaaatataagagttgctcttgatgttggctgtggtgtagctagttttggcgcatacttgttgtctcgaaatgtcataaccatgtctgttgctcccaaggatgttcatgagaatcagatccagtttgctcttgagcgtggtgtgccggcaatggtggctgcattttcaactaggtgtttattatatccaagtcaagcttttgacttgatacattgttcacgctgtagaattaattggactcgagatggtatgatctctagcagctaattgaccagtgggagtgcatgttgaatttagttataagttttctccctactgagaaaaataatagctagttattgtgtatgttttttacttgtggtgcagatggtattttgctgcttgaagttaataggatgctaagggcagga

SEQ ID NO: 5101 - DNA, 664 bp, Glycine max
gagttgcactcactgaatgcagatagagttactcaaggtctaagtactgtatggagtttgattcttctaaggcctcccattcgagatacttgcttacaaattgctctacaggtttttttctcctacttttgttatactaactttgatgtttgcttagttgttgttagtcataattcctcattggttttctttcttcatatgtataaattgaactttaagtgggtggcttaatgatattgccccttgcttttctccttgaattgtagaaactaaattttcaaaccttctgtcctcttgtaattgtaattttttggcttacatctgatcttttccttaattttgatttttttcctttttcaattaaagagtgcagtgcatcatctggaagaagtgcgtatgaaggcgatacgtctggtacattaagcattaaattcctgttgaaacatttatttgactgcaaacagaatgtcttacaatttgagctcttattgcaggtggcaaataagctttatcctttgtcatccatttctaagcaaatagaagattttgcaaaggaaatgcttttctcagtgatgagtggggatgcatctgaagctactgatattgaatgttccattgctgattcagaaaaggtattcacatatttatagatttactttttttt

SEQ ID NO: 5102 - DNA, 397 bp, Glycine max
agtgggctagcaggcagccacgtaaggtggctatgtatcacttgttaatgctgtttgaggataatccagccagcggtgaagtgaagtagttccatttggttgagtgaagtgaagtgtgaaaggatgaccaattttgttggactaaggttgcatacgaggttgtcattgccattgccattgccattgccagtgttgggtggtgcttctcactcttgttctgccactgccactactctgtcaagagcagtaataaggaagtggaattggggaattaagggtcctcgtcgtatggtattgggccttggacttggagtttccttcttgtctatggccggtaccaaatccttcattgcctcggctaagataaagggtggtccctctgtggatgagatactga

SEQ ID NO: 5103 - DNA, 605 bp, Glycine max
actatcttcgcctttatcgtagtttatattctgctggtaacctcatcagagttccctagtgttgctgcagatgatgttagcagcatcatcagtgcttcccaatttgagcaattgctgaaacacagaaacgatcaaatttgtgaggggaagaacggattctacagctacaatgcttttgtcactgctgccagaacctttgatgggtttggcactacgggtgatgttaacactcgtaagagggaggttgcagctttcctagcccaaacctctcacgagaccacaggttatattagtcactgagaaaatatttattttataaactataataatgtaaaaaaatcagcataattttttttaactcccaatgaatatttttatttgaagttttttaatcaatgtttttaagatactgattaagatttaacatgtattaccggggacttaattaaatgctaagtgccgggttattgattgtcctcaattgatgcctcataggaggaggaggatggcctaatgccccagatgggccatatgcttggggttattgctttgtcacagaaagagataaatccaataattattgtgaaattagcaaggcaccatgt

SEQ ID NO: 5104 - DNA, 395 bp, Glycine max
cttctggagcgagtggagagcgagaaggacaaggaaacgttcgggctggtctgcaagcgatggctccggttgcagagcacagaaaggaagaagctcgccgcacgtgcgggccctcacatgctccgaaaaatggccgataggttcacacgcttggtcgaattggacctcgctcagtccgtctctcgttccttctatcctggcgtcaccgattccgagctcgccgtcatcgccactgccttcacttgcttgaagatcctcaatttgcataattgtaaaggtcaatttctcttttttcttcttctggctttctatgatttactgctacatattctcttatactattctgagaatttaacttatatggacagagaagactaaaaacaatgttttttttt

SEQ ID NO: 5105 - DNA, 921 bp, Glycine max
  misc_feature (12)..(12): n is a, c, g, or t
  misc_feature (23)..(24): n is a, c, g, or t
  misc_feature (866)..(866): n is a, c, g, or t
ctttatatgatnactcttggagnnaaagacatacaagttcagttgataaaatggcaggctagctttacaaagttgtccttagaaattgtaccaccaaataaataactgccaggagtagtgcaatctggtatgcatcctgttgaaaactgtcgtccctctggaagaactgaataaaagcacacacaggcaatcaaatcaataactcatgaaagaaaatgacctgtgtactaatcttcatgtgtatggcaatctttcttgcaaggcatttatagtttcataccaacatgttaaggaatgcaatggcatagagatttgaacaacttgattgattcattatgaaggtatgtctggttaaacttaagaaaatggtttgtgactttgaccctgcttggataaacttccaaataaatgtctataagagaagaaaatatcaaggtaaaatgaattaagtttcttccgaaagtaaaaattaccttgtgtaaaagttaaaattaggataagttaaatgagagaacttctataagtacttattgagaagttcattcaaatttgatctttcttgtacactcttttaatttattttaatacatttcataatgaagtcaaaatacacttattcatttaagtacttataatttaaactcttaagccaggcatgccttaagtaaaacaaaagcactgtagatgaagaaaggttggatactgaagtcaggcattcgggattaatttataggggggaaaaagaactcaccttggttggatcacctgaaggatctggatacatctccaagttctcttttttggttgacattttactactcaaattcttagcactgtcacccaaatctttgacagattcaacagcnacaaagagagcacgtgatgtccagaaaaatgcctgagcactagcagatgaagctg

SEQ ID NO: 5106 - DNA, 347 bp, Glycine max
aggagaggagcctgaagaagaacaagctcaagaagcacctcccagttcatctcttgtacaaaaaataccaacccattgaaaattgtgggactgatgaagaattggccaggaagttacatcgcgccatgaacagttctcctaggatctcaaagaattctcccaattcagactcaaaagggagtaaacacaagaaacctaagaactcttggagttttgaaatgactgaggtttctgatgcccgaatggcatttgggcaggattgcttatctttgaacaatgggcatgccgtggtgggtaaggttgattctgaaggctccattcaagaagtgtgctcaaacaaggaagaa

SEQ ID NO: 5107 - DNA, 187 bp, Glycine max
aagagagcttccttgatttgaatgagcttgcccctagcactggtttcgatgatggtccgaacacaataatgaaagatgaagacaatgattactgaagcttcccattatggttgagagcagggagtgcagtttcctatcagggaagccaatgggtatgtatgatgatagaactataaattttgttata

SEQ ID NO: 5108 - DNA, 721 bp, Glycine max
  misc_feature (700)..(701): n is a, c, g, or t
agccaggaggtaattaaatttaatgtttattttgcttaactctcttaattcaagaaatatcttcgaagataagtatataagtagagcatttatttggttttgttaattctgttgtgatcaagttaactgcaggagtttgttattaatgttgtttttagtgcatgaaaatttcttcatagaagatattccccaacctataaattaacaatttaacatggtttgtactttactagtggatctatttttggaagatgttttataatgtagtcacaacatctaagagggcttttacatattaatcaaagttgtttcattaagaaaaatattttatggtgcctggagaaattaattattgattttgtaattgacaaatgttgtttttgtttataaggtcattcaagagtgcaaagagatatatgagaattcacttgttgatggaagacctccaaaggcaggttttgtttttcgacgtgtgaagtgcttaacagcaaccaagggagggctttggcgtaaactcacttgaagtacgattccattcagttattcatatatcttgttttgcctgttaaattatttgttccttgtgcataattcccaaatgctatgctgtcaatagacaagttttgtaaaattcatttatacaatttccttagttaatgataccctcagtttatttctgctcccgttctcggtttaccannaccaaatggcgtcgacattc

SEQ ID NO: 5109 - DNA, 405 bp, Glycine max
gtaggagtcgttcttactctcctgactatcagaggaggaggtcttactctccatatcactccaggcggaggtcttactctccattctatagccggtacaggtcctattctcgatatgatcgacacaggtcatattctcgatctcgctctccgtatagcaggtcacctgtcagcatgcatgacagatcatactctccctatgaaatacgatatgactcgccggatgcgcactcctacagaaggcaccgttaccgatctgtttcacgaagtgcctcgcctgatgatccttattatggaaggcaccgttacaggtctgtttctcggagtgcctcacccaggccaaggagaaggtcaaggaggagctactcacggagtgctacacctgtttcaagagagcactcacaaa

SEQ ID NO: 5110 - DNA, 379 bp, Glycine max
cttcgtcgtgtgcgccgagctcctcaaccaccccgtcttcgtgaagctcctcaacgaatcggcgcaggaatacggctacgaacagaaaggagttctccggctgccgtgccgcgtcttcgtcttcgagcgtgttctcgacgcgctccgtcttggactcgacgcgcgtgacgtggcggagctcgtaaatttctcgccggaagagttctcctgagaaacaaagaaaaagaagcaaaaaagcaaaaaacacaaaaaaacaaaaaaacaaaatacgaaaatcgttgattagtgagaacttttgctggttttggtgctctgtaaatatactacattaggatcttgatagaaaaaaaaaatgaggcacataaatgttagggtttgc

SEQ ID NO: 5111 - DNA, 380 bp, Glycine max
tgcaagtttgagtatgaccctgataggaatacttactctatcattgttccattcctctgtgagaagggtgatttcaagactgccattgatatgtgcaaggagattttcaacaaccggtgccgtgttgatgcaacgttgctgcagggcgtggtggataagctggcgagtgagggcatggatacagaggcgaaggagattgtggagatagggaaaaccaataggtattgtcgctataggctagatttgccagcagagaagtagaattatgttagtacttagtcgcattttattgttgttcttgcaatttaaatggttttttttttcacaatgatggttgggaaattgccaacaatggattttgtttggcattgtgagcttcg

SEQ ID NO: 5112 - DNA, 404 bp, Glycine max
cctctcttcttcttctctctccgcgggttgagttgaacttcaagaacctcataaaaccctttctctctctctctctctagatctgttcaaatccgaaaccatttccgctctaatttccaagagcaaaccctaatccgctctctctgtatgatactagatttcccctcctcaaaggcgtagttttgtgtcgatttgtaaattcattcggtagtttaggttagaatttttgtgtcaagtttttagggttttgaatcggtgagatgaatcacaacaacagcaacaacaatagagcgaggtaccctcccgggatgggacttgtgcgcgggggtttcaatccgaacctgagccagaacccgaaccagaaccagaacccgagcctgaaccagaatcatcacaatcatcac

SEQ ID NO: 5113 - DNA, 349 bp, Glycine max
acttcgtcgtccaagaggtgatggtgatctatgatggcgcccaggagaaggtgatttgtgtcgaggcccgggagaaggtgatctgtgtcgaggcccgggggaaggtgatctacgtcggcgcccaggggaaggtgatctacgccgacgcacaggggaaggtgatctacgtcgacgtactggagaaggtggtctacgccgtcgcacaagagaaggtgatctacgtcgtcgaaaagatggtgatctacgatgaactggagaatgcattctacgtcgtacaggagaaggagatctagatcttcttgaataaggtatcctcctataaggagaacgtcgtggtgaatgcctgtga

SEQ ID NO: 5114 - DNA, 377 bp, Glycine max
gatctctcttgactgaagagcacttaatcatggagtctatgtcagatgatgacgaatataattcttctagtgaaggatctgacggtgatgactccgatggcgacgaagacgaattgtcgaatcaagtggggaagcttaaactgggaaaagaagtagccacaaacaaaaacatagctgaagaagagagtgattgtccaatcacaacgtcaagtagaggtcgtctttatcctcccggaaggatcatgcatattattcctattgcacattcgtctgaaaatcctaattcaaaccacaatggttgtgatgagaaacatgtttccctatatgaaacgcctagagagctctatggaaagctcagactttcaagaaggatgata

SEQ ID NO: 5115 - DNA, 1276 bp, Glycine max
gcatggggagaggagggtgatatggttgtaagttaatgaagccctattctacatttcaccttctaatatagaattgagctaagttgtgatgcctgagaagtcacttaattgaaagcattttggtgcttgtactgcaaaagagatttatagtttttggttttctgaaaattttgatggatattttaaggtgtatgtcaaagtgatatgtcaacgaaactatactgtttaagagaaaaaaatagggagaagcttaaatttaaacacaatgaacaaacattgccacaatccacaataataaatcttattgcaagtggatgattatcctccaacaatcaacattcagtttcatcatggcacttggtgatcctatgaagtcatgacttacagttcctacacaaatgtgggagttctagtttgtctcaatttggtagccttgctttaattgaaggcttaactgatcctttccttttattttcttgtgcggtgattgatgcgacaccatcctagtagagcatgtccaaactaatttttctttatgatttgtgcttattggagttgagaaaacttcatgtttcctgtcagtctataagctttagattgactgtttaaaaaaataaactaccgaaagcattacaactggagtctgataacttgtttcctcttcttgacatctatataaattaattctttaagagtatcatatcatctataagttgaaataatgcaccaaaaaattaatataaacaaggaattgttaatttgtgggttgtgatttgtgaaacaaggttgtacttttatatgcatggtgcaggtggttgctggcaaaggccatgaaacatatcaagtagaaggtgataagaaggaattctttgatgatcgagaagagtgccgagaggcattgcagtatgttgatgagcttcaccaagctggaatagatacaagtgaatttccatggcggtaatatcaaatgttttcctcttcaatgcccttttgtaacttgacaaggctggttattggcaattaagaccacacctgcaacaaaataaataaaagaaaaacacagaattgtcatgtgttacccatgaaaaagaataacatgtttatttcgtttttgtcttgtcgcaggttaccagagagccattgatacaaaaggctgttgtgataaatattggattgttatcttcgagcaagtatgaagaaaagggcctttccgtggttagagagcttttctttgcaggagctggaaagcgcaagccccgaaaaattaggcgtcaga

SEQ ID NO: 5116 - DNA, 952 bp, Glycine max
  misc_feature (941)..(943): n is a, c, g, or t
tgatatataaaagaacaagttgaaaggcaatgtccatcaacagtttcttgcgctgatatcttatccttagcagttagggaagctattgatctggtaaaagtgtcatttactttatattaattgttgatagaaattctcagatgaaagttccttataattaaaacaacctttttgcctaggttggaggaccttcttggcctgttgcattaggccgaagagatgcaacaaaagccaatcggatggaagctaatcaacaaattccttcaccgttcgagcctctagataacatcattgcaaagtttacttcaaagggtcttaacttgagagatgttgtagccctttcaggttcttactcttttcaccaaatatttgaagcttttttaatacatgacatcatacatagttaaattcaatttgatacaataatgtatgaaatctatatttgattcattaaataaaaattttaaaggagattctggtctatctcataaaggatagcaaactacattaagatgatctcctgagattgtgtaattacatataattctattcctttttattttcctacactaactccttttaagtttgaaaatattacactaacaccaacttactaacaccccttatatgtttgaaaatattacactaacatcacctcaaaccttatactaatacccctacaagagagctgaaagtaatggttaaaaaaataggaaacgaaacatcaggagttgttgctataatttgttctagaaagtataactatttagtggagagtcagaatataatttgctttatatagtttggggattatttccatacacaacctattatggtgatgactgatgagtgtttgataattgatatcagtgacttgatgtgtctatttccatgatcaggaacgcatacaattggttatgcccgatgcttgaccttcaaannngagactttt

SEQ ID NO: 5117 - DNA, 360 bp, Glycine max
cattgtgttgaaaggatgaacgacatctacataaatcatatgctaaacctatcccctgaacttatgaaaggtcatttaacaggaatatagtcctaaagaacccaaaagtgtctgcattttctccttataaacgtggggatgattgctgttattttatactctctacagggtggctacaagacatgctaagcatatttattagtgtgttaataactaaagatctccaatttggcagtcatcattcacgctaacaactgtacttgtaccacagcatcaactccgctgcattcttgacagacaaataacaatagctaaactgctcattgttctttccctgagcttttcttccccgtcctatgt

SEQ ID NO: 5118 - DNA, 481 bp, Glycine max
ggtgttctttgatcaccttgaactccaaccgatcgaacaggcaagaaaactgcaaaagcttgccatattgaatcatagagcccagcatccttgattgaccgaacgaagatctcatcaacctaggaaaaaacaattgttagacataaatactaaagggtaatcatcaatcagcattacagacatacaaaagcacaaaagagccatgtacctgtcggagaatatctaaagcatttccttcagtcacatcacccaagactctcactgcaagaccaggccctgggaatgggtgacgttttagaaaggccacaggaacatccaagatcctccctaattgacgaacctacacaaacggcaacaaaaacaatgcataacataatctgagaatccaagcacatttaaacaagccaatatagatccaaagcaaaacctcatccttgaacagaagcttaagtggttcaataagcttcaacttcatatcttt

SEQ ID NO: 5119 - DNA, 399 bp, Glycine max
cacaaaaatggaatgaaacctgctaccaacactgcaaagaggaggagtgcagcgcaaatggaaggcatttcatccaagcctaaacctaagaagaagaagaatgaaatcactaagaggaccaagctgactaatgcccatcttccggagctttttcagaacttaaagtaaacaattcctgacttaaggaactcgtggcaattggtgaatgaattcacatagctcatttgttgacataaagcatgtggttagaaagtcttcatcgttcagatggatatggcctttttattgtattagcatactgcttctggttttggatgggtacccaattggatggtaacggtggccattgcaaattcaggtcattcgttatatctaggcttctacacgattctaaagcaa

SEQ ID NO: 5120 - DNA, 225 bp, Glycine max
tgcagcattgggcttgtccatctacgttatagtgaggccggaagctctcgcaacatcatcataattgggttatcattgtttttctctctttccatacctgcctactttcaacaatatggcatctctccaaattccaacttgtcagttccaagttatttccaaccctacattgtggcttctcatgggcctttccgcagcaaatatggaggggtatgccttttacta

SEQ ID NO: 5121 - DNA, 1397 bp, Glycine max
  misc_feature (1357)..(1357): n is a, c, g, or t
  misc_feature (1359)..(1359): n is a, c, g, or t
cattgaggcacttgaagatcctcattctaagccccttgttttgtggctcaatggaggtgaggcttgttcaacttaatttacacttcactaccactaactaactatcttttgttactattgacatgaaacattttaatttggtgtgtctgtagggcctggatgttcgtccattgctttcggacagtcagaagaagttgggccttttcatataaattcagatagcaagaccctccatttcaatccctattcttggaaccgaggtgactcaaccttatcaaacattcttttccacttttattttataaccaaaactgcctataggctacagcacatgtcgttttccactttttttaaacgtgtctatctgcttatatatattttttttgagtgatgatatttgtacagtcacaaattacaaagacccccttaacacctctaatttctctttactctcccttgtcctatcacattacatcacaggtgatgatatttagaccccttcaaattacaaacacctcattaacacatctattttctctttatctctctttttttcatcatattatatcaccaatcaaatcaatcacttatcacaggtgtagatacttaagagatgtccaagaatcatttgattgccaccttgtacttgtaatgatgtactgatttttataagcataaattaataagcttcatgaatgcatttatgtgtaaccactttttcttttcgtagttgccaacattctttttcttgacactcctgttggggttggattttcatattcgaataacaaatccgacatgctgatcaatggcgatgagaggacaggtggtactcttttcattcaggaatcccttgtttcagctacacacattaggtgagagcaaggagccaatatttaacattcagtcttacattgatggttaatattggttttacttaaaatctaatctaatattaaccatcaagtaagattgaatgatcaagattagctcctctcaagctctcgcctcatattgatacctataaatttgtgtcattaaattaattaaatttttgtgcagctgaggacaatttagtatttctattgaattggtttgagcgtttccctcaatataaaagaagcaactttttcatcagtggtgagagctatgcaggtaaacatggtcaacttgaaagtaattgatattctgttcattagattttcatatttgtttgtttcattggacttttcttgttttaaactcattgtttgctagtagtggttatgttttcaactgaattagttttggcactacaatactgaaaagataaggaaagaaaaggtgatatgaaaacacttaggtgtttgagttaaangnttctgatctgtttatttatatagattttataatactct

SEQ ID NO: 5122 - DNA, 192 bp, Glycine max
aaactctcccttcgcctctccagcttcttcttcttctccgttttctgatgctttttctcgaaggtactaattgaagatcccctttccttttcgttttcggtctccccttttctgaccctcaatttattttttggagcatcgtgctgtgataatatatatactctcttcttttcttttcttttcttttttttt

SEQ ID NO: 5123 - DNA, 448 bp, Glycine max
  misc_feature (429)..(430): n is a, c, g, or t
  misc_feature (433)..(433): n is a, c, g, or t
ggacgattgagaacgcgacgcaattagggttgaaggggtgggtgaggaaccggagggacgggtcggtggaggctctgttctccgggagtgttgacgcggtgcaggaaatggagcagaggtgtcggcgtggccctcccgatgcggttgtcaccggccttcaggttttcccctccgacgatgaccctgccactactgggtttcaccgcaaacctactctttgatcgaggttaattcgttaattaatccccctcaaatgcttcgcgccattagttccttgtgagagtggagttattatactttgaatttattttgatgtttgctagttaatgactcgagagaattacaactgattttcaagttgtacaatctatctttttagattattagattccggtgtctgttgcactgcagaatgtataaaaaaaaacnntanctaattttagagtga

SEQ ID NO: 5124 - DNA, 713 bp, Glycine max
caatcccatacacaagattctaaggttggaaatgcaattaagtgttggaattgaaaataccagctatgtcaatatcctcgagaagtcattgtaattcttttgacctcaagcaggaatcttctaatcatcaagatacaaatgtaccaataaatcttaagtccaatagtcttagatccgagccaccaaaggatagtctcacaattgcagatcagaatagggatgctaatgttggtgcactttctactacaaaggttgcaaaatttatgtttttcaatgtttagttcaatgttttagcctcctcctagtgatgagcattgatctaaattatattgctaattatagggaaatggagcaactgttcaggtgctaaaaaagcctactggtgcttttggggcactccttgggaattctgcttcaaagaggaagcttggtcctgataaggtatgctttcgccagatatctcaatgaatgtctatattttaattacatacatgatgcaaacatgcagctccatgtttgttctctacttatttccataccactttttggggatttcttcttagggcaaggaagacagcaagctagagcagattagatcttctgtcagtcttcctttccattcatttttgggtagcagtgaaaagtcagaacctacagtagaaactcatactgtagcatctgaaatgttagagtcacagagacctgtttctgat

SEQ ID NO: 5125 - DNA, 915 bp, Glycine max
  misc_feature (442)..(442): n is a, c, g, or t
  misc_feature (543)..(545): n is a, c, g, or t
  misc_feature (547)..(547): n is a, c, g, or t
  misc_feature (564)..(564): n is a, c, g, or t
  misc_feature (566)..(574): n is a, c, g, or t
  misc_feature (576)..(589): n is a, c, g, or t
  misc_feature (591)..(592): n is a, c, g, or t
  misc_feature (598)..(600): n is a, c, g, or t
  misc_feature (603)..(608): n is a, c, g, or t
  misc_feature (611)..(614): n is a, c, g, or t
  misc_feature (617)..(619): n is a, c, g, or t
  misc_feature (621)..(624): n is a, c, g, or t
  misc_feature (630)..(632): n is a, c, g, or t
  misc_feature (639)..(644): n is a, c, g, or t
  misc_feature (646)..(652): n is a, c, g, or t
  misc_feature (658)..(659): n is a, c, g, or t
  misc_feature (661)..(678): n is a, c, g, or t
  misc_feature (681)..(681): n is a, c, g, or t
  misc_feature (684)..(689): n is a, c, g, or t
  misc_feature (691)..(697): n is a, c, g, or t
  misc_feature (700)..(704): n is a, c, g, or t
  misc_feature (706)..(715): n is a, c, g, or t
  misc_feature (717)..(717): n is a, c, g, or t
  misc_feature (719)..(721): n is a, c, g, or t
  misc_feature (723)..(745): n is a, c, g, or t
  misc_feature (748)..(751): n is a, c, g, or t
  misc_feature (753)..(757): n is a, c, g, or t
  misc_feature (759)..(761): n is a, c, g, or t
  misc_feature (763)..(764): n is a, c, g, or t
  misc_feature (767)..(768): n is a, c, g, or t
  misc_feature (773)..(792): n is a, c, g, or t
  misc_feature (796)..(799): n is a, c, g, or t
  misc_feature (808)..(810): n is a, c, g, or t
  misc_feature (812)..(817): n is a, c, g, or t
  misc_feature (820)..(837): n is a, c, g, or t
  misc_feature (846)..(849): n is a, c, g, or t
  misc_feature (851)..(856): n is a, c, g, or t
  misc_feature (861)..(881): n is a, c, g, or t
  misc_feature (889)..(892): n is a, c, g, or t
  misc_feature (895)..(900): n is a, c, g, or t
  misc_feature (902)..(904): n is a, c, g, or t
  misc_feature (906)..(908): n is a, c, g, or t
gagaatgccttcacataattaaaggccatgtcttgtgccaagaatgagaggcaataaattctgtggctttttctctcaaccaaatggaggaacctctaatccttttatgctataagcctagttcctttttcaactgagccagagtggcttctatttcctcaaggttatcctcaacgcctctgcttcccttgccagcttgaccttgactgctattgcttggtgtctctgtcccaggaaagttcgatgtgttgcctccctgaggcgttttataatcatcattttgatcagtaatattgagttctttctcaaggaactccacaaattcttctcctatttcctgaaaggtaaattttcaaatattatgaatccctatttaggtcatgttggcaactatatatctagatggctcatgtatgcatttttttttttttggaaaaagggnggggaacgcttcaaaagggaaaaaaagggaagcgggaagttccccccccaattccccccaaaaaacttttggttttccttgggaaaaaggggttgcttccnnnanccccgaattttttttancnnnnnnnnnannnnnnnnnnnnnncnncaactnnnccnnnnnncannnnccnnncnnnntcacannnattctcnnnnnnannnnnnntaaatnntnnnnnnnnnnnnnnnnnnccncannnnnncnnnnnnntcnnnnncnnnnnnnnnnancnnnannnnnnnnnnnnnnnnnnnnnnnagnnnntnnnnngnnnannccnntcttnnnnnnnnnnnnnnnnnnnnctcnnnnctctccccnnntnnnnnnttnnnnnnnnnnnnnnnnnnacccctccnnnncnnnnnnaactnnnnnnnnnnnnnnnnnnnnntataccannnngtnnnnnnannnannnatctcta

SEQ ID NO: 5126 - DNA, 501 bp, Glycine max
tggcaaaattggaggaccgaaaggaaccatggcttgttgtgctttatgcaccatggtgcccctactgccaggtaaattcaacttgttcttctcgtattcgatctgttaagattgtctcacactcactatggttggttgaaatatttgttctctaatgaggtgtatattctgaattgcaacaggctatggaggaatcttatgttgacttagcagacaagttagcagggtcaacagggatgaaggttggaaaatttagagcagatggagaacagaaagaatttgcaaagagtgaactgcaattgggaagcttccctacgatattatttttcccaaagcattcgtctcggccaacaataaagtatccctcagaaaagagagatgttgattccttgatggcatttgtaaatgccttaagatgaggatatcaggaaattttcttcgtttttgggttgcaattccactgtgactatacgtacagcgggttccttctttatgctatta

SEQ ID NO: 5127 - DNA, 354 bp, Glycine max
aagctaaactctacataatccccaactattgctaaaagatatatttatcctcattacccctaactaccatgctctaatagaatgatactaagtgccataacagtatgataacaaactctttagctacaattaatgggccttattcctcttttggtacactcgcaaggcctttggcttccgcggtgactgaatctgatcaacacctgttaggaatacaatgatttgctctattcggaggtaaactcttgggctcagaaaatacttgagcatattcatccaacacctgttgtatttgtctctgctcctctatttttgcatcagttcgattctgtccttgctccttctctttatcca

SEQ ID NO: 5128 - DNA, 706 bp, Glycine max
  misc_feature (622)..(623): n is a, c, g, or t
  misc_feature (635)..(637): n is a, c, g, or t
  misc_feature (639)..(640): n is a, c, g, or t
  misc_feature (691)..(693): n is a, c, g, or t
ttgtagtatactttctttatctgtggaaatgttaattaaacagaataattaaacagaaatcctcttagctaaatccctctttgcaagttcatattatcctttcctgggtgattcttgcagcattgtcattttctcccgatagaccaactaacttgtcatgttttgcatatgcatatttatttctggaagtaatttgtgggtgatgaataaattttcaattagctacctgctatatgttgacatagaaatatcaactcactgtctcgaatttttggcaaaccatgttttcattttctatttatatggacatcacacatcaggtttattaaatcaatcagttgacactgcattttaactgctgtaaacagatgggaatgctccagctacacttcctttgccattggcggctcttttgagtctcacaataacatataaactggataaatcttgtgagcgctttgttattttggctggcccatctttgattgccctttcttctggttgcccctggccatgcatgcccattgtaggtgctttgtgggctcagaaggtgaagcgctggagtgacttttttgtattctctgcttctgcaactgtattccaccacagcagggatgccgtnnttcagcttttannnanntgcttcgcctccacccttggggcttggttctgcctgcatttataacaatgnnngtgttgggcaccc

SEQ ID NO: 5129 - DNA, 406 bp, Glycine max
gacgccagatctcttagcaccgctcttcttttcatcgattaaataacaaaaaattggcttaattttattctaacatcctaagcaaaaactaacgttttcacccgattttaacattcgagagaagagttagtttattttattgtatttttttattaagttactgtttctatttaaatcgataaacggcgaggtcgagcgttagaattcgaaatccggagaaaaaaaattacaggtattattatcaggggaatcgcgtggaagcgttgttgaggagagtgttgtgtttgatctgaggaagaagaaagaaaaaaaataatggtgggaggtggaagcaggagggatgaagggtcgttggtgttgaacaacacgaacgtgtttgcagcgctggatactctgaagaagaaga

SEQ ID NO: 5130 - DNA, 460 bp, Glycine max
gatctccctccgcagcctctctattcccacaccctattcgctacccctcaaaacctcccttccgttcccgcgcttcaacttccccaaaatcgagagtaagtaccaaccatccaaaaatttcagctgctgtcaaattccaaactgctaactgtgattttatggagcaggattacgagggttgcagccctgtgtgagtgtgagtgaaggcagttccgctgaggctgaggtgttggaggagagccgaattcgtcgagtttgcgacaagctgattggggtgttcatggtggacaagcccaccccaacccattggagaaggttgttggctttcagcagagaatggagcaacctcagaccgcacttttttgcccgatgtctcgaaagagccgatgccgctgaagaggatcccgccatgaaggagaagctgcttcgccttgcgaggaagctcaaacagattgatgaa

SEQ ID NO: 5131 - DNA, 1141 bp, Glycine max
ctgatttctacggaggcctacaagtagactggtaatcctgcaaattattttaaaatattttttgctgttttatacactatccataataaaaacaaagaagtcttcagtcaaggttttgtttgatcaacatgctgaaatgaaactaaaaaatcatgttagtttaataaagtgatgaaagttttaattattggagccagaaaagtaatatgtatatgaaagatatcgagtctgaataagatgatctatgttatatgtgttctgcttttcaccctccccctgtcataaattttgaagagtaataagcaatggagcataacaatatagtaaaaaaactaataggagaggagaaacttgtagaatgcagacttggatctctcaaatgaaagttcattccacaaattttccatttgatacatcaaatcttttgtgattaggtagatttgatttcttaaaatattgcctttgttcatgatgataatggatcatgcatttgtttataagtgttattattatggcccttccttggaattaatatttctacaatatttgttggcttgttgcttgatctcatttactatattttatgctgtgaagtagtagaaaactggaacttaaatatcaacctgaattatgtgattatgatatttcattgatagattaatcattactgcattctgtctttgatttataaagcatatgttaattatgtggaaaagattatatatgtttctttgctgcaatgcagatcagtcaatattcaaaggacaatgtttgttttgttatgttcctggatgatcaaactctatccaaactttcatcagaaggaagcagtcctgatgagagagggtacattggcttgtggaaaatagttgttgtaaaaaacttgccatatgaagacatgcggagaactggcaaggtgccaaaatttttatcacatcgcctcttcccacattctaggtagttctagtaatctgttctagcatccaagttttctttctttctattcctcatttccatgatgtttaaaaatcattccttggtaggtattcaatttggcttgacagcaagatgcgactcaactctgaccctatgctgattattgaatattttttgtggcgaaggaaggcagaatatccattca

SEQ ID NO: 5132 - DNA, 372 bp, Glycine max
tttgaagttctcattgttattttatgatgctatgttgacactattcggtacatcagttgcttccctctcagctggggaaaatgctgggattgctttcttgattggtgggattggaggcttcttgtatctgctactattgcagagatctgtggatgaattgccagcttcagaattaatcaccaatgacaagggaagaactgatgcactgttcagaggagtgaagggtccaatagcaagtgtggcattggctataggcttggctgtaattgcatcaagatatagctctggagatcttgaactgatgctaacaccaaaagatctcatagttggaatgatgggatttcttgcatgtaaagtttctgtggtgttggc

SEQ ID NO: 5133 - DNA, 328 bp, Glycine max
gatcatggatagaagcaacggagacgtggccattgactcatatcaccactacaaggaagatgttggaatgatgaaggatatgaatttggattcatatagattttccatttcttggtcaaggattctcccaagtaagttgattgctttataactttggactaagttttgccttgttggatattattttttaacctttttttttaattaaatgtatatttacagaaggaaaactaagtggaggtataaatcgagaaggaataaactattacaacaatcttatcaatgagctagtggctaatggtaagaattcaaacttcaatcttttttt

SEQ ID NO: 5134 - DNA, 330 bp, Glycine max
tagcgctacttccggcgagcctcgccaatacttctgccaccagtgcaaccgcaccgtctcaatttccccttctccctcctccgatctcctctgccccacttgcaacggcggcttcctcgaagaactcgaaatcccaatccccgaccctaaccctcctaatccttttttctccgacttccccctcggcggcgccgccaccattcccctcgtcctccccggcgctgccacctcccctcccttcggcgatctctcagccctcttcggcgaccgatccgacgctgccgcctccgatgccttcaaccccctcgtcttcctccagaactacttcca

SEQ ID NO: 5135 - DNA, 173 bp, Glycine max
agatctcaatttacctcgtgtggcagctaaagacagaaaatcataccctgagaatgcatcatctgcagttgagaaagagctcgtgaagccaagaactaagaaactcaagatgcaacttgcttcaacgaatcatattggtaatcatgcctactttttcgagtattaagtttttt

SEQ ID NO: 5136 - DNA, 400 bp, Glycine max
gcgatgacgctatcccccgcgccctcaccgccaccggcattagaagaggagccgttacctcacgacggcgacgattaccacggcatcgtttcactggacgacgagggtttcccgtcgcaattccccgaatcaggaacggcgtcggaaaagagcagtttcgccgcggatttctatcgcagcggaaccgattggtcctcgctgttgttgtcgctggaagatagtaaacagagcgatttagcgcaagattcggggaagaagatgaagcaggccaatctgttccagatttgggggtttaaaagaaacgacgccattggttcagttgaatctggtcccagtaaaagtggttgttgtgacgacggaggtggttcttctgagaggaagattgtgaaacctgaaaaag

SEQ ID NO: 5137 - DNA, 867 bp, Glycine max
  misc_feature (852)..(855): n is a, c, g, or t
  misc_feature (857)..(858): n is a, c, g, or t
gtgcagtgaccatagcagaagaagcagtgatgtcaaacgcagcagagcaagctcgtagtttatttggaatttgtctctcacacagacccaaatggcaacaattcctcatttgttcttctggtttcttctttggatatctagttaatggcatatgtgaggtactatatagggtatatacacaagtacatgtactgattaactggttaattttcttcaatatcatttggtggtttgaatctgtaaaaccactgtaataggccgtggtcttttatgtttccttggagaagagaaaaaataatgagtttattgtttctttctgtttgtgggaacgacggttaaagttgttttgcttttgtttgttaagctctgtttcatgtgttttctgagtggcttggagattaatcatggttttggaattttcattggaaatttgggctcgaattgtactatctctgccgtcaactctagtcaatcatccagataaataaataaattgtatatttttttgtttgtgtgctgcatccaaataattgcagtatgtgaagttatatcgacaaataatccttttttttatcgtgcttgacttccaggaatatgtttataacaggcttcagtttaggtgaatttcataacctcggtgctttttcagattgatttgagctttttgatttgagatatcttcaatagaatgaaatagttgacttggttcgttatttcagctatggttggtacttcacatttgttcaaggatttgtttacttgtttttgatttatcttcaaggcttcacaagcaagcaaatgatgaacccatggaaaacttatgtgaagctttctgctgtacttatgggttcnnnntnncctcacaaa

SEQ ID NO: 5138 - DNA, 499 bp, Glycine max
aggtttcttgagcttcatccaatagccacacacattatagccatccacaagaagtacagggacggcattgtctaatataccctgctggtttgtgctgtaggagtagacatgtatatgagtaattagatttagcgaaagaaagagtgcagatgaacttactagtagagggaggtggtgggatcacgatagaggtctgtgtcaacaacatcatcttccttctcgaccttcttcttgcggtaactggtagaaggcctaggagtgctagaatttctattctggaagctctgtttgatttgaaatagcataaggatgagtaagtatgataatgaggtgcgtaaattattagtattaccttccatagctttaggaagcggaggttttgtttgacgttggatgtgattcttggaggagtggattcagaatcctgagtctgcttcttgcgtaccatgaggctgctgtgacttgatcctgcttttaccactaaccaattatgccacca

SEQ ID NO: 5139 - DNA, 352 bp, Glycine max
gtccctgtggttcctcaagaggaaagatttctatttcgacgagtttgccccaaagattaccacatattccgctgtgtcgcccgatatggctacaaagatgttaggaaggaagatcaccatgcatttgaacagcttcttattgagagtcttgagaaattcttgagaagggaagctctagaaacagccttggagttggagggcaatttaagtgatgacatggacagtgtctcagtgaatacaagagattcagatgttcctgttgatactacggctgaggagcttaggattcccctggtggatgatcagaaattggaagaagcaggagcttcttctgcctctcaggaagttgcat

SEQ ID NO: 5140 - DNA, 291 bp, Glycine max
gtttgccggtgacggcacaagagagccaagtgaaacagagatggctcttgcagagcatcagggcaagtatatggctattgtagtcaagaagctcgcccagtcatgaatggtgttttcttcatttcattctattcttgttgatcatctgtatttttttaccgttcttttttgtcaaaattggttctggcattttaccattgcattgtgatgaggaatggaagctctgttacactattttaattgattctgttgggtttgggggttctgcattgtttccggaaggtttagatg

SEQ ID NO: 5141 - DNA, 371 bp, Glycine max
  misc_feature (350)..(350): n is a, c, g, or t
agcttctatggtcaattttatggcggtgcctggtaagggttgacaacatgtttggaagcagcttacttgtaccattccttcatgattacaaattgcaattatgcatgaaaaagttttcaaaaaagagaaagatattccaacaatcagtgatcaacatgaagtatttagattttatatcaggaaagggagggcagcaagcaaaccatgtctattcgaggcattaaaattattgtaaaaaatatatatttattcaacatgaagtttgagcttctgactattattattttcttgatccactctgttttccatgtgggatctgtagctattggtggtgaaatcatcctaaaaangacgctttctaaattatttgc

SEQ ID NO: 5142 - DNA, 253 bp, Glycine max
aaatttctcgttttggattctcaggctcccttggatatggagcaccaatccggtctgtgtgaagcttttttaccttggagctgaactttttccatgaaatttttccttcgtccaactgatcaacaagtttaacaaaattcatcctacatcaaccattgaaatcaactatgatgagaatgaacaggaatcagttaacacaggtctaaaatgcatatcaataaatcatcttggttgaagtaatgaagaagaaata

SEQ ID NO: 5143 - DNA, 818 bp, Glycine max
aagactatacttaaagggagtagaactgtttggcagaaacaggtacggagctttctgtgtttcacctcacatcattatgttgagaaatacaaggatggcaccaaatttaattgtgcatttcacctcacaaattatccattaagctttctcatgtctagtgcatatgttatatccatatatcatatcatatttttcctcaccaagtgggataaggctttgttattattgtttcatacatgtttttgttagttcttttgtgaaatattcttatttcttgtgtcaatgttgagctccattgctgcagcccttttcattatattatgcaattaataataattaataactattgaagtttgaatgcacatttagcaattgattttctctaaactgcaactaataaaatgcatgaatttgaaacctctgtaggcaacttccccaattgtggctaatggttcataagtaattagtaaatgaaactaatgcatagtgcatgtcataaatatctacttcatgtagtggtctaattttattctgtgctcatgtcaagtgtaacttatactctgcagttgcctcatagcaaggaacttacttcctggtctgaagacttgtatggaaatagctagttacatgcattctggaggagtgtcaatgccccacggatctattgttgctcctagttcaatcatggaagaaaagggaaaatttgatgctgactgcacagtgagaattacaacctcttctgtttccatcttctttatcctacattcttgtgtcttgacgtctttctgttattttctttttggaggtgaggggaggat

SEQ ID NO: 5144 - DNA, 359 bp, Glycine max
  misc_feature (19)..(19): n is a, c, g, or t
tgattacatcttgtgtccnccctgatccacagaagagaccaacaatgaaagatgtgagtgagagactgagagagataacaaaaataacacctgaatctgcggttccaaaactttctccactttggtgggcagagattgagattgcatctgcagaagcacgttgagatcagtgtagcagatttttaaaagtctttgagagctcttagcattgtgatcctttttttccttagctgaaggcataaaaaacttcttacttgaagtatctattgttgtaggacatggtcaaaagtgacgtgtgggggaccaaaatggtgtggtgaagttcttttgggtgctgttttttttaaaaaagaaattgt

SEQ ID NO: 5145 - DNA, 647 bp, Glycine max
  misc_feature (634)..(635): n is a, c, g, or t
  misc_feature (637)..(644): n is a, c, g, or t
gccgggctcgagaaggagccacgcgccctatggcggcgctatgtggagtggctctaccagcacaaggatctggggctctaccttgacgtgagccgggtcgggttctccgacgacttcgtccgcgaaatggagccccgcttccacgccgcgctccgcgccatggaggacctcgagaagggtgccatcgccaaccccgacgaagggagaatggtggggcactactggctcagggactctgctcgggcgcccacctcgttccttaaatcgcagattgataacacgctcgtcgccatttgcaccttcgccgacgacgtcgtcaccggtaaggttagttcgaacttcaaattcgcggctccgtcgttagttatgtttcgaagaggagtgctagtgacacactatctatagagattcattgaatgcgatatcagacctgtaaaattttgtgattttcaatgaatttcaactaataataaatagtgtgttcaaaagagtgtgtctgggagtgtgctactagcatttctcattttttgaatttgttgcgtgtggttggtgattgtggtgatggtttgggtttttttggcagattaagccgccatcgtcgccggaggggaggtttacgcagatactttccgtnnannnnnnnnccc

SEQ ID NO: 5146 - DNA, 370 bp, Glycine max
ataccgaggggatgtgtttgaggacattgatgttgatttggtggtgggagaggaggaacagaagaagcatgaggaggtagtgggtggagaggaggaagagaaagctagagttagcatatgtattcctcccaagaatgctcttttgttgatgagatgcagatctgatccggttaagatggctgctttggctaaccggttttgggaatctcctgttcacaaagacagatgtcaagaagaacaagatgaagaagaacaaaacatcaaaacaaaagaagatgaacaactagaggaagtacaggaagaacaagttgaaagagaagccatagaagatagcatttgtgagagagaaacagaaactgctgttgtggcc

SEQ ID NO: 5147 - DNA, 513 bp, Glycine max
taaagcagcaaattaaagtcacttttatacaaaatcaattagttaatgatgaggtgctttctaccttgctttcgtacttctaaacggaggaaccacttgcgttccgcctatgaagcccaagtaagcaagcaaaacctcactctgtcttaagtcttaacgatttagatattttggttctcaaaacttgtttgttacagaaccatgtgggagaaggagctgttgaagaactcattgattccatagcagagtcaaagtaagcaatccattcattcctttagtattttgataatatatatttattatcctgtcatttacgctttcagaacaaaaaatgaagagcaattgaataagagtgttgaaaccaaggatgatcggaaagaggaagcacctcaaatagatgagacaaataaaagatcgcatcaagaagagtcttcggagtcactgttctctctctccatttcttctaggaaaaaagcttcagatgccgagcctgaagttaacagtcctattcga

SEQ ID NO: 5148 - DNA, 346 bp, Glycine max
ttgatggtgagactttaactctagaatctaactatagcagcagccgtgagcacactggagtgatggggcttttctatctattggtggcagaacagcttccagaccaacacttcagacatacctctcgttcttcattctttatgaatataaatagtatatttcattgatagataactagtgaaatgctaatatatttggagtgtcatcgatggtatcaaagtatgtatgacggtcaaaagaaatataatgacagaacttagaagtataattggaaaaatatacttctcttgtcggcggcaatagacaacaaaggtaaaagccggcgaagagcatatttccaagtttg

SEQ ID NO: 5149 - DNA, 185 bp, Glycine max
tcttttattattttgattcataacttgatctatctgtaatctagtctttattgggcgaacgagtgaattttggtttataagctcttcaaactttggtttgaattcgttcagatatcttattgaaaggaaaattgatataaattggtttaaatcttctgaccaattcataacctcctttttttttt

SEQ ID NO: 5150 - DNA, 1012 bp, Glycine max
  misc_feature (882)..(882): n is a, c, g, or t
  misc_feature (887)..(887): n is a, c, g, or t
  misc_feature (889)..(892): n is a, c, g, or t
  misc_feature (915)..(915): n is a, c, g, or t
  misc_feature (917)..(923): n is a, c, g, or t
  misc_feature (925)..(926): n is a, c, g, or t
  misc_feature (937)..(939): n is a, c, g, or t
  misc_feature (941)..(946): n is a, c, g, or t
  misc_feature (949)..(955): n is a, c, g, or t
  misc_feature (960)..(961): n is a, c, g, or t
  misc_feature (964)..(968): n is a, c, g, or t
  misc_feature (979)..(989): n is a, c, g, or t
  misc_feature (995)..(995): n is a, c, g, or t
  misc_feature (998)..(999): n is a, c, g, or t
  misc_feature (1001)..(1003): n is a, c, g, or t
  misc_feature (1005)..(1005): n is a, c, g, or t
  misc_feature (1007)..(1008): n is a, c, g, or t
gggggcatacaaaaaattcctatctggtaaagataaaatttattagtcaaacttcagtagctatacccataagagcaatattgtataaaattgctgaatgaaatagcgtagatttctgattattaatacttacagagaagctgtcatcttcatacaaatgcaggtatttgattggtggtggctgttgatggttcccgttacattcaggcatttgactagaccaattacgaaccacttgtgcttcctgctcaagacctacatctgacggcttgattttttctgggaaacattaaataaaatgttattacaaaaatctcagttagacagcaaaactagtatgtagcaagattgtagaaaatcacaagggaacaaaaaggtatgacacaagttaatgtgtgatatgactgtattttaaaaagactcatagaagttcatgtgtgatatgactgtattttaaaaagacccggaacagaaccgaagttcaaagagagacaattaaaatgtgaaactagtatttacacctacatatgcacacttgaatagcccctggagcagattatataaccacaatctctaatattaagagtcacaatcacatgcttacaaagatatttggtccgatgagaaaatcaggccacaccgtgtcacatatagtgcagtttaggtatattggatctatcttacaaagcagctggaacattgagggggattatagcacaggataccagcagaggcacataaccagatggccagtaaaaaatcatatttcaaaaggtagagctcttttattgtgcattaacatactgataagcaagaaaattaaattaataaatgacaaatggaaatcaagtttacagcaaaaagcttcaagacaaaatttanccctnannnntctaaatctatcctaaaatttanannnnnnntnntggcccttttnnncnnnnnnaannnnnnngattnnttnnnnnaaaagtttggnnnnnnnnnnntgactngtnntnnntncnnaaaa

SEQ ID NO: 5151 - DNA, 397 bp, Glycine max
gagtgtacttcggtcctgagcgttacacatttgagcacatgccaattgatgccatgagaggacaaatatttaatgcctgccgttcatgaattggtatgttacagaatatggatgctgcttggtcgagtggttcatttgtcaacagcttaaaaattcaggtttcagcatctaagtttcaaagatgcgacaattgacagtgatcgagtgagatccgtggaatatcacccaaatgctgcacaatttgaaccttgtaaatgtggaatgtgacagtgatatggaatctgaaccgtagttagatgagaaatctgttgttcattgctgaaatgtgcccttcaaccgaacataggatcataatcaagtagagttaatgttgcagtgtgagaacatgcttgatacg

SEQ ID NO: 5152 - DNA, 962 bp, Glycine max
  misc_feature (34)..(35): n is a, c, g, or t
  misc_feature (829)..(831): n is a, c, g, or t
  misc_feature (860)..(860): n is a, c, g, or t
  misc_feature (876)..(881): n is a, c, g, or t
  misc_feature (893)..(893): n is a, c, g, or t
  misc_feature (895)..(899): n is a, c, g, or t
  misc_feature (901)..(901): n is a, c, g, or t
  misc_feature (903)..(908): n is a, c, g, or t
  misc_feature (911)..(916): n is a, c, g, or t
  misc_feature (918)..(919): n is a, c, g, or t
  misc_feature (940)..(943): n is a, c, g, or t
  misc_feature (945)..(946): n is a, c, g, or t
  misc_feature (948)..(949): n is a, c, g, or t
  misc_feature (954)..(959): n is a, c, g, or t
tttctcaaggcctccttagttccctccaatgccnngtgtgtaaaacgcaagttctcgtgccaagtcatcattgacatctacttcttgctcttgatcaacatcaacagagagtttgtgtatccattccacattctctggccaactgatgtctccaagtttatctagtagagcatctctgttatacactgcatttttagatggttcagttaatttcacatcttcatcctgctctgattcagatgatgacatttcttctctctgatcttcagtttcagcctcaaccagtgtatcatcattaacaggcattgccatttaacctatacaaatattaaaaggaaaaaaaaagttcaatttacaccaaaatagtggagtctagcatttataaccatcatttcatgtgctaagcagaacttcattaaggatacatgagacaaagaacatctaagggacagagatttctcagccaaaaggtggagaggaggtgatacattcaaaggagtatcatagcttaggatacatgagccaaataaaccatatttcagaaataatgttataggcagagcccttaacataatcaacataattatacgaatgatatattaataataaataaataataactgacataatatcagatcaacaaagagaaaatcaaaattttcttcttttaattcaaaaagatcaacttatttatatgcataacaaataaattataaccgacatgatatcagatcaacaatgcataaatcaaaattcattttattttaatacaaaaatctcaatgcttcaagaaaaaataggacgcaaaagaacatagtattgtaaccannnacctaaaaactaaatgcccttttgacttnacattaatttgctttnnnnnnctctcataacanannnnntnannnnnnctnnnnnncnncttctttttacattccaaaannnnanntnncaaannnnnnaca

SEQ ID NO: 5153 - DNA, 408 bp, Glycine max
gccgactcattcatccaaatgttgagtgtaagcgaataaatatactcagcagatgagtgaatgatgcgggagacaaattgaatcttaagtttcctgtacttggactgaagggagctcccttttccttttgtctcttacttcttctactatttttatttgcacatgacaaactgcatatcatttctaatctctctttaaagtaaggtagtacataattgaacttttgaacttaatatgctgtcccaaattatgttcccccccggttcccaggttgtgattaattacagttttcttcttctttcggtgtaactttgttgcttttcaacaaatatattactgctggcatggcatgtaaggtctttgacaataataatatttgcattaaaagtgatttatgtgcttgtggtg

SEQ ID NO: 5154 - DNA, 480 bp, Glycine max
gaaacatgaaaatccttcaaacaatcactggctgaaacgttttcacttaaccgtggatcttcaatgttcctgttgttagctgctggcattcctgaaagaaacaaagcaagttcatcctgttctccttcatctaaacgcaaccaaggcagagacgccttgcctccaggaacaactgattcactcaacgaatgctcaactttcattatattatcctcaattgcagtgataaaatctcggtgcctatttctcgcttcctcacttgagcttttgacataacttgacctcaccgcccgtgcaaattcctctaactgcattgccaaccaaagatgcaatcatatccccatttgaacaacaaaatatgtcaagtgaactagctatttctgtagcatatatttaccagtagtagtaggaattacctgccatttggcagtgctaagtgcagtgcgtagatctctgcacaattcatcagagttccacatg

SEQ ID NO: 5155 - DNA, 579 bp, Glycine max
gattttggtttggctaaacttggtccagttggggaaaacacccatgtatcaacaagggttatgggcacctatggatattgtgctccagagtatgcaatgactggtcaactgactctgaaatcagatgtttatagctttggtgtagtacttctggaaataattaccggaagaaaggcgatagacaattcaaaatcagcaggagagcagaatcttgttgcatgggtaagagtcttctacagttatctcatttcctactagggttggttgatcattttaaagcagcacatcaaaatatgaattatcacttacaacaacccttagaccaaaatatttcataatgaaatttgatgcatggcttggtccttgctccttaactatctgaatattaagtttttttaggatggactattctgatttaactgcaggctagacccttgtttaaagatcgaagaaagttttcacaaatggctgatccaacactccaaggtcaatatcctccaagagggctataccaggtcattgctgttgcagcaatgtgtgttcaggagcaggctaacatgcgtccagttatagctgatg

SEQ ID NO: 5156 - DNA, 479 bp, Glycine max
taaatcaactggtcgagacgacctggacgcagaagagctgggtcaataatatctggtcgattagtggccccaatgatgaacacagttttctttgccgacattccgtccatttctgtaagcagttggttcaaaaccctgtcagcagcaccaccagcatctccgacactactacccctctgcaagacaaaccaaggcaaatagttgaagactgataactataaaaagacaataatagttgtctagacataaatattttgaaaccaatgaattttgcccaaagtcctagcttggtaaccttgagtggtacaaacctgagttgcaatagagtcaagttcatcaaagaataggacacatggagcagaaccacgagccttgtcaaaaatttccctcacattagcctcactttctccaaaccacattgtgagtagctcaggacctttgacactaatgaagtttgcttgacattcattggcaatagc

SEQ ID NO: 5157 - DNA, 325 bp, Glycine max
ggtggcgaggcacgtgacccttttgcttgtgaccctaagaacaccgccacaaaaaacttaccattttgcaaggcttggttggcaacaggggcaagggtgaaggatctaattggaaggttaacactgcaagaaaaagttaacttgctagtgaacaatgccgcggcagtgccacggcttggtatcaaagggtatgagtggtggtcggaggcactacatggggtctcaaatgtgggccccggaacaaagttcggtggccagttccctgccgccactagcttccctcaagtcatcaccaccgctgcttctttcaatgcttctttgtggg

SEQ ID NO: 5158 - DNA, 651 bp, Glycine max
tttttcgctctcttcttcccctcccttcgcttctttctcgaccgattcatattcgaggttcgtaccttacctttctcattctctcttcttctcttctcttctatcaccgttgactcacgactaatcacatattacttattaaacttgtaatcaaagtttattcaaacaaactctgctgcctttgacttttatgttcactctgctttatatatgacagaaagtggctagacgattgatttttggaaaggggcatgcggcgctggactaccagactgacgagagaagaaaaaagattagcaaatttaaggaatcagcctggaaatgtgtttattatctttccgccgagattcttgctttgtctgtaacatacgatgaaccatggtttacaaatactataaacttttgggtgggaccagggacccaggtctggccagatcaaaagatcaagtaagtatttctccacatgcctcacttatgaatcatttgttctttccatatgattttaatttataaccttttaacatacatttcaggttgaaattaaaggcagtctatatgtacgctgctggattttactcatactccatttttgctttaatattttgggaaacgaggcgctccgattttggagtgtccatgagtcatcatgtt

SEQ ID NO: 5159 - DNA, 1110 bp, Glycine max
gatacaaaccaagttaacgttgcaatcgcataataataaccatccgaagtttattgagagaaatttgcaagtttgaaaagaaacatggcatctcatcaacaaaacaagcaagagcttgatgaaagggcaaggcaaggagagactgttgttccgggtggcactggtggcaagagccttgaggctcagcaacatcttgctgaaggtttattatcaatttatagaacactaattataattgtttccatactttttactttttttatatttgtgctagatgaatctctctattttaaaaattttattttcaaagtattattattcatcatgacattttacatatttctcttcattttttactttctttcaaattattattatacatcacatttattcatcattttcattgaaatcgcatttattcatcatatttgtccatgaaatttttatctatattattcttttcattaaaatcattattacctatatcattcatcattttctttgaaatcactgttatctatcatatttgtccatcacatttttgtcgatattattcattacatttgtccatcattttccattgaaatcattattacctatcatatttgtccttcacatatttttcaatttttcttttttatctttcattttcctgaaatcatatcatcatttttttattttactttcttatcctttttaagttatggacactttcattagaggcgtaaaaaagttccatcttttccataaatatctcagatcactattaatttcttctcaagtgtaatgattgatgaagtcatttttgtgtttggtattttgtttgatattccataaatatctcaaccattatttttctctcgaagtgcgattgatgaatttattttagtgtgtttcggtattctgcttgataacaatatctgactttggattttggggtttgttatttttggttattgtaatcatataactaggaaggagcaggggagggaaaacaaggaaggagcagctggggacagaagggtaccatgaaatgggacgcaaaggtgggttgagcactatggacaagtcaggagaagaacgtgctcaagaggaagccattgacatcga

SEQ ID NO: 5160 - DNA, 373 bp, Glycine max
  misc_feature (306)..(306): n is a, c, g, or t
acaacggcggtaatgtagttcgatgtgggacttcagcagtcacgggcgaaaacctagtaacactagctaaagcacaagtggactacattctgggcaacaatccaacaaagatgtcttatatggtgggttttggagagaggtatccaaagcatatccaccacaggggttcctctctgccttccatccacgcacacactcaacacatttcatgcaacaaacaatgttgtaggtttgcttttgcccattgttataggatgaaattatttatagaaagtgcatcttactcggatgtgcttcattgtatgngcaattagcaagtagaaaacaatcttagtgtggttttcgtttttaatcctgttgtgataggactcct

SEQ ID NO: 5161 - DNA, 377 bp, Glycine max
tggtgcagtttttctccaccattagaaataaacctgcatctgatgctgttgctcttttaagcttcaattggtttattcttggcactctaacctaccctaccttaccaagggttgctcgcatgctggctccactagtgttacgccttatggaccaaaccatgacacctggttcggtctcctttccatagcttgacactgcttttttcttttctgttgtgttatattatgtgcagtataatctgaattttgtgtccttttttactgtggtgtgcgtttcttattgcttgtacaatacgaggaatctctgtaatttagttgtctgtgttgtgatattctgttttttctgtttccagctcacaaacatgaaagggagataa

SEQ ID NO: 5162 - DNA, 735 bp, Glycine max
  misc_feature (717)..(718): n is a, c, g, or t
  misc_feature (720)..(721): n is a, c, g, or t
tctttaagctgactaaggctaaggcgtttccttttcttagtttcaggcacaaagacgggttcagttttacttattttttcttcatcatttgattcctctcccttagaagtatcagcagttccatcttcctcatgccgaccaatgaacatgagtcgatgatgagcatcccactgatccatccctgcagcagagttaaactatctcaagtggtctgttgatccttgcaatttctgtatactccagaagaagcacaaatggatcttgagtgtaatcatccacattagcaacacaaaacaaattaacaaaaaaacccaaatgcttagtgagcaatcctttcgataacaaaggttaatttaattgaatattccatgtgacatgaatccatcatagtgcaacatggcatcatgatttacaagttaaaaaaaatatgagtataaacaaaattcttacagcattaacctgctgcttcatattatatcccaaagcagtaagccacagacagcaactcctacatgccatggtgatgctttcaccgaaagcctttcaatgaattgaaagcctttcggccatcaaggctcccccagaacataacaacaaaatgaacttagcttgctattggtggaagtaaccaagacctaacatggactgtactgtaccacaaaatcatccaaccatttagacctacgtgaaatattaattttcaaaaattttatttcnngnnaagccacaaaaatt

SEQ ID NO: 5163 - DNA, 709 bp, Glycine max
  misc_feature (549)..(551): n is a, c, g, or t
  misc_feature (560)..(562): n is a, c, g, or t
  misc_feature (565)..(570): n is a, c, g, or t
  misc_feature (574)..(578): n is a, c, g, or t
  misc_feature (584)..(589): n is a, c, g, or t
  misc_feature (591)..(592): n is a, c, g, or t
  misc_feature (601)..(605): n is a, c, g, or t
  misc_feature (617)..(621): n is a, c, g, or t
  misc_feature (624)..(624): n is a, c, g, or t
  misc_feature (640)..(644): n is a, c, g, or t
  misc_feature (646)..(646): n is a, c, g, or t
  misc_feature (658)..(660): n is a, c, g, or t
  misc_feature (662)..(667): n is a, c, g, or t
  misc_feature (675)..(681): n is a, c, g, or t
  misc_feature (683)..(692): n is a, c, g, or t
  misc_feature (699)..(704): n is a, c, g, or t
aaattgaagttcgcagtgggtggacttttagtgatagtgtcgggtgaagaggatatgttagtgagctgcccctcctccgcaccgtacgtagaagcggcggaagaatcattggaaacggctttccaatcctttgaggtggtgagctgcgcctcggttgatagatagacctcaaaggaacttgttaacactgtgagtcagatgatatcattatgattattatttttattattccagttattgtcttgataagaaaatgtttcagggaatgaaaatatagatatgcttatgtgttgttgctatcactttgcatattgtatgattggttgccagaatattgaggagtgtcaacattattggatccttgccagagaatcttggaaaattgactaatttggaagtattgtaagtggtgatttattttcttttcctttatgttctttttaagatgataaatctcaatttttattgtcatattttagtatatttagagttaaaatatgagtttgagtctaactcaaccccaaaaactaactcactggtgagaggttnnnctctacttnnntannnnnncttnnnnntatttnnnnnnanngtgaaactnnnnntttttttttttnnnnnttnttaaaattttgaaaannnnntngtttttttcctnnncnnnnnnttgggaannnnnnnannnnnnnnnntttgttnnnnnntattt

SEQ ID NO: 5164 - DNA, 423 bp, Glycine max
gttcgccaccggcatcttgtttcccttcttggttactgcttggatgggaatgagaagcttcttgtgtacgagtacatgcctcagggaacgttgagtaggcatctttttgactggccagaggaaggactagaaccactggagtggaatagaagattgacaattgccttagatgtggcaaggggtgttgagtacctccatggcttggcccatcaaagcttcatacatagggatttaaaaccttcaaacattctccttggagatgatatgagggcaaaggttgcagattttggtcttgtccgtcttgctccagaaggaaaagcctctatagaaacaagaattgcaggaacttttggatatttggcgccagagtatgcaggtatctgttagtattttaacttcccttcactgcactatgtctttttg

SEQ ID NO: 5165 - DNA, 362 bp, Glycine max
aaacagcaattggaccagagaatgcgattgcattataaggccgcaattgaacagatcgagcaagttcaaattgacgtaacatgaaacctattaatgcgaaagcgccgtggagagcaacaaaagtccacagaccacctaattgacaccaacgggtaaaatctccctgtgcttcaggaccccacagtaacaacaaagagtgtgctaaactattagcaggagtggagactgcagcggttaagaagttgcagccttccaaataagaacttgccaatccatgagtataccatgaagttacaaaggtcgtacctgtgaaccaaccccccaaggcgaaataggcgcaagggaagagtaatagaccggac

SEQ ID NO: 5166 - DNA, 401 bp, Glycine max
ctgtaaagatgcgatgagatatgatagaagatgttctctatatacaacactatttcaaagaaattcaattagacgataattttcatttttctccccaaaaaaaagcaattctagcacaagagtccaataaccttttcataagtaagaaacctacctttcttttcttaagatttttgctaatgatttcttatataaaaagtgattgatatcaacgtttcatttcatttactttgaccaattgaagcacggagtagttacttacagaatctcaaacaacctattaaggctcggtgcggtacacggaacactaacccaatatcaataaatacagtaaaagcaactactttcaagcatctcgtagttgagcggtactgccatcaacagttccaacatggacaaga

SEQ ID NO: 5167 - DNA, 342 bp, Glycine max
ttttatggccaagaggtggcttgatatattgttggaggaagaaaggaaaagcaaccaagaaatgcaagaaccagaacagggtggttggttaacacgaagcacctcctggttgaagaatgtttctggaaatgtaatcgggtatattggaactaccgttggatctcccatgtcacccaaatctcccagagatgcatatcttgatcagcagctatgaggtgaaggtccaacacattgggactgtcatacttgtattttagaggaataatgtagatactatgtgctgctaagcaacaattctctgccactctctcttttggttctctgccccacccgaaatagcgt

SEQ ID NO: 5168 - DNA, 732 bp, Glycine max
taagtttctctgtatcagattttgattgctcctgtacagaatagataacatgtctacatcagatgtcaacaatcatcataaccatctttcaaacaatacatgttaatattatgttataacctcatatgctttcttaaactcatcaatgctcttcatttgcatttggtcagcctgtgatgcatagtcttcaagcttttttgattcttcaaatagcttatccacaaattcttgagagcgatcagagatatcttttatttgttcaagactgagattgaatctctttgatttacaatacacaacataacagagtcagaagaagataaagaatatcagtcataacaaagaaaaaataaatatacaggatgctgtccagaacagagaaacaaaagatgtgacaaatttgttaaaagctataaacaggtaaaaagaaggaaaacttcgaagcacatacactgcgtagtttccctgcaaatagttccagttcatcctgctgagttgaaagggttctctgaagatcgtcaaatattgaaccagcttcagtggcctcagatgcaagaaactgattcaccaagaataaaatttttattttagtggttagaagaataaaaaaaatgccaaagacataacagtaaaagtagaaataataatttgaaacagctgaaacatacttcctcaatagaatgaccattagaggatataactgatgatagttcctccaagttagcatcagag

SEQ ID NO: 5169 - DNA, 580 bp, Glycine max
tattcaagtttgcaatagttcagggagaattgctttgaatgcttcatatgttactattactgaagaaaccaacaacgaagaccacaaaatacttaaaatctcatagcatctattcccgaggtcatttgacacaagcatctaatatcaatattaacaaaatttctacaggacagttgtttgcatgtatcctctcatcctctgtaaataagtagacctacaaccaaaacacaagttactaaaaataacaataactcaataaggcattaaaaatttaagtcaattgtggctcttaatgcttacgacagggaaactaacctcaacattccgacggtgatatttgacagtcaattcaaaatttgatcaatcagtttggaataatcttcaacagctcaatatcaaacaagagagtcttgtctatcaacccctgattcctcaacacaaaatccaaggctcgttggccctgtaaaaatatatttggattgcatctttctcataatccattcagatagtggaagaacatagatattcacttcttaccgagaatgttgttggtcttgggccactcttattgaaatcattc

SEQ ID NO: 5170 - DNA, 548 bp, Glycine max
cgccgccgcaattgacgattcccccctccagagcttcggcgaggtcgactcgagccgcttccacgaccgcgccgcgagcctcggcgacgacttgttcgtcgatttggtgcgtcccgaggccgttcaggacctcagagaaatcatcgatcgcatggttaggtctggttatgagagagagtgtctacaggtttatagcagcgtccgtcgtgacgctttggatgagtgtttggttattctcggtgttgagaggttgagtattgaagaggttcagaaggttgagtggaggagtttggatgagaagatgaagaattgggttcaggctgttaaggttgttgttggagtgcttctcagtggtgagaagaggctctgtgatggtttgtttggcgatttggatgatctgaaggagataccttttgcagttgatagggctagagatttggtttgctatcaaaacatgggttaaggactactgctccttttactacaaggaggatgacactatcaagaaagatactgaacttcaatcttggtggaaggaaataagggag

SEQ ID NO: 5171 - DNA, 380 bp, Glycine max
gggcaaatcctgtagcatggagtttgtatggattggtggcttcacaatatggagatataaagcaaagcatggaatccagcgacgggagaacgacagtggaaggctttgtaagaagctactttggtttcaagcatgattttctgggagtggttgcagctgtgattgttgcattcccagtagtctttgcattggtctttgccatatcagtgaagatgttcaatttccaacggcgttaagatcgaacgtgttcaagtagtttgtacagggtgtttcatgtaatgtaacatgttgagagaagatatccacatagcttttttttattcttttatttaccaattaaattaaacttatcatagtcgaaatccactaggatctgtcaa

SEQ ID NO: 5172 - DNA, 325 bp, Glycine max
ttcctatcataggaaacatcttggaacttggcacaaatccacacatagcactcaccaaattctcaaagatttatggacctcttatgacttttaaacttggcagaataaccaccatagttatctcctctcctcaagtagccaaagaagtactacttgaaaatggtcaagtcctttctagcagaacaattccacattcagtccatgcacttgaccatcacatatactctactgtgtggctgccaccatcagctcaatggaggaaccttaggcgagtttgtgcaacaaaaatattctctccacaattgcttgactccactcaaatcct

SEQ ID NO: 5173 - DNA, 422 bp, Glycine max
  misc_feature (376)..(377): n is a, c, g, or t
  misc_feature (379)..(380): n is a, c, g, or t
  misc_feature (386)..(388): n is a, c, g, or t
  misc_feature (390)..(395): n is a, c, g, or t
  misc_feature (402)..(404): n is a, c, g, or t
acacatagtagaacaccaacaatggcacctgcacaattcaacctagctgaagcagaagacttcttgccctcaaactctcctgaactgggtgccggtgctggtgcctcggcctcaaaaggagcaccagaactcattggttgattggctcttggagtggggaaaaatgaggaaatatctggggcagtcacataaggcaaaacaccaggagaagctgaaattgtaggctcactagttgaacttgaactcacaccctttgaattggtaagcaagataaccaaaatggcaaggtaaaataataacttgatcatagtagcagccatgagtcactaaactctcagaattttggctaaacagaagggtgcagaatgaaaaaaanngnntggaannnannnnnngtcatannntgtaaggtaatctttggg

SEQ ID NO: 5174 - DNA, 412 bp, Glycine max
gttgttggtatatggagaatataattactaaactagacatcaacaatgcatgtttggaagagctgaaacttcacggccggaccggcaaatccgatggcgtcgtcccggtcgccggcgagcctgaggtacgccggacagttgacattaatatggtaaattccggaaacccaagttccgaccttccacttgactcttccgttgacttttacgttgaccagaattcctccggaggttttgtcctgctggaggatctggagcgtgaagggggagacggggacggcggtggcgtagaggtagggggaccagacggaggtgtcgcggtggccctggtaggtggcggggagggaggtggcgacggagacctgctggccgcggtaggcggcgtaggcgtcgagtttggtgtagtaaaaaa

SEQ ID NO: 5175 - DNA, 510 bp, Glycine max
accaggttcttttcttaacacaatcaaattacattttaatatgatctagttttttgtattatttcagagatatgaatgttctgtgagctcactatcaacctaggctaggataataatgttatatgctttcaaaatgtcatctatctgcagattattgtaaaagaaaaaggaatcttcaccaacgtgtcatcaccatcagccaaagccaaactgagactgttgtttgaggtagctcctttggggttcttgattgaaaaagctggaggttacagcagtgatggtcatcagtctgtgctagacaaagtcatcagtaacattgatgagagaactcaagttgcttatgggtccaagaatgagataatccggtttgaagaaaccctgtatggtaaatccaggctcaagggtggtgtagctgttggagcagctgcttaatctgttaaacctgcaattcattgtctatttttatctgcttttagaaaaagatatatgctatcttcagacaagtacctg

SEQ ID NO: 5176 - DNA, 601 bp, Glycine max
ctttgctcaactgtgtgtgtaatttcaaattgttcccttctctgcaaatatttaatcttttaattgttttactccataatttcatttagctaaaactatcactttttccattcaaaccatggacttgtccttgggaaacattaaaaaaagcacacttttttttgtgcttagtactttgtttaagtttttaattcgttaatgtccttgaaatacagagtgtggtgatttatttacttaactttgttttagagcaaggtcgtattttgttagaagatgaaacgcaagcgtgggcataagaaagggaaggcaaaaggcaccactaaccatggaagcagtagtgctaatgctaattctaaggaagaagaaacctctgggttggatgataaagatcactctggaatggaagttgacacaccttcttcgacggggacggatcagcagcataattacaatgttgccaacataaatcctgatggttctgttgataaggctgctattgggcgtgttaaggtgaagctcaagacacctaaattactggactcccaacccacctcatctgatgctcccactcccacacaaagcgatactgagagaatggaaa

SEQ ID NO: 5177 - DNA, 404 bp, Glycine max
tgcaattgcaaccatgtgttggattttcttaggtatcttgaccagtttgggaagaccaaggttcaccttcaagggtgcatgttctatggccagccagaacctccagcaccttgcacatgcccccttagacaagcttgggggagccttgatgctctcatagggaggctcagggctgcttatgaggaaaatggtgggtccccagagactaacccttttgcaagtggctccatcagggtgtatctcaaagagattagggagtgccaagccaaggcaagaggtatcccttacaagaagaaaaagaaggcctcaaatccaagcaagggaaacgatgaatcatcctccaccatgcacttctcttgaacaacatcatcagtatcgatctctttggacctttcaagtcatga

SEQ ID NO: 5178 - DNA, 298 bp, Glycine max
accgcactaacccacgcctggcatcctttactgagtagagtcctaaattgttcatcaaaatttccagtgtagtatgcaagaaacaaggcttcagcatacaaattgtgctgttgaatcccagtttataattaatcatttagcccaaatgattgtatttttatgtttttagtagctaattgtataatttgagtgtgatagatttgtaggacaacatgttagttgttgggaaaaattacccaaattttctttgaatcagattttgtaaaaggctaaataaatgttgaataacaacaaacac

SEQ ID NO: 5179 - DNA, 510 bp, Glycine max
tgtagaggaattatagatgaagataattttgggaggggttctccatatcatcagtatcaatatgagcaggatgctgattttgttcatataaagatgttgcgtaataatacctttgttactgtaacagattctcaaggaaatataaaactcagtggctctgccggtccattgaaagacctgaaatcagggcaaaagctttctaggtatgctgccgaggcaaccgcggaagttgttggccgaaaggctaggggcttgggattgaaatctgttgtcatgaaagtgaatggatttactcattttaggagaaaaaggaatgcaataatgagctggaaggagggctttactgctggttctagaatgtgtaaatccattcactttcatgacaacagatttcaatcccaagcccctagcctttcggccaacaacttccgcggttgcctcggctgcatacctagaaagcttttgccctgatttcaggtctttcaatggaccggcagagccactgagttt

SEQ ID NO: 5180 - DNA, 663 bp, Glycine max
tcttggtcttggtagtatatcaagtctttaaattactatttgcaagaacgaattacttattacatcatttataaaccttctatatgtattttcagtaattcactcatgaaagtgaattctgatgttcctagaaaaattattaggtagttgaacattattaattatggtctcaaatcgaatattattaattatttttttataaattagaaaacttgcatacgtgtcatcaaatctaataatttctccttatttagagatatattctaagaaaaacttgttttaattttattatttcagcaccaagagccatggcaaaatgcaagaacaggagctagactagtcgcacaattcatgacctgccccatcctttgtaattgtggtgcccagttggcttagtaactaaagtaaggataagctgcagcagacacggatggacattgcagggtgttgaattatagttaatttgtgtatcattatggtttgttataatatttcaaacaaaacaatgagatgcatgtctaattaagtactaattatgaacaggaacataatgactctcaatcatgttgttagacttggctttcttatatatctttgcttgttctgtgtgagtgcttgcttaataataattttaagatgtgtttgtctgttgtagttgtagcg

SEQ ID NO: 5181 - DNA, 883 bp, Glycine max
atgtttattaaacttctattttcaatcataccattcaagagtatgcttctagtgaaacagtcagagcaataactggtgagttattttcctatcgtgcagtgttaaatacttgttatttttattctgaactactacggtatatcttatcttcacttttcctcatatagaatggtgtatttgttacttttcacatggtaatttctgatgctggttttcttgttacacgtgacttttaatacatcttttggaaaaacagcaaagctgattttttttggttgattattggtcatgaaaccaaaaattaggggaaggaacaaatgaatagtaaaacttgtggcctgtacacttaattgcttcataagttgaacagattgactcttatttgtgctatataacctcttctagctaaaataggcacctagtcttctgtaaatattcattaatgtatctgaaaaagtataggttgaatttaaaagtattgtctgtagataaaggtgctatttctaatctgaattcattggtgagcaatgttgattctgtgtctaacaataagttgcttcaccttgataacctctctctagagtctagagtatgtaaatatagcctaacatttttttttgggttcttttagctgctattgaaaaggacttatgggctactggatctgtgaacgatgagtatcttaaagccttaaattctctatttagcaacttcccaagactgagagcaactgaaccagcaacacttagcattccccatttggttacgtccttaaagacaggctctgaggctactcaggaagctgccttggatgcacttttcctgcttaggcaagcttggtcagcatgtccagcagaagttcaagagctcagtcaatagcagc

SEQ ID NO: 5182 - DNA, 610 bp, Glycine max
atctctatttcgccgcacgctctttcccattcaactctcaacgccgcccctaaacgcaccgtttcgtccaccactttctcactgacgctcactaacggaacctgcaaaaccagacacgttgccgccaaatcatccgaagccgacaccggaaacacttccacctcgctaacccaaaccgtgagtctccctctctctctctccacgtctcactccttctcaggtttggttaagtttctctataagcactccttctaaagtgtttctaaagaagattacccaaacaggccattatattctctaattttgtcgtatcattaatcgatgtggaatctccaacaccttcgttctacaaccgtatgagtgtctctgttttctttttcaggtgtttggggtgcttcatttggcggtgtccctgggcctcattctcgcggtggacaagtttctgaagcaagcgtttgtggctgccgcgatcaagttcccgagcgcgttgtttgggatgttctgcatattctcggttctgattatcctcgactccaccgtgcccgccgccgccacggcgttcgtgagcttcttcgagcccgcgtttatgttcatacagagatggctccct

SEQ ID NO: 5183 - DNA, 340 bp, Glycine max
ggcagagagcaatggcatcaggctcttctgccaagacatatgtaacccttgcaacaatcttaacaagcccttcaagaaatggtgtcatgaagcgagtgcctcggatctctccctgcctgatggcaatcaccctggatatgaccatcacaaaggcaccttcatctagtagctgccttgtgaggcccaagtccctttcaggaagatccgctaaaaggccaacggccgctgcctgctcttcagtgattcctgtattttctgatatgactttaatgagactaccaagctgtccaactgagccgcgtagtgcatcagctagttcctgacccatatgaggagacaa

SEQ ID NO: 5184 - DNA, 529 bp, Glycine max
gctacttgactggattataggttcatattagcttgcagcttgaagctatgtctgcatatgctcatcaaatggagcagcagtactctgcacctagtctctcggatgattctggtatgtaatgctaattttctcaccctttaactaagaattattagaaaataaataaaagtactatgatctattgtagagcctacccctaaatagtttaatgtttagagttcagtaattattccatgtacttacctttatgcaattatcatattcatcaatggattaacttgtaaaaagtagtgttttagggatcacaactttgtactccccctccaatgacaacaaaagccttatcccgcttgctgaagtcagttacatggatcacatggtgtcattcaacttagttaaagactgagtgatccatgttaagtatattaatgaattttacgttagctggcgagaatctagcacaaacctcctcttcttttacccgggcttgggaccaactttgttctccccctccaagaaccaaaaaaaa

SEQ ID NO: 5185 - DNA, 404 bp, Glycine max
cccgatcaggaatcaccatcataatggagaaggcaaccatagaagatggcactgtcatataaatggatagggctcatttctgggctgattacccaaatgcgctggaagaggaatgctcccatctttggacagaagggtagctgtttgcaatgctgtgttacaatgcagaaagcagcagaacaccccatgtgctatatgatatgtaaaatagtagctcccccccaccaatacatgtaaaaatagaatgaataaaaccacgaaaatcaagatgcatgagagtatataaattgaagggctgagcccgaggtagctagctacaaagttgcttgaaccccttgtaaaagacactttctaaattatttgtatcgctaaggtatcagtgtatggctaaatgggattcgttg

SEQ ID NO: 5186 - DNA, 371 bp, Glycine max
ctttgaatagggttaggggatccggggggcgatttctcagcaccaaacagcttgcacagtctaatgcagaatttgtcactggtgcacattctggttctgaccctaccaacagatatcaaaaggaacatctatcagaggtggaaagtcattcctcaaaagatggagataattcatctttcatcacaacctgctccgaccggccatgtttatctggcaacaatgtcaattttcggcagcaggagtgcatgtttctggggaattctgcaaacatgggtggatcaccacagttcagtgggggactcacctttggcggagcaaagcagcgcacatcagttgtccggtgagagaagaaactgatcgaaaccgactta

SEQ ID NO: 5187 - DNA, 692 bp, Glycine max
  misc_feature (614)..(615): n is a, c, g, or t
  misc_feature (626)..(633): n is a, c, g, or t
  misc_feature (636)..(636): n is a, c, g, or t
  misc_feature (662)..(668): n is a, c, g, or t
  misc_feature (673)..(674): n is a, c, g, or t
  misc_feature (676)..(677): n is a, c, g, or t
  misc_feature (683)..(683): n is a, c, g, or t
tacgtgcactgcctcttcttcccctgctttgatttccgggtcaccctcccattttcggtgatcccgattttgatttaattttcctctgatttcgagaatttttccttttttgtttttttgttttttgcacctgaattgttcgtggttgtgaatgttgattttgactcgtgtcgtttatcaggtggcatgtgtggtggggctttgaatttggatttaattagggaaaccctttttctgtttttcccctgttatttccccatggccttcactctcagattgggggtcccctttttctttttctttttcgttttccttttcggtttccgagagattgaaatggtggtggcttagcaattgctttgtatttatgttagtcttaggaatggagtttgtttgaggtgtatttatgctttacatacatacatatagtgtggtggtcagaaaggagggtagaggaagaaggaatattctgtgaggatgacagattttcagccgttacagcagaagcctgagcctgctgatgcccatgccgagtttgagcttggactggaggagtttatgcgtgggcacttggatgattgtatgtcgtttgcttcgtgtagctcgtcccgtgnnccggatgatgnnnnnnnncgngggtgatcagctggttcggaggaaannnnnnnctganncnngaaggngatgaattt

SEQ ID NO: 5188 - DNA, 385 bp, Glycine max
tgactctgcttttttccttaaaaagcccgaaacctctttgcaaccaacaattccttggttaaaatcaaaactctgtttggtctcaaacactaaacacgtatactttctctcactctctcttccttaacggttacgaaagtgaaacaaaaatggtggcatcagacggtggcggtggagggagattgatgaagaaagttctgggcttggggttttgggtacaaggattcaggtgttttccatggttggtagtgagtttctacctcaaagatggtctgaatgtggacccttccactcttcaaattcttcagagttccgctaatcttcccatggttggaaaaccactctatggccttctttcagactctgtctacatctctggccagag

SEQ ID NO: 5189 - DNA, 767 bp, Glycine max
  misc_feature (763)..(763): n is a, c, g, or t
ggtctctatatgagtacatggctaatggaaacttacatgaacatctgtctggttagttcccaaatgaattcaatttcttgttaaaaaatttgtgcaaatcaatttacaaactagttttatattttgaaactctggatacagaaatattctagtcgatcaaaaattgaaaatcaaaatcacatataaacaatcattgcatagaaagttacagaacttgttcctgcaggtaaacacatcaaatcaaaattcctgacctgggaagacagacttcgtatagcagtggatgcagccttaggtgaggaagtaaacttaaaattatgtgttttgttaactccccttttttcctctcaaattctcaatatgttttcaataaatcaaatatcaggattggagtaccttcaaactggttgcaagcctcctataatccacagagacgtaaaatctacaaacatcttgttggatgaaaagttacaagcaaagttatctgattttggtctatccaaaattatcccaattgatgggggaactcatgtgtcaactgttgttgctggtactccaggttatctagatcctgagtaagcacttaaattattgtcctatccatcattttcccggaaattatagtgattgtttatatgtggatatttgaaatttgaattattatcaccacaaactcttgcaaaaaataaatggggttacttaatttgtcttgcaggtactacatatccaatagattaacacagaaaagtgacatttatggctntgga

SEQ ID NO: 5190 - DNA, 528 bp, Glycine max
actattttattttattcaaccttggagcgagtgtttatagccattgcttggaatgctaccgcattgccgttctaatcatactatttattcataggctggttttgctgatccaaacttgccagtcgcgatagttcgtcctgcagattttgaggatgcagctaagcaagcatgccaaacaaaacttgagaatgccaaatccacttttcctcgtgttgatgaggggaaccttccctatctttgcatggatcttatataccagtatacactactcgttgatgggtttggtaggtttaatttcaatgttggaatagctataatgatgtttctacaaagtctgagttatggtgttatcttcctgcactcattgcttcaatttgttggcaggtatatatccatggcaagagattacattggtgaagaaagttaaatacgacgatgccctggttgaggcagcatggcccctaggcagcgccattgaagctgtgtcatctgcgtaaaattactgggactatcgcttagatttgtctg

SEQ ID NO: 5191 - DNA, 407 bp, Glycine max
agaaaatagagaatctaattcatcatactctttctcatcacatactggctcggatgcttgtggcccatttcattggaaaggttctctagaaatcaagataatgttaagcaaatcaaagagcgagattctgtttgctggagcagagggagatttgtggattttctagttagcttcttcacagagaacctcttggatctattctaaaccttatgaatggcaagttatcgttgggaagcattgataacttgtgcacaagtgtgaagaatctcaacccatcatggttcatcgggtcatgaaacaaatcctttctgattaatccaagggtcgctcctaaatttggttgtaagatcaatccactaaatgttttacaagaagacgacgctcctaagtattggtgtggcactgta

SEQ ID NO: 5192 - DNA, 197 bp, Glycine max
aaaaggaaaaattatcaatacttcttgaatgaatgaaattatttctatgccatcgtttcaattattttgttcaatgggaacaagagaaatacaaactcaaatggacgaagtatgttctgttcagttagaacataacagaaaagaaaaaaagggtggaaaaataacagaaacaataaatactcttcagagaaaaaaaa

SEQ ID NO: 5193 - DNA, 583 bp, Glycine max
atgtagatgccacttttgtttctctgtatgtaattttttaaagagcatatgattgcatcagtatattcagttttcatataatgacaacattctcgaattaaaacttctggtcagattgcctcaactccaatgcctgaaacctacaaaaacaagatggtaagtatcaagtctcagctctaaagccttagtactaggaattgtgagacataactaactgaatatttgtatgaaccaggtgtggatactttgcaatgattgtggagtaaactctcatgtacaattccatattgtggcccataagtgcttaagttgcaactcatacaacacaagacagatacaaggagtacctgccacatcaagctcttctagggtaactgaaatggtgagatgaacatttgattgcaaaaaggtctcttggaatggaaactgttagactattgatgtgatagagaaattagttgcaagttgttataatttaaatttcaatagaaacagctcttgttgaacagagttactctgttatgacactaaaattaaactctagttatcaaacttagatattaggaggataaacttggtttta

SEQ ID NO: 5194 - DNA, 379 bp, Glycine max
gatactgtttttgttgctttctcatgccttcacagtcataatcttttgagcatgaaaactcagtgaattcaataaacatagtaataattcagcggtaaccatttcccaccatgtaatgagtttaatttgtccatcacaaaacaatagtcttttgctaacactaggaactgtcgaccttttgcataaatttgcacagcttcaaatgtgatctctttactgggtaatatattttcagcatgggcagtgtggcacaatgtgtttctatacataatatatgatccaccaaattgcatggtgtggcatattcaggggtgatatatccaattgcttgatatgtgagtggtttgatgttgcatatgagctggcatatcaacagtga

SEQ ID NO: 5195 - DNA, 383 bp, Glycine max
tcaaagattaaaattttcagcaaaaatttccaggtttgtacttttttaaaaactttgtttcctctctaatctcgtgcaatcttgttctgtgtgtaatgaaccaacaagttcttgctatttcttaaaaggaaaagtttaacaagatgctgccattcttgtaccgtgttagactgttaggcatcccacagttgcagaagttatgagaggggaaaaaaggataataatgagggggaaggatcagaaagaggaactaggctgtaatgaccttgcttatgtggcaaggggtgtgggaagggaatgtgggggagcaaggatgaaagttagaagaggatgcaacgataaaagttagaagaggatcatagtggattcattcagtcgtggaa

SEQ ID NO: 5196 - DNA, 361 bp, Glycine max
tgaaacattcgttattcaaggaatgaatgagggaggccaaattcttaattatctttattgttttctttcttagcgttctttctagttttctagaactcccgttacttatttttaatttattattattatatttatatttatgtgtcgtgtattgtggttaagtggttgttgtgtgttatggcctagatgaatttagctttagtacacgaaaaatcagaagccatggtttaatttatatattatgtggtttggactttggagatgtaattgtgaagcttatttgaatttttcgctttgtttcgtaaagtattgcttgttgcacgtaaagaaggtacgaatggaggagaagacaaaggagtga

SEQ ID NO: 5197 - DNA, 389 bp, Glycine max
acttgtcatgattctctctttgtatggaacccaatatggggtgcagagtggtggttatgtgaaatctgacatgggttttgatgattaccctttttccaagcttcagaaccttgtgatggttgctgggcattccatttacactagcagtagttgtggaaaaattgagaaggaggattcttggtttttggagtcttatcagaagaatcctggccaagctgccacttttgtgacacacattcatgaagggattgaggttgtggcaagggatgactctgctttgctgctcttcagtgggggagagactcggagagacgccggaccccgcagcgaggctcagagttactgggctgttgcggattccaaagggtggtttggtaaggaagaaagtg

SEQ ID NO: 5198 - DNA, 888 bp, Glycine max
  misc_feature (829)..(832): n is a, c, g, or t
agagccagaggaggtttggactgtgcaatgggatcagttttgcaagcttttcaccagcagtggcagacccttcaagatcctcagaggagagggtatatgaggtggtgttgaagcaagcagcactggtcaaggagaagaataagggcaccaagagagcactgaatttagacaaaccaacagttgaaggtgatttaacccatggggatctgttgagtgctgcttatgataggtgtggtgaagtctgtgctgaatatgccaagacattttatcttggtactctctctctgtcctgttttggtcctttttgtttttcttaatcattttcccttgttccaatgagtttttgtgcatttttttaaagttcattataatatcagtttcatattaagaaaattcagtcattgactaactgttgtgaagaagtaacccccttcatggttcaaattttaagcttctctcatccttcttggttgattctagaggaatattcacttaagagagggatctctataattcacttttgccaattgtactatgccttcactttgttgcaaaatgtttactataattgaaatggtttatttattcccaaggcagcgtggatcaacagtccattcaatgatttcaaattttggtcactattctttgttggtctatttaatgtttcttagtatatgttgttgttgtcaatttgattggttaattgtgaactgcaaatctcaggcacacaattgatgacccaagagcgcagaaaagccatctgggccatatacggtatgtgtgcttatcctaattggcattctacaaaagcttatccaatgaggcttgnnnncatttttatttattttgaaattgactacactttgtgcatgcagtgtggtgcagaag

SEQ ID NO: 5199 - DNA, 309 bp, Glycine max
  misc_feature (142)..(142): n is a, c, g, or t
  misc_feature (145)..(145): n is a, c, g, or t
aacggtggctttgtcctcgttggcgagtctgcgaatgacggggtcgtcggtggtggtgactttgaagaagttccgattcttgaagcgttcgaggcggcgttcgtttttgggagtgatccgatcgtaggtgcggtcgtaatantcnagggcgccgcagaggaggaggtcttcgggttcgggaacggtgaaggagagcttggagaaggtgctgaaggggatctggtcgtgcatgttccattcgggttggatatccacggaggatttgaagacggcggcttcgcggcgctgttggttagggtttgagcggtt

SEQ ID NO: 5200 - DNA, 870 bp, Glycine max
gtgctcctccgaaaccgaaataaaaccgttcccatcgtgcgaacaagttcaatcgattccaaagtctaaaactgtgaacgttctttattgtgaactagactctgataaccgaagaaaaggacatggcctcaagaacagttgcaaaagacataatcactcttcgcggttccgctgcaattgttagcgagttcttcggtattcacatccctcttctctttttcctgtctcgtttttctccgatttctttcattttcgcatatttgtgtattttcttatgaacttttgcctgatttttgtttactggtgatttttcaaatcaggatatgctgctaacaggtttgatccttgtgtcctgcattttttaaattttttttattttgggccttatttttcgcattgcaattatgtatgtggccggaaaaattgtgatatttataagtatttgaatttgggaatttgatcagcattctttacaaccgtggagtttatccagaagaaagctttgtgaaggttaagaaatatggcctccccatgttgcttactgaagatgagggtgtcaaaacttttttagccaatctaactgctcagctctctggtaactagcacccctaatttgtttcttctgttgtggttctcttttcatatcttagaagctgtagagaaaaatgtcaatttcattgtttacttgggaattattgttttggattaatctattcatagtataaaagttcattttaagaaattgttttgaattcgtatcgttttttagatttccttgtttattgtaatgctttagttagtagcagttcagttggtgtatcattgttgatcattgcttttgaattttgaaaagaatggcttgaagctggc

SEQ ID NO: 5201 - DNA, 1344 bp, Glycine max
  misc_feature (1282)..(1288): n is a, c, g, or t
tgctttctatcgtggtgctgattgttgtgttcttgtatatgatgttaattcgatgaaatcatttgacaaccttaataactggagggaggaatttctgattcaagtatgcttttattcctttctgtataattttttctcagttttatctattatctcaagctatgttgtacagattttacaacttttaagatttgtgatcactttggcaggcaagtccttctgatccagagaattttccttttgttgtcataggaaacaaaatagatattgatggtgggaacagcagagtggtatttaccctcccttaagtttgctatcatcaatgtttcttttctctttttccaaaacttgcccagatcaggcacactcgtactcataaaacacctaaacacatactgctaaacatatgaacactaccaagttcttgtgtgcaggtgtcagaaaagaaggctcgggcttggtgtgcatcaaaaggaaatattccatattttgagacatctgccaaagaaggtcttaatgttgaagaagcattccaatgcatagcaaagaatgccctgaaaagtggagaagaagaagaattgtaagttcttaaatctgggcatctctttcatatatgtgaactgaccaactgaactcactaagacataaatacaataagctacatctctcagatttatgagattgcgttcattggttgagggagtgtagtttggttttgtcagagttctaattcataattttcatgttatctcttgaaatctgaagatctatctatgatttgcttattgagacaaaccatttgcttgctataacaaaaaaacaggattatgggcatacattatttattgcaagctgatattgtttgttaagtgcattttccgggttttttttttatgaattgtatctgttggagattttggttctcatctaacagctttctccaacttcatagatactccaatagtccaatgtaattgtacttttacaaatatagagtactaaaactaaaatgggacatttttgttaataaccttgaaagagcaccggtaaagttgcatatgcaagggtaagactatgtacaatacaatggccctcccccataatagcactacttactatgacacaatttcaacagctttcaagaattagtattggagatgttagtttgtctggtgtatttcgattgtggtatttctcgatggttacccagagattatggatattatttatttggaacttaaattgtccattccttggctattgatattactttttgggtttnnnnnnncatgtggtaatttgtgctttattgaagatacctgccagacacaatgatgtgaaaca

SEQ ID NO: 5202 - DNA, 852 bp, Glycine max
tcatcacaaagggtagctgctagtggttaaattgttctcacattaattgacaatgtctagcataagatctcgttctagacaatccggtgcttccgctgagatcacagatgctcaaatcaccgatctcgtttcgaagttacaacaacttatccctgagcttcgtgctaggcgctccgacaaggtaattcattaaccttgctctctctctctctctctctctctctctcacatgcacacaccataattcacacacacacacatacattgcacattttgagtggatgcccttcattttggtagataggtcacgttagcagctaactattgctcgtgcctcctctcccttgttttctttagccacaacttgaggctatagtgtgggattcatcagattcttcccctcttgctcccattgactaaattaactgcattacttaattattatcaactagcttcaagtgcgtgctaaaataatgacagtaataataaaataattcaattataatttactaacagtatagatatttaaataattgacactatatattatccaatcacacaggatatgatacaagataagtttatcaaattttataataattaattcgaattcatatctaaaatgaattctgattaattgacagtagtgtaaacatctttatgctggttgtgcatgaataataataaataatgaagtttaattgctcataatgattttttggtgatgtttgtgactattgtaggtttcatctgctaaggtattgcaggagacatgcaactacataaagaacttgcacagagaggttgatgatctaagtgaccgattatcggagctttggctaacacacactc

SEQ ID NO: 5203 - DNA, 400 bp, Glycine max
tttttgaatcttaaataagagaacagcccaaaacctttcaaaatacacatgctgcaaattgctcacccaatcaccagccatgggagaggttgacgcagcattcatccaagacccaccacacaggccaaagctctccaccatccaagccgaaggaattcccataattgatctctctccaataaccaaccacagagtttcagacccttctgctattgaaggcttagtgaaggagataggtagtgcatgcaacgagtggggtttcttccaagtaacaaaccatggagtgcccctcactctaaggcaaaacattgagaaagcctcaaaattgttctttgcacagagtgcggaggaaaagagaaaggttagcagaaatgagagctctccagcgggttattatgac

SEQ ID NO: 5204 - DNA, 380 bp, Glycine max
tgatacattaagagttcttggttcagaccctgttgattatctggtgacaccaagagtgttagccacttgtattgcgttaccccttttgaccctgttgtgttttacattagggatggcatctagtgcccttcttgctgatggtgtttatggggtgagcatcaacattatcttggattcagctcagcgagctctcagatcatgggatattattagtgcaatgatcaagtcacaggtttttggtgctatcatatctattgtgagttgtgcatggggagtaacaactttgggaggtgctaaaggtgttggagaatcaacaacgtcagctgtggttatttctcttgtcggcgtgttcattgctgattttgctctttcttatgttt

SEQ ID NO: 5205 - DNA, 380 bp, Glycine max
tgtctttgtttaaggattctctaatgttgtcacaaatggacatggaggagcttgtctcatgtaacaacaacgatgccaccaacatagccaaaggcaagcgcacaaagcggcgcttgaggcctttgtctccttgtgccgtcgttcctaccaccaccaccatcaccactgtcactgccgctaccacccccatcatgacatctagctgttcaagtgcttcttgtggcggtggttcttcttcatccacaacctttgaggaggaagaggaagacatggctaattgtttgattctcctagcacaaggaaaagtaggaggggaccctcctcatcgtcacaaggacttatatggtagtgatgttaagacagagaagctgggtagcaca

SEQ ID NO: 5206 - DNA, 530 bp, Glycine max
ttggtgttgctcctgatccagccaagcctgaagaaataccatctgtatgcaggtaagagtttaattttgataaactatccgtctaaagatttttacaatgttgattgttaactaattagaaatcattgtttgagttattgtcagaggctaaatattccagttacgggtcatgactagttttattatttatccatgcatgatgagttgattacgtttttgcagggacattgtgattgaatattcaaagaaaataagggatttgggttttacaatgtttgagttattgtcagaggctttgggacttaatccttcttaccttaaagaattgaattgtgctgagggactctttattttgggtcactactatccagcatgccctgaacctgaattaactatgggcactaccaagcacacagatagtaacttcatgactttacttttacaagaccaacttggtggtcttcaagttcttcatcagaatcaatgggtcaatgttcctcctgtacatggagctctggttgtaaacatag

SEQ ID NO: 5207 - DNA, 459 bp, Glycine max
  misc_feature (404)..(408): n is a, c, g, or t
gtctgggttgaattattaggagcagcaaaacttgaggatatcccactactgtcacccttaccagcagaactatcgacagtcggcattttacccttcttaccatgaccattaggagcttctgatgaaagtggagccttattttcacaagtgaactgagctaaaaagggatcaaaaggaggggcattgagatcaatagtggcaactcctgcctccacctgttgagtggcattggaagccgagtctgcagatgggatctgttgacctcttgcttcagaagtgataggttcttcaggaacaccattttttgcgaatggaccagttgcaacatgaggctggcaatgagaatttagaatagattgtcccagtagggaaactaaatcagtgagattaacaggcagctgatnnnnnagtggttcaggcactagggaaattaaatcagtgagattaacaggcagctga

SEQ ID NO: 5208 - DNA, 352 bp, Glycine max
agacaaaatggatcaccatttcacttcagaaacctctctcattattcttctcctcatcacatccctctcctcccttgccaccgccaccaacatcaatatcctccaccacgacctccaatccgacatcaccgaattctgcaagaaaaccaccaaccccgccctctgtgccgagaccatccatccccacttcctcaagaacagaatcgagcccttcaaggcgctcgacatagaagtggacgccaccctggcgaaggcaaaaaaaaccctagccaacattcaaaccctagaatccaaaacgggcaccaccaaatcgtccaaggactcgttcgacatttgcaaggaccagtacaag

SEQ ID NO: 5209 - DNA, 383 bp, Glycine max
gattcgggtccacgccggcccggtaccttacatttgccaacaacagactctccgggtcactcccgaagagtctcggctacgcgccgagtctcaccgaggtgctcttcttggggaaccatttcgaagggtgtctgcccttcgaaataggttacctcaagaaggtcgtcgtgtttgacgtaagcaaaaatctcttgaccggccctatcccgctctccttcggatgcttgaagagcattcagtttcttaatttggcgcaaaacaagctctacggttgtgttccggacaacctttgtcaaattccttctatccggaacaatgggaatctctctttggcggataattatttcaaggaaattggaccttcgtgttggagtttgatcaag

SEQ ID NO: 5210 - DNA, 903 bp, Glycine max
agtatctaatgcacagaacaagttgcagacttctgtgcggagtactgctaagattgaactcccagttgttgaacctccatctgatttaaagagaactatagagaagatagttgagttcatcttaaaaaatggaaaacaatttgaggctgttcttgcagaacaggatcgacctcatggaaggttcccgtttcttctgccatctaatcaataccatacttactatctgaaagttcttcaaactgctgaagaggtgtgtttctcagaatcattaaaattgacttatttttaattttcaatttatgtgattcaaactgttcctcgagaagtgagaaattagttgcacttgcacttttctaccttgtaggatgtaatccatgtcactctaagattgaatgccttctaccctactcttccctcccctctagagcaaaaaacataatttaattgactgatatcatctgtaaacttatctgcagtaccctaatgttggttattctcattagtccttggtcatgtttgtatttctgtctgttatgcatatttgtatgcatttgacatgtatgctttgtatagctataatgccttgccatgtagttgtgataaattatgaatttttgaagcagtcatggtttttcatttcatctttgcctttcaaagatttcccttctgcatggaattcaaattttgataattattttatttgggttctggagggattttgtgcaccttgtgtattccatggattatttgggactgatgaaggtattgttaattttgactttgagatgctacttactgatcttcctaattgtttacagtttaagttactaggcaagggccaccagaagcacaatccagcaggtcatacaggtgacaataatactcctgtaaatgatgatagtg

SEQ ID NO: 5211 - DNA, 377 bp, Glycine max
cagggagaatgtgaagtgaagttggttgggagtccactaacacatgaaaggtttcttcggaggaacagaggaacatatgggccagccgtgcaagctggttcagatgcctttcctggacattcaactcccattgcacagctttattgttgcggagactccacctttcctggcattggagtcccagcagttgctgccagtggtgcaattgtagcaaattcattagtctcggtatctcaacattccaagctgctcgatgcaattggcatataaaaccaaggtttcatcttcatgtccccacgttttcacactggaaaagattgaatcttttctacttctcgtgcaaaaactacatcttggtcaataacttatgtggggaa

SEQ ID NO: 5212 - DNA, 397 bp, Glycine max
cagatgggaaaaatgaaccaacaaattgggaggattcagagacaaccaatgcaacacatgttgatggcaggggacaaccaagaatgactgtttgggagaatgagcagagatcaaattacagaaagaatgaggagagggatttgaggacaagtactcgtggtgaagtttcttctcagtcttcagaaaatcaagtatctagttcttctgtgatgaaggcaaaatttcccgaaagttcaggaaacataaaaaaatctgatgatatttcagcaaggaaattggatggtgttgcctctgatatgctagaaatctcctcaaaaccatctgcttcaaaagatgccaccctgattcaaaagatagagggtttaaatgcaaaagccagggataattcatctgctag

SEQ ID NO: 5213 - DNA, 389 bp, Glycine max
aacgttatccttctcaacaacaagaacatgatactggcgaaaacagaaggcttagaacatcacatgtcagatgaaaatctcttccttctgaaccgacaactgaagtgaaaacatcaaattcaaaggggcatgcacgaacaatttccttagaatcaggaattcgcgggggttcatggcgtgtgcatccaaatctacccgattatgatgatttgagagcctgtcttttaggcaaagtgggttttaataaagaaaaatgcacgcattagtatctttagatatctcccaggatattccctggatgagagcatctttagatactatcaaaggaactgatatctcttatattagtagttaaacaggattgcacatccttctcttacctttggacg

SEQ ID NO: 5214 - DNA, 360 bp, Glycine max
  misc_feature (306)..(308): n is a, c, g, or t
  misc_feature (310)..(312): n is a, c, g, or t
  misc_feature (318)..(318): n is a, c, g, or t
  misc_feature (322)..(324): n is a, c, g, or t
  misc_feature (334)..(338): n is a, c, g, or t
  misc_feature (342)..(343): n is a, c, g, or t
  misc_feature (347)..(348): n is a, c, g, or t
  misc_feature (354)..(354): n is a, c, g, or t
cttgttagcaacggtctaagcctcagattgaagcattatattaattataatatatatgttaactgagattaccggtatctttctttgctatggatgcgccgttatgcagcatgtgtatttcacaaggaactctctctctccctctccctctccctcatgattcttctttggcttattatggtagtttaaaaataaaacattagcttgatatggtagtttatttgtgtaatgtatgtatgtgatggttaagttggtgtcatgtattgatgcacttcttttatcagaaagtaacccgatcttagccannncnnncatacnttannnaaataaactnnnnnatcnngctnntgtttnattttt

SEQ ID NO: 5215 - DNA, 508 bp, Glycine max
atctgtggccataccactggctttggctgcaacatcaatttacatgattgtaagtttaattgtgatatgattttttcacatcagattgaaattatcaatgtctccagctctccatttgtttatagtcatatttcatatacactgttttatgcattttgtccagggacgagggatctataatatgtcgcatggaattggaaagaaagaatgacctggaaatttctgattgaggaggtttttccacacatagcctccttaatatggactagtggttttctttgcatttatgtttgttctcttaataaaattgcttagttgcagattttgactgccattgggggtttataacttgaatgaaagttgttctttgtatgtttgatataatcaaattgagtgaattgcctcaaactgctggtttcagtttctggtttagtacttgtttcatgttagctgttccttttagatgatacttctccttgccttccgtgcgctagataagctcaactgt

SEQ ID NO: 5216 - DNA, 636 bp, Glycine max
catcccttcaaatgaaaatatcgaaactttgcaattaatcaagaatcactggtgtagcattatgagcatgcaaagagagaaaatggcgaagaaatccattggaagcttaatgcgaaagaagctttctgatatcaccaacaacaccaatcctcctctctctcaacaacaacttgacactactcttccctccgataacaatttcattcaacaactcctcaaggtaaatttattaatttatttactttttattctttattctctatttattttttaaatgtttttggttgaattgtgatctatgaagcacggacactctatttgttcaaagtgtctctgacaccaacacatcccgtcacttatttcgacatgtcttattagatgtctaatttaaaaattattgtgatgcaggaaagaacagcgttgattcaactccttgcggaaagaaagtaaataaatgttattaactaaaatgaaaggaattaactgaaatgttattaatttttctttgaattgattgaaaattgagcagtaaaataattgaagcgagtggggtggagctgcggaggctgagagcagatgtgacgaagctgcaaatccaaaactggaaccttgctcagtccaatagccacatgttag

SEQ ID NO: 5217 - DNA, 382 bp, Glycine max
atcctctgatggttctaatttaatgtctatttacaaagatgcttgttttgaaggttggcgctgatggaggaaaatcacatgttagggagttagcaggaatcaaaacaactggatggaattactcccagaatgcaataatctgcacggtggagcatacttatgaaaatgaatgtgcatggcaacgttttctaccaacaggtccaattgctcttttacccatgggtgataagtttagcaatattgtttggaccatgagcccaacagagtcaaataaccgcaagtcaattaccgaggaagaatttttaaaggatgtgaattatgctttagattatggacatggacctcatcctacatcaagcttatcaggaactcgagacgtgtt

SEQ ID NO: 5218 - DNA, 466 bp, Glycine max
  misc_feature (61)..(63): n is a, c, g, or t
  misc_feature (67)..(67): n is a, c, g, or t
cgcttctgcagctgagttaaacaagggaaatggagggaagagttttaaagcagttatatannncttnaaataatctgtttgaagtaccaggttaagattgcatgtgacacggctaattccttgtgttaaaatgagtgcaacaaatatatctgaactatgaactagacatactatctaaagagattttcatatattcatggaaccagctattgaagcataccatcattcctctctgcattcgttgttgcttctttttagtcatcctcaaaagcctacagtaagacaacatgaatacatcacaattcatgcaaacattggatctcaattgcattttgcaaaatataacacttccacctgttttttaagccctttagaagatcttctgctttagaaatttctccggtctttgccaaagtccacactatcaatacatcaaagtgccattccatataccagttttcctgac

SEQ ID NO: 5219 - DNA, 370 bp, Glycine max
gagcacaaattcccactgtacatgcgccagggtttgctgcagctgatactttgaacactgcatgaaggttacaagcaacacaaatccaactacagagatctttcatgcaatgaaattaacaggcagaaagttacactttcctacttaaaccaaaaaatttctcacacatccaatggaacacaaactcaatcaagcttcggggaagacacagtgaaaactcatgaattaactggaatgcagaaggaggagctgagaggcggtggcaaaacacaaaccaaatgtggcccagcaggtttgcagcttatatttgcctcttcaacatctggcagtccaagcacgggagggtgaacataaccagccaccagtggca

SEQ ID NO: 5220 - DNA, 390 bp, Glycine max
acttcccaaccccccctgagagaatcacattcaccttgcctgtcatcaattctgcatccaatgttgcagtagttgtcaccggtgaaagcaaagcggaatccgtacacttggcaataggcgatgttggacctgatggccccttaataccggcgagaatggtccaaccagctatggggaagttggtgtggtttttggataaactggctgcctcaaaacttgaagattccaatttaaacaagtaggacttgttgtaagtttgtatgtagtgttaagggatttcacaagtgttgaccatccttagaatcctgcctatttcttttctcttggatagaaagtctttgtttctttttttttttttttcctttttttgttttcccccagggcccgggg

SEQ ID NO: 5221 - DNA, 190 bp, Glycine max
actcgctgaggttcaagaattcacctccttcttgcgactcttggggagttaccctatcgatatcacaccctggactccctcttctccgcgccaaaattaacatccacctccatttctttcatctcaactgtatatatatatattggagcccctcattgcacataatgtgcttctctttatgtgtttccaa

SEQ ID NO: 5222 - DNA, 655 bp, Glycine max
  misc_feature (83)..(83): n is a, c, g, or t
  misc_feature (209)..(210): n is a, c, g, or t
  misc_feature (223)..(223): n is a, c, g, or t
  misc_feature (234)..(235): n is a, c, g, or t
ctgtaatagaccgtggtcttttatgtttccttggagaagagaaaaaataatgagtttattgtttctttctggtttgtgggaancgacggttaaagttgttttgcttttgtttgttaagctctgtttcatgtgttttctgagtggcttggagattaatcatggttttggaattttcattggaaatttgggctcgaattgtactatctcanncgtcaactctaancatggacaatnncaggaatggttgaatacataaaatcagggcagaagcaaggtgacatggtgctggttgtgcctcatggtacctatgctgttaggcttggcaacgaagcttccattaagcagaagatccaagttgtgaagggcatgttctactcattaacattcagtgcctcacgcacttgtgctcaagaggagaagctcaacgtgtcagtggtgccatccaatgagaagagtgattggggagtgtttcccattcaaactatgtatggaagcaatggttgtgactcttatgcatgtgggttccgagcagattaccctcgagtggaaattgtgatccataaccctggcgtggatgaggatcctgcttgtggtcctcttattgattctgttgccttgaaactcttgcactcacccaaacgaactagagacaaaa

SEQ ID NO: 5223 - DNA, 403 bp, Glycine max
tatatcctatatcttccaaaatactccagcggacacagatattcctttactagcctcccatttcagaatgattattttggaataaatcccttttctttttatattgaatgataaactaccagaaagatcaaattaaactaaaatttatttttaaaaaaggctaaataaaaattttaaaaaaatccataaattaaattgaaggtttttgttaagaggaattaaattaaaactaaaaaataaaataaaggactaacaaaaataaatttagccaataaaaatattaagaaaaccataagataaaaaaaagtattgagttgattgtttgaattaaaagcgtgaaagcccattttggaagaagctgaagcccacaaacaagaaaaagaagtgacatggtttgttcgag

SEQ ID NO: 5224 - DNA, 343 bp, Glycine max
atactcaatatagttgctcagattcatacatcgttgttttcaaatttcttttaagactactgctaaagaaaaacatatggtcttgtcttttccacctttcctgttaccgttaaaatgttcactgtcttacaccttcagatatacattggtgcaaccaattctttttagtgggtatgcattaattgtgagtgtgataggcttttgaagcaaataataacatttcttttcttagcatataagaaaatttggatctggtatttccaatgattggatacatgtggtgttttcatgatccttctcaagtaaacacaagaaggggataggtgcgaatttggtaactcaa

SEQ ID NO: 5225 - DNA, 900 bp, Glycine max
  misc_feature (49)..(51): n is a, c, g, or t
  misc_feature (779)..(781): n is a, c, g, or t
  misc_feature (801)..(804): n is a, c, g, or t
  misc_feature (825)..(825): n is a, c, g, or t
  misc_feature (827)..(831): n is a, c, g, or t
  misc_feature (852)..(852): n is a, c, g, or t
  misc_feature (854)..(861): n is a, c, g, or t
  misc_feature (864)..(873): n is a, c, g, or t
  misc_feature (880)..(880): n is a, c, g, or t
ccattactagttgcagacatcccatcagacatagatttccgcaattgcnnntgccatctcttcatctcagatacaccaactgaataaatggctttctgccactctgtttgaataaaatgccaaagtaagaatgcatgtatagatgcagacataaggagcaaatgtactccaattagcttctcaacttaaagtggtgtaaatataaagccaatttacttttgatggatgtaaatatgccaacaaccaaccatgcacctttgtgtgtgtttatgtataactttaaggttggaacagtttgaacatggtctaaacccacatgttcaagtacatcggggactataccttaaacttttagaaaaattcatcattatcaaaaagaaatagagttcattttgataaactaaacagtgaatggaatcatatgtacaaaacaaaattaaaatatacaaaatgcaagactctgttctaacttacatgtcacaggttaaaacaaataataataataataataagagaaaattacattgacacccccaatggtttctttaagttgaaactgataccttacctttttagcccctacaataaccccctaaattgtttaaaatacattatagtgacaccccctgtttctcaataaatacattacatgtgtacccctataggggggtcactgtgaacgttaaaaggcagaggtattgtgtgcaatttgaagaagccacaggaggttttagtgtaatttgctctaataataataagttataacatatgacagaggnnntaatgtattttctaatttannnncttaacttttctgacatgaantnnnnngataattttttatatacattngnnnnnnnnaannnnnnnnnnaaaagtnactaacctttttaatccaaa

SEQ ID NO: 5226 - DNA, 682 bp, Glycine max
tctcctgctgcagtaaggttgtgaagaagccggagttcacagaaggagagctaatgccattgccatccggttcctgtttcacaccagtcatgtttgatgagtcaaaactagcatattctggcagagggatgtggaaatatgcaagaccaggagcagcatctttctgaggcactggtttacttatgtatgctttctgcagaataaacaaaaagtaagtggtcaatccaaatattaacgataaaaagaactaaaaaataagtcacatgtttagtgaggatcgacagaaatttccataacatgatacggtttagcttcctgtttggtttgagaaaatgttttgttttcataaataataataacaaaattgacacaatttgttttctactattttcaatttttgtaccagaagtgttgaaataaagtggtagttttgtaattatttatgaaaacaggaaatgaaaataaaaaacgtttttttcaaactagacagactatactgtaagtagaatacagatagataatcgtggaagagataaggcagcaccttaagctttgcagatgttcgttggaaccaaagctgttgggagggcttgatccaatcataaccaaaaatagtagaaacttgggaataatctccactatcgagaaagtacaggttgagcactgattattcaaaatcagt

SEQ ID NO: 5227 - DNA, 385 bp, Glycine max
ttcccaacgtctcctcctggctcgacgcccacgcgcctcttccgagaggcgcgtggggagcctttctcaacttcaccggctgccaccgcggtgacaagtacgacggtctcgccaatttaaagtcttactttgaacgcttcggttacattcctcacgcgccgccgccgtcgaatttctccgatgaattcgacgacgcgctcgaatccgccatcaaaacttaccagaagaacttcaacctcaacgtcacgggcgtcctcgacgatgccacgctccagaagatcgtgctgccgcggtgcggcgtcgccgatataatcaacggcacaaccacgatgaacgctggcaaggagaacgagacggcatcgtttagcaagccgaagtttcacac

SEQ ID NO: 5228 - DNA, 385 bp, Glycine max
acagctggacgacgcgctgggtcgactcaacgacgcgctgtcggccgcggcggcgctgacggaggcgaagatctccgacgttcagacgtgggtgagcgcggcgatcaccgaccaacaaacgtgcctcgacggattggaagaggtcggtgacgtggcagcgatggaagagatgaagaaaatgatgaagaggtcgaacgagtacaccagtaacagtttggctattgtcgctaatattcgcaacttgttacaacggttccacatggcgctacattgaagttgaagttgaagattttcaattcgttacatttttttttgtggttttatatatatatatatatatatatatggattttgtgtattgggggggtgaatatgtgatgcttaa

SEQ ID NO: 5229 - DNA, 290 bp, Glycine max
caggtgtaattaaccttgccataattgtaaactaaactacatgttgatgagcatggcgatcgttgttgatacacctcttatttagcatatacttaatacaccccttaacttactaggtgtcttcaattggatcctggagggtactttgggtaaggtgacttcccatatggtggattgtaggaaggtggcttgtaatcaggtgttttgtaatctggtgaattataagaaggtgacttgtaaactggtggattgtaggaaggtggcttgtaatcaggtgaattataggaagg

SEQ ID NO: 5230 - DNA, 464 bp, Glycine max
  misc_feature (424)..(426): n is a, c, g, or t
  misc_feature (444)..(447): n is a, c, g, or t
tttagtgtttccggttcgaattggggtcttgctaagaattttagcactagtgtttgtgtcaatattggtagttttaggcctagggtcgtgtccttgacaccgcatgtagcgtcggattttaggaatcactctacatcggttgattctcattctaatgacacgagctttgagaagatttacattcaaagtggcttgaatgtcaagccattgataattgaaagaattgagactgatcaaagtaaattggaggaagttgctgaagaaagatgtaatgagtcaaacgtaaatatagataatttgaaggatttgagtgagaataaggttcagagggaggtgtctgagattgaaaaggaagcttggaagttgcttcaggatgctgtcgtcacttactgtgggaatcaacggatgtagggtgagtccaaannncagacgctacatgcggtnnnnaggacacgaccctaggc

SEQ ID NO: 5231 - DNA, 417 bp, Glycine max
gggattctatagtatgtatacaaaatcatgataatcaatataaatcatcaatataataaaagaacaagcaagcacaacaacaagctcatatctaacccaatggtatgaatctgaaactgaatccaaaagcaaggcccgagtgtaccatgtattctgaaaaagcatcataatcagtagtgccaacctgatcagcatgtattaactccatccttgcaatctttagtcaaattgtagaacgtttccacgcgtgtctttccacggtaaaagacctcagtatccactgcaactctcatgtacccatcaaactcaacaggctttccattgttgagaagtgtggtctcgttataccactcacttgtatttccccacagctccttatagtcatcaagcagatgcaccttgtaatttgacctcaac

SEQ ID NO: 5232 - DNA, 492 bp, Glycine max
gagaagttcgaggaaaacaagaacgtgagctccgaggcggagatccagaagcttctcctagaggctgaagaggcctcccatttcatcaccaacatgctcgtccaggcacagctcaatcccgattctggcacttacggtatgctcacctcctgtttgttatttcgcttcctctttttttcgttttccattcctcgctcagcactaccacattgtagttcacgcacttttaattatatggaattataattttacatctcaatttttgcaaacttgtcgctgcagcggtgaagccgtgtaaggagcatgctggagcaacgcttgaacttccctccgaagaaattattcggaagtcagcatagggacaagaggcaagcggttagaacaaagtctagatttttatttttgcttaggatcaataagcagtattgcctctgattttatgggggtgtttgattattatttttttgctcccaatcctatgtttcctttcaa

SEQ ID NO: 5233 - DNA, 450 bp, Glycine max
  misc_feature (398)..(398): n is a, c, g, or t
  misc_feature (432)..(435): n is a, c, g, or t
  misc_feature (440)..(446): n is a, c, g, or t
ggtggtgatgacagtagtagcagaattggtaataatctgagaacccatgttgctcgtaaggtctacaagaatcctaggattattgatgaattcttgggtacaggagagtacgagaatttagctttgccaggggaaagttttggcctagggtttaagaggtttagttctaaggatgggtcatccattgcctttggtcactcgggaatgggtggatccacgggtttttgtgatgtcaccaataacttctctgttgctgtgacactgaacaaaatgtcctttggaggtgtcactggaaaaattgtccaacttgtgtgttcagagttaaatattcctgttccagacgatttcttgagatttgcggttgagcaaagtggaccagatgagcaattatcaagaantcgtctggaacaggaatgtttatctctgaacacnnnngttgnnnnnnntttc

SEQ ID NO: 5234 - DNA, 341 bp, Glycine max
tggcagtttcttcagcaacagcttcctccaaactcatactattcccccatgcatcatcatcctcttcccttaattccacacccttccgctcctccaccaccaacacccacaaactaacccctctctcctcctccttcctccaccccaccaccgtcctccgccgcaccccttcttccaccaccaccccgcgtcgcaccttcaccgtccgcgccgcccgcggcaaattcgagcgcaagaagccccacgtgaacatcggcaccatcggccacgtcgaccacggcaagaccacccttaccgccgccctgaccatggctcttgccgccctaggcaacagcgccccc

SEQ ID NO: 5235 - DNA, 1196 bp, Glycine max
  misc_feature (184)..(184): n is a, c, g, or t
  misc_feature (188)..(188): n is a, c, g, or t
  misc_feature (196)..(199): n is a, c, g, or t
  misc_feature (205)..(207): n is a, c, g, or t
  misc_feature (263)..(265): n is a, c, g, or t
  misc_feature (733)..(734): n is a, c, g, or t
  misc_feature (741)..(746): n is a, c, g, or t
  misc_feature (748)..(758): n is a, c, g, or t
  misc_feature (761)..(771): n is a, c, g, or t
  misc_feature (780)..(787): n is a, c, g, or t
  misc_feature (791)..(797): n is a, c, g, or t
  misc_feature (805)..(807): n is a, c, g, or t
  misc_feature (811)..(812): n is a, c, g, or t
  misc_feature (814)..(829): n is a, c, g, or t
  misc_feature (831)..(833): n is a, c, g, or t
  misc_feature (838)..(852): n is a, c, g, or t
  misc_feature (864)..(866): n is a, c, g, or t
  misc_feature (869)..(877): n is a, c, g, or t
  misc_feature (884)..(887): n is a, c, g, or t
  misc_feature (889)..(889): n is a, c, g, or t
  misc_feature (891)..(905): n is a, c, g, or t
  misc_feature (909)..(916): n is a, c, g, or t
  misc_feature (918)..(923): n is a, c, g, or t
  misc_feature (932)..(933): n is a, c, g, or t
  misc_feature (940)..(943): n is a, c, g, or t
  misc_feature (945)..(945): n is a, c, g, or t
  misc_feature (948)..(955): n is a, c, g, or t
  misc_feature (958)..(959): n is a, c, g, or t
  misc_feature (961)..(974): n is a, c, g, or t
  misc_feature (977)..(981): n is a, c, g, or t
  misc_feature (983)..(996): n is a, c, g, or t
  misc_feature (1004)..(1015): n is a, c, g, or t
  misc_feature (1017)..(1022): n is a, c, g, or t
  misc_feature (1026)..(1026): n is a, c, g, or t
  misc_feature (1028)..(1041): n is a, c, g, or t
  misc_feature (1045)..(1088): n is a, c, g, or t
  misc_feature (1092)..(1100): n is a, c, g, or t
  misc_feature (1110)..(1114): n is a, c, g, or t
  misc_feature (1116)..(1123): n is a, c, g, or t
  misc_feature (1127)..(1130): n is a, c, g, or t
  misc_feature (1132)..(1132): n is a, c, g, or t
  misc_feature (1134)..(1137): n is a, c, g, or t
  misc_feature (1139)..(1151): n is a, c, g, or t
  misc_feature (1159)..(1163): n is a, c, g, or t
  misc_feature (1165)..(1167): n is a, c, g, or t
  misc_feature (1169)..(1176): n is a, c, g, or t
  misc_feature (1178)..(1193): n is a, c, g, or t
gtgagttactattgcttaatgtataattacaaagagtaatgctatatccctctacaaattttataaagaaggtattaaataaaaaagtaaatatatttagtgtcttggaaacattaaaagcattcaatacttaccatacaaaacaattaggaggattattaggatgatttaaaattattcaatnaacnaaacactnnnntaagtnnntgttaaacaaaccctcattccccatgaaattgatcccatttagaacaacatgcagnnnaaggaaacaagatctgtttaatgctattggttccatgtacaatgccattctcttccttgggatccagaatgccctttctgtgcaaccaggggtggccattgaacgaacagttttttatagagaaagagcagctggaatgtattcagccatcccctatgctcttgctcaggtaattaatttaacttctagaagccttatttagtattttgtgtcagttttatatcttaatcttattaatgcaaccttttacttcttaggttgtaatagagctaccatatatttttgtccaagctgtaacatatggcatcatagtttatgcgatgatcggattcgaatggactgcttcgaaattcttttggtatctgttcttcgtgtacttcacatttctatactttaccttttatggcatgatgactgtggccgtaacaccaaaaccaacacattgcttcaattgtggctactgcattnnatggaannnnnnannnnnnnnnnnttnnnnnnnnnnntcccttttnnnnnnnnaccnnnnnnnttttctannncccnncnnnnnnnnnnnnnnnnannncccannnnnnnnnnnnnnnctcctgaatcannnccnnnnnnnnngtccctnnnnanannnnnnnnnnnnnnnggcnnnnnnnntnnnnnntctctaaannaaatccnnnnanatnnnnnnnnatnnannnnnnnnnnnnnntcnnnnnannnnnnnnnnnnnntatgtttnnnnnnnnnnnntnnnnnntccntnnnnnnnnnnnnnnccgnnnnnnnnnnnnnnnnnnnnnnnnnnnnnnnnnnnnnnnnnnnnactnnnnnnnnnttttattaannnnnannnnnnnntttnnnncntnnnntnnnnnnnnnnnnncacaatannnnntnnnannnnnnnnannnnnnnnnnnnnnnnttt

SEQ ID NO: 5236 - DNA, 749 bp, Glycine max
ctggctagattagctctaacagatgtcacccctgcagaactgtaagtctaactcttttatggcatcatcatgagattttgatttgttattttgttgatcagtgatcacccttcaattttgtttcataaccaaaactagttcttggatttctaatatatattttatattttattttccctatgtatggatgtgtttttctatttacaggatgacagaagaggcaacaagtggaaatccatgggccccagatgccagaactctcagatcaatttcaagggatgcttttgagctagacgattattggaggattgtggagattctgcataaaaggtatttccaggtccctttgttttccttaccacgtttcccacttttgtgtcaatcaatcaatcatgtgtagaatatagatcaaccaatcagggatgaatgacatgtacaattctaaaacaggtttcttaaatttgaaaagaagaattggaggatctcttacaattccctgatcgtgcttgagcacttgttgactcatggaccagagagtgttgcggaggaatttaagagtgacaaagatgtcattagccaaatgaaaggttttcagtatattgatgacactgggtatgttcttatttttgcatctcctgcctaaaaatctatggttattaattttctccttcttgacaagacaatgggtgcattttgagtgtttgcaggtttaattggggcctaactgtgagaaagaaatctgagaggat

SEQ ID NO: 5237 - DNA, 396 bp, Glycine max
ttaaatatttgtgccatgacagaatatatgacaaatgacatcatgtatcttttagtacctgctctcttgattggtggttgtatctctctaggaagtcatccaacttaatcttgtttgggagcttcatgtctactcaaataggattggaagatttaaacttgcggagatcatagataggatttgatttgaacttgcatcataagctttcttaaatctgtgttgtttttctttttacattgtttttattattttcaacaaaaaatataagtttctagatacctataaagtatattctgagtcaaacttattaatggtaagttggtaacaaacttgatttctttaaggatatccttctttttgttaagatgatttcgatgttgaaaccagtttccgttc

SEQ ID NO: 5238 - DNA, 335 bp, Glycine max
ttggatcaagtaagaagctaatgaatgaattgagaaatgtaaagcgccctgtccccaccataatctcaagcagagaaaatccaaagaagaatgaatgaccgatcaataaaagaacatttcactagtacagcttctcaaatgacatatagcttaaaaaatgaacaaaaaagaaaagtagaaaacctttttttgtatcccgcaaaagaagcagcagctaaacatagaggcagtattccctcgtgaacaacacttgtcttctctaacagtagaagaagggtttaaaggggtgtaatgtaacgtaacgtagtgggagtcttcaaattcaaagctaaaat

SEQ ID NO: 5239 - DNA, 456 bp, Glycine max
tggtctaatgactctggtgaggtcgactacatggatcatactcgactacatgaatcatactgtgccgttggattaaagaccaaagaataagattaaatgatcatttcatgtttataggagtttggacactgaaaattattattattattattattgaagggactaatacctcttcttttttatgccctttctttactcttaagcctttgatcaattatcctttttcacttctttttttcattggttttcatgaacatttgagttagtttacactatagaacctgaatggtcctactcatacgtacaagatgaaaatcaataaaatttaagcttgtgttatactatgttctttatttctctgcctcctttttaagttttcaccgtttttcagttcccatccgccgaacgaaaattcaagggtttttatctttggacttggtgaataatagaattggg

SEQ ID NO: 5240 - DNA, 381 bp, Glycine max
tattttgttccatttggaggtgggaggagaggttgtccagggacagcactggcattcagcttgatgaacactgcagttgctgctatggtgcagtgctttgattggaaaattggtaaagatggaaaaggagaaaaggttgatatggaatctgggtctggtatgtctttgagcatggttcacccccttatttgcgttcccgtagtacattttatcccatatgatatataatataattcaatataatgaagactcaccaaggaagaacttatattatgatatgatgggtaatatataatataacccttatcttcaattttatccttttttatcctaattttcattgttttacggaaagacacttcctgaatccaagttcctgaa

SEQ ID NO: 5241 - DNA, 357 bp, Glycine max
ttttctaatctcatcatctaacccttccatcgtagtttccacatttctcctaccgaaaagtcaaaactacccactcacccaggtaggcacaggcagcgatggacgtaggagccggcgacgatcattccccggaagccgtcatatcgcggtggaaattcgcggtgtcgcagcagtaccagcacatgctggacaaaacgacgccgcacgttctccggcggtggatcgggtgcctggtggttgccgccgtgtacgtgctccgcgtgtacttggtccaaggcttctacatcgtctcctacgccctcggcatttacatcctcaacctcctcatcggcttcctctcccctcaggtcgatcccg

SEQ ID NO: 5242 - DNA, 359 bp, Glycine max
  misc_feature (39)..(39): n is a, c, g, or t
  misc_feature (69)..(69): n is a, c, g, or t
  misc_feature (87)..(87): n is a, c, g, or t
acaaattacaaatccccacatgggattcccattgatctnctggatcgacttctcatcatctctactcanccttacacggaggatganattcgcaagattctggatatcagatgccaagaggaagacgtagacatgagtgaaggtgcaaagtgtttgttaaccaaaataggtgtagaaacatctttgagatatgctattcatctaatcacagcagctgcattggcatgccaaaagcgaaaggggaagacagtggagttggatgatataaatcgggtttacaatctgtttttggatgtcaaaagatcaacacagtacctaatggagtatcaaagtcagtacatgttcaatgaaacaggaga

SEQ ID NO: 5243 - DNA, 398 bp, Glycine max
taccgatactcaccgagcaacaaatctctagatcttctagtgatgtgttgtctcaaaattttactgtgacggatgatgagaataaggagaagaaggagaagggatttcttagtgactcccagtcttcagtttcaccaggaaagtcatcttctaccgccgagttctcttggcaagttggttcggataccagtcattgcaaggttttcatagagtcagaggatgtgggacggacccttgacttgtcctgtcttggttcatatgaagagttgtacatgagactggctaacatgtttggaatagaaaggtctgagatgttgagtcatgttctctaccgtgacgcagctggtgctcttaagcaaactggagaggaacccttcagtgagttcataaaaaggggg

SEQ ID NO: 5244 - DNA, 814 bp, Glycine max
gagcttaccggtgcacccgagttcagccagctgatcaggaacaacatcaacttttcccaagtgtcgcacctattgctgccacctttgtagatacgccccaaaagccaatgttgtcgagcaaagacaatattgcagcatcatcgacagtgtcctcggccactaattggtaccagggggcaaaatctgaaccattggaaatgaatttatcatcaccctcttcttataactggttttttgtccctcctatcagccaaggaaacatgaccagcttggaaccggggagggttctctagttattttttatttatttatttatttttatctcccttagttatatatgcttaattatttcgtccggtggatatagcttttgtccacagtttgtttcatttggacaacaaaagctatatccaccggacgaaataattaagcatatataactaagggagataaaaataaataaataaataaaaaataactagagaaccctccccggttccaagctggtcatgtttccttggctgataggagggacaaaaaaccagttataagaagagggtgatgataaattcatttccaatggttcagattttgccccctggtaccaattagtggccgaggacactgtcgatgatgctgcaatattgtctttgctcgacaacattggcttttggggcgtatctacaaaggtggcagcaataggtgcgacacttgggaaaagttgatgttgttcctgatcagctggcttgaactcgggtgcaccggtaagctgctgaacaaggtcacggaagttgatagcgtccaccttgtacac

SEQ ID NO: 5245 - DNA, 335 bp, Glycine max
gttcgtggaagggctgattctagacatggtcaagcgaagcagaatttagttcatggagatgctatggtcactaaaaatcccattggaagtgatcaatgtctcaggattacagagctgaaacgggttcttggaaattctgattctagaaactgcaaattgaagcagaattcagttcatggagatgctgtggtcaccaaaaatacacttggaagtgatcgtcagttgaaaagtgtcaagattacagagcccaaatgtgttactggaaactctgattctaaacattgcaaagcgttgcataattgggttcatggagatgctatggtcacagataatgc

SEQ ID NO: 5246 - DNA, 662 bp, Glycine max
  misc_feature (600)..(601): n is a, c, g, or t
ttcgacacttctcttctcatgcatccaaagaacagaaatcacgaaagatgcttttatacttgacgggcttagtttttgctatggttgggtgcacatatgctgcagttcccctttacaggagattttgccaagcaactggctatgggggaactgttacccggcgtgaggtgtgtttgagttggttttctatggttttttgttttttcatcaactgggttgacaattttacttctttttatctgttgataacgaaattttgcacttttacagactgttgaagaaaagattgctcgacatgatagcaataatacagtcaccacaaggtattgttttttcttatttgatgttaccttgttaccatcagtcatcatacgattaattttttcttcaggttgattgttgtatggttattagaaatagccgttgaattccctagaaattttgaaataaaaaattcattattttcctgttccgcacatggtggttcaatttctttgagctgctttgtttccttcatttatactgtgcattcgtataacacagtacttaggcaaaaaaaaaaaaccccggaaagggggggaacccgaaaaaaattttttnncccctttttggtttacccgaaaaatacccccaaaaaatttccttttttgaacccataaaaa

SEQ ID NO: 5247 - DNA, 630 bp, Glycine max
gaaagacaagaggtttggatgacacgggttttcaaattgaattagtttgcatgattatattgctggtcatattattcttaatgataagcttttgaggaagtaatctagtcattatttttttctttcattttcataaaataggagttagataatgatatgaggaagtgcaaggaagagttcaaagagtttgagaggattgcttgatgaggagaaggtcttagaagaaatcacagagagttccaaaggtgaagtcttttcttttttatattcaacaatatattagaagttgcttttaggattagacaaaaattgcgaagtttctaacatgtgggtactaaaattgctagaaaagaacaggggggcaaaaattgtggataaggaattaaagggggtctaaaattgcaatttagcctcaatactattaattttatctttatcaatactctactttgtatataatcaacacattccattagtttaacttcttacaaatctttgcagcaaaatatgatgttgcaatatcaacagcatgccatggacttgattatattgtggtggaaacaactaatgtagctcaagcatgtgttgagttacttcgtagagagaatcttggtgtcgctactttcatga

SEQ ID NO: 5248 - DNA, 375 bp, Glycine max
cagctcccctcggcttcggcggtaaagccctcacctggctcgtggacgcgctgaaagcacgttcacagggctgccccgacttcatcctcatcgactgccccgccggcatcgacgccggcttcatcaccgccatcactcccgccaacgaggccgtcctcatcaccacccccgacatcaccagcctccgcgacgccgaccgcgtcaccggcctcctcgaatgcgacggaatccgggacatcaagatgatcgtcaaccgggttcgaaccgatatgataaaaggagaagacatgctgtcggtgttggacgtgcaagaaatgttagggttgcccttgcttggggctattcctgaggacactgaggttattagaagcacca

SEQ ID NO: 5249 - DNA, 1075 bp, Glycine max
  misc_feature (1000)..(1003): n is a, c, g, or t
  misc_feature (1057)..(1072): n is a, c, g, or t
aatcgttatccacagcctcacttcaatggaattttgttttcccaagtcaaacagtgaggattctttgtttcctgagtatcaacatgaatcttctctcaggttagctccatcattttgtgcagttcgtcacacaagaacttgttacttctgaattaagctcacatcagtgtgcatccactagtaatgttcagtttcttgatgatgagttaaatcttagttgtgttccaaactgatgagttagacacataataaaggaacaatttggcaagagtagtgtgcatgcatgttttgccgtagctcacttacacgtgctcacattttaaatgccaacattttattcaactacatacgtctctagaaaagaaatactctataagaatgtttagatttgagtaggcttgtttcaacaaacagtgttgtgtgttatttcactttatctattttcatgactgtaaaaacatatggatcctgaaatattttaatttggagtgaaccaccacataggtcaccgagattgtaagcatcaattactttagtccataactcagtaaaactcttgttttttttcccaaattttgcaaaatgtcattcacttcaatcttttctgactgcatttttaattgtcattaagtactaaagtgaatggcatttcacaaagtcagggactaaggttacatttttataaattcagggactaaagtaatcgacacttacaatcttacgaccaatgtggggggtttactaaatttatataaacatctttagctatgatggatctattatgtgtacttgctctcagttatcaacagctttcttactccactttatgttccattaatagataccaactgatcagagtacatcctaaaagccttggagaaaactgcaagtggttggagatgtttgaagagaccgatgttgtaatgttctcagttgccttatctgactatgatgagtacactacagacagtaaaggagtttctaccaacaaaatgttggnnnntaagaatctctttgaaaacataatttctcatcgaagcttccataacaaaaaatnnnnnnnnnnnnnnnnttt

SEQ ID NO: 5250 - DNA, 485 bp, Glycine max
atgcggtcgtcaagctggcgggcagacatgtcccaacaacctatgctgcagccagtacggttggtgtggaaacaccgaagaatactgttccccttctaagaactgccagagcaactgctggggaggcggcggcggtggcggtggcggcggcggcggtgaaagtgcttctaatgtccgcgccacatatcattactatgagccagagcaacacgggtgggacttgaacgccgtgagtgcttattgctcaacttgggacgctagcaaaccttactcatggcgcagtaaatatggctggaccgctttctgtggtcccgttggtcctcgtggccgtgattcttgtggaaagtgcttgcgggtaagaatatataattacttattttgttgttttgggggtggaagatgactgacgatgatgatgatgataatgcaggtgacaaatacaggaacaggagcaaacacaattgtgagaatcgtagatcagtgca

SEQ ID NO: 5251 - DNA, 517 bp, Glycine max
gaggaagtacggtcagaaaccgatcaagggttccccatacccaaggtgagtgatatttaattttgaccgttgatttagttgacttttatctcatcaagactcgttccctgacgtcgattttttttatcatcaggggttactacaagtgcagcacgattagagggtgcccagcgaggaagcacgtggagcgcgcaccagacgatcctgcaatgctgatagtgacgtacgagggggagcacaggcacgcggttcaggctgcgatgcaggagaacgcagccggggtggtggggttggtgttcgagtcaacgtagagaatgagaaagaaggtccaataaaaaaataataataaatttggaagtggaggacttttttaaaaaatatatatatataatttttggaaagtgtagtgggaagaaccaagaagtaaggacaatggctgccttgtaaatttgttttatttttatctttattattattgttatattttagttgtcatagactcgtagagaggtgaaaa

SEQ ID NO: 5252 - DNA, 356 bp, Glycine max
tggtttaacgccaaggtaaatcagtgtaacactagtttcatttttttgtatacctactagatcaacaaattgaagcagaaaagtcttagttactagtccttgagagcttttaaccaggaaggtggaccaagtccactgtgaagttatttttagggctgtgttcttcttgctgcaaatgcaacattgctgcttctccgccaattactggtgcattattttggttacagtgtttgtctctcccacattaaatactaggagagatgtaaacttttgagtagtctcgttttcccaatgtaacatgtgttttcaatgagaataagtcaggattaatttattgacgaaggtgaatgatttca

SEQ ID NO: 5253 - DNA, 788 bp, Glycine max
  misc_feature (694)..(696): n is a, c, g, or t
gatgacgtggcgcgtttgacatgtcgcatggggaccacgcctcgcacctccaaaccattgatttggtgaaagaatacaattctcagtttcaagataaggttgtagccatcatgctcgacaccaaggtcaactcatttttcccataacatccattttcgtcggttttagctgaagctagttttgtctgttgacatttttaatttcaatgttagcatcaaactcatcattattgttcatattcgaatgcttcttatgtttgatggtggtaattaatgtgttgtgagcttgtaacttgctttgcagggtcctgaagttagaagtggggatgtagctcaacctattttacttaaagagggacaagaattctgtttcaccactatgagaggggttagcacacatgacacggttagcgtgaactacgatggctttgtgaatgatgtggagttcggagatgtgttgctggttgatggtaagcacagtggtctcttgtttgttgttgtgcacacagttgtcttgcttgattaggtgaaggttttgccatttattatcgtagttgattgctactaatttgattaggtgaatgatgtgaaagttgtcatccataggctaccaataagatgttcctcctattttaataatacattttataatctgagagttttagaggaatttattaaattgttggatgaccacnnnattttgattatctgtaaagatgattttaatctcttctgattgttatttcaggaggaatgatgtctcttgctgttaagtcaaagacaaaagac

SEQ ID NO: 5254 - DNA, 351 bp, Glycine max
aaaataggaaaaggtgatgaactccttcaatgcattgcagcggcaaaaggaataattcttcttctcccattcttaaaataagataagaaaaattctaggaaaagtagagcattacctgtatttgtatgtgttataatttagccctatatttaccttctatccctacttggcccttagtgtgtctcaccaccttttgttctattttctttctctttgtttttatgtttttctttgctgctctcccattcatcaacaatgagtgtagatatgtcttgattttttctcgaggctcagagaaattcaagaaggctagaaaatgccttgtttgtctacccaaaatcttggtgggta

SEQ ID NO: 5255 - DNA, 360 bp, Glycine max
gcaaacaacaactttcttccgttcggaggaggaccacgattatgtgcaggatcagagttagctaagcttgaaatggctgttttcattcaccatctcattctcaactaccattgggaattggctgataccgatcaagcttttgcctacccttttgtcgacttccccaaaggcctacccgttagagtccaagcccactctttactttgagaaaatccacccaatgcttagttagttagttcaccccaaatatgtaataactccaagcctagccaataatagagttacacctcaatctaaattaaactacgtgaagaatttgaagttcctccaatggcattccacacaaattaaaagtatttc

SEQ ID NO: 5256 - DNA, 376 bp, Glycine max
aggtgcttctccctcttgacctagtgcttcccagcaaggcgccggcgccggcaccggcgttggcgagaaagggtttgccgaaggctgataaagggaattccacggcggcggacgatggcactgttggcggcaacgatgacagcgacgggaaggccttgccggcgggtgtttctgcagggtgtacgatgaagtgggtgaataacgttgttgttgtaggagtggtgggtttggtgggtggtgttttgatgtaaggtgagtgtgcatggataaagggattccataatttttgttgtgcttttgtgatcgagtaatatatgtattaattccatcgtgcttaattgaggttctggtttatgggtaaagggtagggtgaaaa

SEQ ID NO: 5257 - DNA, 401 bp, Glycine max
cggggaagacggagcgtgcatgaatggattggcactgggtgtagacgaaggggtgggaggattggggagggaggagccattggagtgcggaggaggaaggggaggtggagtaagagatgaggaaggaggagtggtcggagagagtgaaggagaggagggagcctttgatggggtcagggtcagagagagagaaggggataggggtctgggttttggggtggatgacggagtgaatggtgagggagcgggtgtccagatagaaggggccgctgtgggaagtttggagactgaagagtgcggaggcgtggatggtggatgagggcaagtccaggtagagactcagggctacgtgccttgtccttgcttgccttgagtccgtgaacgagtgaggatcaactgct

SEQ ID NO: 5258 - DNA, 618 bp, Glycine max
cttattgatcgtctcattcaacgcaattacatcatagtatgtccatcttcctctcacttctattaaaaattagatattacttacttaaccagtagttacatataactttcaaaatagttaaatttataaatttgcatatataataatttataattgattgagagtactaaagcattatacatttgttatttcatatactattttttctaaaagttatacacaataaaattaagtcccacgtgacatattattggctaagtgctaagagtgggtcatgttttgaatgtcaggatgttttcggtaagcaagcaagggacagggctgcattgtgggagccagatagggaagcttggaagaaactctgtgtcacttttttgaagggtcgattgtgacataaaaatggcattgaaaagaggagttatagttctgctaagaagcgataatattaaaaagtagtcgtatggatgagggtgatcgatctatacataaaagttataggttggtggcactaatgtgatctggcatatatatgcacggctttgcactgttaattattagatggctttgttaggttgccagccattaagtgttgatggggcattctatctaagctcaact

SEQ ID NO: 5259 - DNA, 400 bp, Glycine max
tctagctgtaccaaaagcaaaaagtttgactaggtccacgtagcttagatgctgcaattggttcaagtgtggaagtgatgtacaaacagcagatctcttcacatttgcttttgaagacttgttttcaacatttgacccataatgggtggtgggggcctcttgttgatacagattttccttgttgaataatgtatgattgtaatctgacttgccatatggtgtgcatttactacatatttggacctataaccaaatctatagttggtcacaccattcatcatttgactttccctttggtggacagctgatgaaagttgttctttggaacagtggtggcacgatgacttgaacatgcccctaggaagctattggaaatcttcaccactagctcattgcttgt

SEQ ID NO: 5260 - DNA, 469 bp, Glycine max
ctaaaacgcagcgtcgttttcgtttctttctttctttcactctttgattcaatcttttgcgtttgcgttcgttttatgtttaggcgatcgagaggagaagagcgaggtcaggagaagccgaaggccagcgaatcggaagcaccgatcctgcttcggatcgattagttacagaaccttccgaacctgcttctgctgattctgcggtgaaatcgccgaaatccgttggtgtgaagctccgaacgccgttcggcagcaaagtgccgaagatcttcctcgacatttcggagttaccggaagacgacgaatcggagactctgacgccgcagaagaagcttcttaacaacatcgatcaggttgaggaagccgtgcgcgaagaactgaagaagctgaagagaactccgagtgcgaagaaagcagagagggaaaagcgcgttcgcacattgatgtccatgaggtgattggaattctc

SEQ ID NO: 5261 - DNA, 492 bp, Glycine max
atttgaaaaactgagaaaactaaagctggggcagtaaatctttcaacatcaaacatgaaaagcagcaagtaaatatggatagcaacagctgagttcctttgttgtgctttgttcactccatgcctgaacccattaatagctcctaagaatcaatccaggattaataccgactgacaattaacctaataccggctgacaattaaccatagccaaaatagtatactgaaatgtacatcatgaatcttaccagtgaagttgagcagtgctatgctcattcctagtaatcatactcctgagaatgagaaatctgagtgacgatattcatggtccatatcacgatttctctccctgtcacgtgattaagattttgcgtgttcagtatggtagtcatcttctttcctaccacgatcaggatattggttgtaatggtcaccatggtcatctccctcatcatattgcccccttcctcaatgatgctcctagtgatcagga

SEQ ID NO: 5262 - DNA, 375 bp, Glycine max
ttattgcgcttctccggcgctcttcacgaccatgaacctctgcctcacactcactctcactctcggatctcactcgcagatccaccttcagctttcaccatcactactacttattcgctttttctcatggacccatcttcttctcgtccagctgtagttatcgacaatggctccgggtaccctttttctccatttctatcacccactttctcttttagttttatgttgttgtattttttttcttatgtggtgtggacactatgtgtttgttggaaggcccactcatgtttgcttagttttgttactagaattgtctgtaatattgattcatcccaattgggtttagtctgaatttgaaaaatgattttttttttt

SEQ ID NO: 5263 - DNA, 378 bp, Glycine max
tcatcactcgcttcccactccagaagctacgtgccaagcatcaggaccaggaccaccactcgtcggcggagctgtccgccgtggcgaacccgtcccacgcgcatgcgaacacgctcttcttccggtcggcgtacaacgtgcaggtggtggtggacgagaacgagccggaggagaggctcctcaaccggttccggagagaggtcatgagagccggagtcattcaggagtgcaagcggagacggttcttcgagaacaagcaggaggaaaagaagcgcaagaaccgcgaagctgccaagcgtaagagcagaagcaggttcgttcgttctttcctagctgaatgcttaccctctctttgctttttttttttttttttttttt

SEQ ID NO: 5264 - DNA, 1341 bp, Glycine max
ccatttccactgcaatagcaaaagattttgatgtaaaagaacaaattctggtcttctatttcaagatatacagggaaggaaaataatccaccactacaaataagaaaatgaaaagaggtataaatggtaaaccataagcaatgatatttaccatgttacaaatgctgcacgaataagtttctcacccatccacaattgatgtcgcattaaccaagttccaaattgttgaataacatccgtaaatggtatggctgtgtcatgccaaactctggtagaaaaaaataatgataattcaataagtgtcacagttatattgggtgggcactggtggcagaagcaggtaataatcccttggtaactgctacaatagaatgttttctagtgtagtagctttctattgctatcattaagacattaaccttaaattacaatcacacaaatttatttcactagtctaacagattactcatcagttatcagacatatcaaatcatagtaaacactataatctcaagcactacatgaagaaagaaaatcagagaggggttttactgagttgttagattgtttctggtagtaaaaatggaaatgaaaaaaaagaaggttgtatatggatcactagtatgaatcagacaagaaaagcaaaataagcttcatacctgtgaactccaaattttccatattttccttcaacatattcatttattcttcgttcactcatttttgagggcctcacaaacctgttaaacagttaaaggatcaatgcaagtataactttaagataagcaaaaaatgatgattttcatatgtttttttttaaaaaattcaaaagaaactaacctaagaaataacaaaatattaatctcaaataagttgcgtgactcacaagccagctgttgcatttaagggttcaaaactcaagagccaactattccattcatggtataaactatttaaaaaataaataaaataaagtaaaacctaacatctaaatgatacctttctataaaatgattatactgtaagaaagtagtgtcaatgtgctatcctagaaacattctttccgtttaaatattctttctagaactataataaacaacataaagtaaaacagcattgtcaaaagaaaaacagaatatctcaggcaatcactgaacagtgaaccctgcacctgttagatattctataaagtggcagatcaaaacctgtggaaaatgtcttcaacttgcaatgttttcgcactaatcattagaactggaaactcaagaatctcaaccctaccctctaaatcaagcacaaggaaaaagtctagatcctgagagcgtatttgtcaactcagcg

SEQ ID NO: 5265 - DNA, 472 bp, Glycine max
cacatctcccagttgcattgtctcaggtatgagagtaataactgaaatttttagcttattctcacctctttattctgtcattgtattttttgttatttactggttttttgcctgtctcaattatatttgcagctatctcatggaagctcccttggacattcaggagtcaccaatagaggaggtataagtgttgtaggaaaccctggatttagtagtagcacaaatggagttggtggttctattccggggattcttcctacatctgctgcagttggtaaccgaaatgctgttccaggattgggagtaaacccaattttgggaaatgcaggtcctcgaatcacaagttctgtgggaaacatggttggaggagggaatattggaaggactggtggaggattgtctgtgcctggtctctcgtctcgtctaaatttgggtgcaaacagtggatccggtggtttaggtatgcaaggac

SEQ ID NO: 5266 - DNA, 525 bp, Glycine max
gatgctagtgaaggagatgttgcaactctcttcttccacacttcacttctcttctgcgtttcgcgccctttctcctcctttgccattctcgattcaattgcgacgctcgcgccgccctgcaattcgatgcgcttcctcagactccgacaaagtatcgtctcggctgtcgcaggttcagcaccttcttcaacaggccgaacaccgtgctctctccgccgaccagggcccacctcctaaaatcaccttagattaggtcccttatgtctcttcttatcatttttcaaataattattttgttttggtttggtttcagatcatgttacagtgagctttgccagaagtggaggacctgggggtcagaatgtcaataaaggttcgttcgttcgttgttttgtttcattttactttctgtcatgcttaggaggctctttagttgtctttgtttgtgctgattgggcagtgaacactaaggtggacatgcgcttcaacgttaaaaatgcatattggttaagtgacagggtcagg

SEQ ID NO: 5267 - DNA, 388 bp, Glycine max
tgtggtcaggaggcacaatccagggttggtggaatgacacacggatgtggctttataagagaataagctcttacctctttgctttttttgatatcatcttgaagtttttcgggttttcagaatcagcctttgttatatctgcaaaggtagcagaagaaaatgtttcccaaagatatgaaaaagaagttatggagtttggaaactcatccccaatgctcactttacttgcaacacttgcattgctcaatttgttttgtcttcttggaatgttactaaagcaagtattcataagtgaagggggtctcagaatttatgaaacaatggcattgcaagttctactaagtggagttttggttcttatcaatgtacctgtgtaccaaggcctcta

SEQ ID NO: 5268 - DNA, 582 bp, Glycine max
ctccacagcataacggaacaaatccatataagcttctccaacatctgcttttgaaacacctccttgtcaagaacctggcttttaaacatacataaccaagttaaccgcagggatttcaatatgaagatttacgtaaatccaggggctaactagtatgtatgacagtaaaaagaagaaaccttgcaagagaggcctccagcatttaatctagcagctacaatagaagcccacttgccatatgcagcagtgagtccttcaggattgatatcagtcctaccatcaataggggtttctccaattttggacacagcaaaataagccaacacctggtttgcatcttccaaacctttgctctcaagccacggctccagcattccgttctggaagaacaccaaatctaaggcacgaccaataacaactccttaatacagacagcattgtccaaccaaacccaatggaggaaaaaaactacttaccaccccatctagaagaaggtgtagattgaagcacagattcaagatcatcgttcctcgtgcacacaaaaatggggccctcgaaattgagtggtacggactctcctcg

SEQ ID NO: 5269 - DNA, 1449 bp, Glycine max
  misc_feature (555)..(559): n is a, c, g, or t
  misc_feature (564)..(569): n is a, c, g, or t
  misc_feature (571)..(584): n is a, c, g, or t
  misc_feature (588)..(591): n is a, c, g, or t
  misc_feature (593)..(593): n is a, c, g, or t
  misc_feature (595)..(611): n is a, c, g, or t
  misc_feature (619)..(621): n is a, c, g, or t
  misc_feature (623)..(630): n is a, c, g, or t
  misc_feature (634)..(663): n is a, c, g, or t
  misc_feature (667)..(676): n is a, c, g, or t
  misc_feature (678)..(678): n is a, c, g, or t
  misc_feature (680)..(680): n is a, c, g, or t
  misc_feature (685)..(697): n is a, c, g, or t
  misc_feature (705)..(709): n is a, c, g, or t
  misc_feature (711)..(711): n is a, c, g, or t
  misc_feature (715)..(720): n is a, c, g, or t
  misc_feature (723)..(724): n is a, c, g, or t
  misc_feature (727)..(730): n is a, c, g, or t
  misc_feature (735)..(743): n is a, c, g, or t
  misc_feature (752)..(758): n is a, c, g, or t
  misc_feature (760)..(765): n is a, c, g, or t
  misc_feature (768)..(772): n is a, c, g, or t
  misc_feature (777)..(786): n is a, c, g, or t
  misc_feature (790)..(792): n is a, c, g, or t
  misc_feature (794)..(795): n is a, c, g, or t
  misc_feature (800)..(805): n is a, c, g, or t
  misc_feature (808)..(816): n is a, c, g, or t
  misc_feature (818)..(822): n is a, c, g, or t
  misc_feature (824)..(829): n is a, c, g, or t
  misc_feature (831)..(844): n is a, c, g, or t
  misc_feature (846)..(858): n is a, c, g, or t
  misc_feature (860)..(861): n is a, c, g, or t
  misc_feature (863)..(872): n is a, c, g, or t
  misc_feature (874)..(878): n is a, c, g, or t
  misc_feature (880)..(891): n is a, c, g, or t
  misc_feature (894)..(897): n is a, c, g, or t
  misc_feature (899)..(904): n is a, c, g, or t
  misc_feature (908)..(913): n is a, c, g, or t
  misc_feature (915)..(926): n is a, c, g, or t
  misc_feature (930)..(937): n is a, c, g, or t
  misc_feature (943)..(946): n is a, c, g, or t
  misc_feature (960)..(961): n is a, c, g, or t
  misc_feature (963)..(967): n is a, c, g, or t
  misc_feature (972)..(979): n is a, c, g, or t
  misc_feature (981)..(990): n is a, c, g, or t
  misc_feature (992)..(992): n is a, c, g, or t
  misc_feature (994)..(996): n is a, c, g, or t
  misc_feature (1003)..(1012): n is a, c, g, or t
  misc_feature (1015)..(1020): n is a, c, g, or t
  misc_feature (1023)..(1025): n is a, c, g, or t
  misc_feature (1027)..(1029): n is a, c, g, or t
  misc_feature (1033)..(1034): n is a, c, g, or t
  misc_feature (1036)..(1041): n is a, c, g, or t
  misc_feature (1043)..(1048): n is a, c, g, or t
  misc_feature (1052)..(1052): n is a, c, g, or t
  misc_feature (1057)..(1063): n is a, c, g, or t
  misc_feature (1067)..(1073): n is a, c, g, or t
  misc_feature (1075)..(1075): n is a, c, g, or t
  misc_feature (1079)..(1087): n is a, c, g, or t
  misc_feature (1095)..(1104): n is a, c, g, or t
  misc_feature (1106)..(1112): n is a, c, g, or t
  misc_feature (1115)..(1118): n is a, c, g, or t
  misc_feature (1120)..(1134): n is a, c, g, or t
  misc_feature (1136)..(1136): n is a, c, g, or t
  misc_feature (1140)..(1143): n is a, c, g, or t
  misc_feature (1145)..(1148): n is a, c, g, or t
  misc_feature (1151)..(1153): n is a, c, g, or t
  misc_feature (1155)..(1163): n is a, c, g, or t
  misc_feature (1169)..(1170): n is a, c, g, or t
  misc_feature (1172)..(1174): n is a, c, g, or t
  misc_feature (1177)..(1210): n is a, c, g, or t
  misc_feature (1213)..(1233): n is a, c, g, or t
  misc_feature (1236)..(1239): n is a, c, g, or t
  misc_feature (1244)..(1245): n is a, c, g, or t
  misc_feature (1247)..(1250): n is a, c, g, or t
  misc_feature (1255)..(1261): n is a, c, g, or t
  misc_feature (1270)..(1290): n is a, c, g, or t
  misc_feature (1293)..(1297): n is a, c, g, or t
  misc_feature (1299)..(1301): n is a, c, g, or t
  misc_feature (1305)..(1307): n is a, c, g, or t
  misc_feature (1309)..(1309): n is a, c, g, or t
  misc_feature (1311)..(1312): n is a, c, g, or t
  misc_feature (1315)..(1322): n is a, c, g, or t
  misc_feature (1324)..(1327): n is a, c, g, or t
  misc_feature (1329)..(1329): n is a, c, g, or t
  misc_feature (1332)..(1337): n is a, c, g, or t
  misc_feature (1339)..(1342): n is a, c, g, or t
  misc_feature (1344)..(1352): n is a, c, g, or t
  misc_feature (1354)..(1359): n is a, c, g, or t
  misc_feature (1365)..(1366): n is a, c, g, or t
  misc_feature (1370)..(1370): n is a, c, g, or t
  misc_feature (1374)..(1379): n is a, c, g, or t
  misc_feature (1381)..(1387): n is a, c, g, or t
  misc_feature (1390)..(1395): n is a, c, g, or t
  misc_feature (1400)..(1414): n is a, c, g, or t
  misc_feature (1417)..(1425): n is a, c, g, or t
  misc_feature (1428)..(1431): n is a, c, g, or t
  misc_feature (1433)..(1436): n is a, c, g, or t
  misc_feature (1438)..(1445): n is a, c, g, or t
ctgggctgaagtataccatcatatactatgaacatagtgtaggacaaagaatcttttgtatgactgtatcacgtagttttcctattcattacagggaagaatgactcgctccagtacttttccctagtaagatcaagaatcactccaactatctgcatcatcttcatcgcttccagcgaatgcctaattcaataatgaacaatagtttagttagtacttagttggtgctggaagaggaaggggttgaggagcacaagcttgttacaataaataagagagtgaaagagagacctggcggattgcatttgctttttccaggatggcagcgaccctcaagttcgtttttggaccctgaatcctgggtggtcgttgaaccgcagcaggcctcaagttgaatgactgacaaaaaaaaatgtgcatatatatatatatatgtttttttaattttttaaatacaaaaaacaaaagggtacaaggtaaaagttgctggctctctaaccttcgatcttatcatttctaacagtgattctcttccatcttcctttgggggggggnnnnnctcannnnnntnnnnnnnnnnnnnncccnnnnancnnnnnnnnnnnnnnnnntccactannntnnnnnnnntccnnnnnnnnnnnnnnnnnnnnnnnnnnnnnnacannnnnnnnnncncntttannnnnnnnnnnnnaatttaannnnncncatnnnnnnacnncannnntcccnnnnnnnnncccctcctnnnnnnnannnnnnctnnnnnatgcnnnnnnnnnntttnnncnnccccnnnnnnccnnnnnnnnncnnnnnannnnnngnnnnnnnnnnnnnngnnnnnnnnnnnnncnncnnnnnnnnnntnnnnnannnnnnnnnnnngcnnnncnnnnnncccnnnnnncnnnnnnnnnnnncccnnnnnnnnctctcnnnntccctatctccttnngnnnnnatctnnnnnnnngnnnnnnnnnncnannnccccgtnnnnnnnnnnccnnnnnnttnnncnnncacnncnnnnnncnnnnnncccnccacnnnnnnnaatnnnnnnnancacnnnnnnnnncaccccannnnnnnnnncnnnnnnncannnntnnnnnnnnnnnnnnncncacnnnnannnnccnnntnnnnnnnnncttacnntnnntgnnnnnnnnnnnnnnnnnnnnnnnnnnnnnnnnnngtnnnnnnnnnnnnnnnnnnnnntannnncaatnncnnnnactcnnnnnnntccctatgnnnnnnnnnnnnnnnnnnnnnccnnnnnannntcgnnncntnnccnnnnnnnncnnnncnacnnnnnncnnnntnnnnnnnnncnnnnnnacctcnncgcncatnnnnnncnnnnnnntcnnnnnnatcannnnnnnnnnnnnnnctnnnnnnnnnatnnnngnnnncnnnnnnnncctc

SEQ ID NO: 5270 - DNA, 815 bp, Glycine max
  misc_feature (729)..(730): n is a, c, g, or t
  misc_feature (800)..(809): n is a, c, g, or t
ataaaatgccatctagagatacgtaaaactatgtttttgctttgtccctatttcccttcactcttgtaatctaatcttcctggaccaaaacatgatcactgaaacctaagctacataaacatgtcaccttttgagatattacagctattgcagcactcaatcatagcaaattagggtacaaccaatttttgcagctcttcatctttaagttgcttgcttagtcttctttcttatccggttcgtccagcacagccaatctttcaacaaggggaggatgagaatagtgataagcagagtaccaaggatctgtattcatagctgaaagattctcctcctgaaaatgcagatataaatcactttacttcccatcaccaggaacaaaatctccttgcacataatagcatgaggaagaataaaaagtgaaaattgaaaatacatccacaaagcaaccaagaatcactgatctcgccaaaatttgcatcgatgtagttagataaaactatgaccctactagacaaacattttagcaagcacttacaggagaaaaaaaataaaaagcaaaataaatttgtgcatctcaacttttagagaaattaggtatgagaacttttaaaagtttaaatgcataggttgatttttaacatgtggatgaaatttatctcattttgcctttttattttcttctaatactaagcatttactgtgaaatttattcaaataaggcctgtnnaaccaggaaaataatagtataaaagcacagataataaatgtcacctgtagtttcacaagaccaccgcgtnnnnnnnnnncatatc

SEQ ID NO: 5271 - DNA, 407 bp, Glycine max
caacttcgaaacttgtcctcttcttctctcactcctcattccaaaacccttctccatgtctccttgcacgaacacgaacccattcccgaacacctaccacccgacgcaaaatcctcgtcttcgtcgaaaagtaattacatctgggtcaacccccgaagccccagggccaaacaactcgagagtagatcctacgatgccaggtacacttctcttgtaaatctcgcccactccttggactcttgcaatccctctcaagaggacgtctctctagttttgaaggacttaggggatagggttatagagcaagacgctgtaattgtcatcaacaacatgtccaattcccgtgttgtaccctttgttctcaattactttcagcgtaggattagacccaccagagaggtcataaa

SEQ ID NO: 5272 - DNA, 411 bp, Glycine max
tcaccgcctcgaggagagctggttcgcgaagaagattcgcaagttcatgaacctcttctgattttgatgatgcaacgatcaacgatgatgatgatgcataaatatatagtagttatatatatagatacgaatggtaactgtttgtgtaattaagtttgcatctgatatagagatgtatgatgtatgtgtggtttgatgcaccatgatctactactatactattgctactaagtttttattttatgttatttatgagttgttagggatattttatactgtagaataatatggttttactgccatagacacttgtagtggttgatgatgaatgagtatagagaagcgttacttgcaaatcctaatagtttatatcttgcttcatgttggctttgtttgaggtagaatggttaa

SEQ ID NO: 5273 - DNA, 391 bp, Glycine max
ggcctatatagcttagggggggtaatagcatctctgatcatcttggccttgtcattttttaaccaatcatctgaaagtggtttgtatggatggcttgcaattcttggtttggccctgtacattgctttcttctccccagggatgggacctgtgccttggacagttaactcagaagtataccctgaagaataccgaggaatatgtggaggcatgtctgctactgtgaattgggtctcaaatctcattgtggtacagtcatttctgtcggttgctgcagctgtaggcactggccctactttcttaattattgctattatagccgtgcttgcgtttatgtttgtggttgtctatgttcctgaaaccaagggattgacatttgatgaagtggagc

SEQ ID NO: 5274 - DNA, 419 bp, Glycine max
tttttatgaagatctgaagactttgcacttgataacaattgtggtacatttatcacgaccgtggtaagtagcacaaccatggcaaaaggataactgccctccaaacaacaccaaccttctgacaatggtcgtggtaaattccatcatggtcgtagtcaactcataagggccgtagtcaatccacaacgccccagagcttcaacgtcatgactttttgcccatgtcgtaatggatttcatcacggacatagtgtgccttttctgattgacatctttttgagaaattataaatatgggtcgtatcttgtatctttagtaccttttacctagttttgaatttgagaacttttgagggttttgagagttgtgaagtgtagacaacaccgtaaggacaaatcaaaactctcaaaaccctcaaaa

SEQ ID NO: 5275 - DNA, 857 bp, Glycine max
  misc_feature (844)..(846): n is a, c, g, or t
tcagctatccaccacatgttggttatggtttggttggaggtgcctatggtggacttggtgcaggatatgctgctccaggtcttgcacaggtgacatgtttgcattagatatctatagcttgtttccagacccaaaattattctttttatactcttcatttttgtgtcaacagaaatcactattttgatgctaagtagtggcattatagagctactgacttttatagaatccaaatccttattgcatttcatttaaacatgtttaatatattttaaatttcattagaaatcatgcatattagactttatcagtatatgctacaggaagtgtatttacatgcaagttgatctctactatatatgtgctattgattcattatcatattcactatctattaatctgagattctgatgattggagttgtatcttttacagcccatgctatatggaggaggtcaaactccctcaggaatggccatcatgcctatgcttttagctgatggacggattggatatgtcttgtaagtaaaactgttgcaatgatattttgtagattggaagatgttgcaatgatatttggtagattggaagatgttgcaatgatgtttctataaaattccaatggccttatgagacacccaattgcctgaatccaaagcctgagagtttattttattctgcaggcaacaaccaggaatgcagccacaagccccaccctcacatcatagaggtggcaggggcggtggtggcagtgggagtggcaacaggaatgtcgggagttcaagtaagggaaggcacaacaatgatggtggccatgggcgcagatatcggccatattagccgnnnttgatatatag

SEQ ID NO: 5276 - DNA, 667 bp, Glycine max
  misc_feature (594)..(594): n is a, c, g, or t
  misc_feature (597)..(597): n is a, c, g, or t
aaatcgtaagctaatgtggacaacactatttaagtacccatgtttaaaatacattgaatgacttaaaatatgttacttaacttgttaattgcagcttttatttgaacaactggctttttacgcaatgaacaaaaccacacaacaatattgtttgtaggacacaaaacaaccagctgccaatgggccttgcaattgacacaacaatgatgtatgaataacacaaacatcctttacagggataccataaatatattttacttactaattcaaataagctcctagatacacctctcagtgagattccttaagccatttcttgatgtaatcttgacattagccacatctatcctttgcattgagtattgactgcggctcaaggaatccatacaccgatccatgacccaagctattgctccattcatccatatacctattttgaacatttcaaaaattcagttaacatcatgtatatagcgcaccaatatggatttaatagtcaacgacattaattttacttacatggtccacaactgtagtatagctatgttccaacattgtacgtctgatattattttgttgacataaacacatgtnacnaacaaggatgcatctacattttggaattccaatttactaacatcccacaccaactgaacagtcttctcat

SEQ ID NO: 5277 - DNA, 498 bp, Glycine max
ggagatgaagcattgtatgacaaattggattctgcctatcctagcgatgatgagaactcagaggttgctctctcttccataataacccccaacctcacctaaaaaacttatatgaaaaactggttttcattatatacttttgtgttaaatacctttatgtaggtggaggatggtgagcagggtgatgaggcatatctcaagacctataatagcgaaaatgatagtgaaattgaaagtgaagttgaaagtgataatatgtatcctccaatctgaggaatttgcctcacgaagttgaaggtcaaggatcatgcgatttgggggtattccttacgcctgtgtgaatcattaatggcactcaatacattggaccacaggctgattaaggaagaatatgatagctccttcatatcaagccaccgagaagatcaacatgctcaattcaatgatattgtcatagagcacgcaattagacacgatcctgaatctaattggctacaa

SEQ ID NO: 5278 - DNA, 805 bp, Glycine max
  misc_feature (667)..(680): n is a, c, g, or t
  misc_feature (682)..(783): n is a, c, g, or t
  misc_feature (785)..(787): n is a, c, g, or t
  misc_feature (791)..(793): n is a, c, g, or t
  misc_feature (795)..(795): n is a, c, g, or t
  misc_feature (800)..(801): n is a, c, g, or t
aggcaaaatagcagagttaaaattttgattttgttacatgaataaatggaccccactgcagctatcaagagtatggaaacagagtcaacattggtattagcttagaacaccttcaatttttaaaagctacttggcagagaatggcttcagggactacattggcagtcgataaccagattacactgtctgtcaaatcaaatttactcttcggcaacaaagaagggtagtcccctaacatcccaaattaaaaaaaaaaaaaatcaatatcatttacaaggttctgacggtgggaaagaaaaaaaaaaaaaatggttttaaaaaaaaaaggaaaaaagggggtttgaatataccccccaaaaggccaaaaggggatccttttctcaaaattttttttacccaaaacacagccttgaaaaacaccccaaacaatttaccaccccccgggttttgaaaagaagcctttttctagggatatagaaagagctacggttacggctctctctgcaggggccatttgggaatggatttccgggtcttcaatcggcaaaagggacttcataatatcttttcatttatttaaaaggagaggggggtcaaaaaaaggggggggaaattttacggccctaaaagggccattttgggagtgggaatcaaaacccccaaatcnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnncccnnncnccccnncccc

SEQ ID NO: 5279 - DNA, 445 bp, Glycine max
  misc_feature (60)..(61): n is a, c, g, or t
  misc_feature (398)..(398): n is a, c, g, or t
  misc_feature (409)..(411): n is a, c, g, or t
  misc_feature (413)..(419): n is a, c, g, or t
tcgttaccctcttctccgcatgattatagaggacaagcttctgagagaagcaaggcgtcnnaatatatattgaatgatgaactggagtttacttggaataaaatccttgaatcaccaatgttcagtaatagacctctgttaccatatgaagaatggaatattgatttcacagaattgactgttggaactcgtgttggaattggtaagtttcagccttcaccttgtagttattgaattcatatgatatttgcagtgcaattcagtatcacctatgatttaagcatgactgaatttctgtaatgattgcaaatcagtgtctggctgaatcacttgactccaaatatttcttgaggcttgatttctgtatatttgatcttgttgtgaaagacctaaaacanatctgggtcannntnnnnnnnatcccgccagaaattttcttaatttt

SEQ ID NO: 5280 - DNA, 410 bp, Glycine max
ggctggagtttcaagcacagagtggccattgataggttggttcaattgagagttttccttgaagctgttgacaggtatgcatttattctctaatgaaacgttttgtatttttatgtttctgtgaaaatgaaaagtagacatttgtgctttgtaatggttcaagtttattcaattcatttcaaatgacaattggataaatgctgctcttagtatggagagtacacgccttttttgcatcttgtaatttgtttaattgtctttgtgataaaatcttattttatttttgacatgttgtagttcgacggaacatatttgcttatctgatttgcatgctccatggcatgcatgatatttgtttgctttctcctttgtttctttcagaacatatttgtgtaaagttatcaatcgct

SEQ ID NO: 5281 - DNA, 478 bp, Glycine max
cacgaaggtttatcctccgcaggtaaaattacactttacgtattatctcttcatgttaccaactaccaagtaactcgaaccggatacctatgatttctgactaactaactgagagtatgttatctgtaataggtactggaattctggacgaagcggagcgcgtggggatgaagcgtgtcacaaccttgtgtgttcatgttatcgttcaacgcgcagggtgggttagtgaaccagtttccgattttgataaagtggctggggagggtttgcacaagcagctggcggaggagatcaggagcgttgttgcagcatgtagttggggaccattgttttcagccaagctggagtgctcttcagtcatggattaagattagctatatattggtcatggctttaggcatatattatatggggattactattcacccaaatccatttgttattggtccctattaaggggttcacactatttctttcc

SEQ ID NO: 5282 - DNA, 449 bp, Glycine max
agaagatcttgcttgggttgaatcctgcctagttaaagattctgatatttcagacactgattggatccctttgaaaaatgctttattagatattatcagctcccaacctcaatctttcagcactgaaggagaagacgttaaaattcctccctacattattagttctgaatatgctaatactgcaacaacttctgatgagaaacttaatctgcaatcttcaacttctgatgagaaacttattattctgcaatcttcaacttctgatgagaaacttattctgcaatcttcaacttctgatgggaaacacttatctgagccttcttcaacttataatgttaattcattactgatggcagtagagacaagcaccgatgaaattccagatgatgaaaagactggtactttgccatctatcaatccttttctgccaacttataaggaacacctga

SEQ ID NO: 5283 - DNA, 380 bp, Glycine max
atgggtccagaaggccaataccacttcttgttgcaacttttgattattatttctttgagtacaaccctaatgggaattggcttccctaagagcttcttggtctgctttgtgcgttctgtcagcataatcttccaaggtgtgtggcttatggtcatggggttcttgctttggacaccagggtttcaagccaaaggttgctccatgcaccttgatgagtctgatgaatatgtggttagatgcagtgatcatgagtcccttcatcgtgccatctccttggtgaacattcagttcagcttcttgttgattctagtcaccattttcgccatgtctttctacttgattctggtcagaagatatggtggtgagaaagtggagtatgt

SEQ ID NO: 5284 - DNA, 496 bp, Glycine max
ttttaaaacaacaacacaggagacacagagaacaaggattaattcatatcagagagagagagaagatgggaactgttactcgcagctcctctgaagtgtatacaagcgacagtgaaaaggggtttgcgatgaaccactctacttctacttccccagagctagatgctggggcaaagtttgttcttgtatctcgaggtgaggctgctttttcctttttattcaatcatggttgtgatgaacaaaagcaaagacttttcaatgaagatgagaaaaaagggtgtttgtgttgatgaattgttcacaatatgcaggatcatggttgcactgtgggtaccatttgactacatctattgtggctcctgtgcttcttactcttcctttctccttcactttgttgggttgggttggaggagtgctttggttgacccttgcagcagttatcacattctattcatacaaccttttatctgtggtcttggaatatcatgcacagctt

SEQ ID NO: 5285 - DNA, 370 bp, Glycine max
ggaaattgctcttataagtaaatttaaggaagcgatagtacacttttgttacttgaaaccctaaataagaagactcattggattgttgttaaattggtaggaactaatcgttggagttatttgatgtatttggtcaggaacatttgtttagttaatttgatatcgtagggtgagttattggtcaaagactagtgcacagatacatatttgataaaattggaatcttaatttgtaatatcttgtacatttctgtttgttgtaaacttgtaatattctttgttttaaaagattattttattgacacaatgattttgcatctgtgaatgaaaataagtcttcttccttttgcagggaagactgtttatccaac

SEQ ID NO: 5286 - DNA, 379 bp, Glycine max
  misc_feature (263)..(263): n is a, c, g, or t
accctcaatccctacctattcaaccacagaaacaccttcaatgaagattaaatccagtgaaatgccctttccaaatagtaaaatgactatggctacaagttccacaaccggagacaaactttctagttcatttactcctgagtcctggggaaaaggcttcccttcctctgggtcacatttatccactatttctgcaccctcaaccttccttggaaaagttaccgagttccatgttgaaacatgcagcactgtgatccccctcngaggcggtttccattggagaagggtgttcctccaccatggtggcccacagggaatgaagagtggtggccccaaatcggtttatcaaaagatcaaaattctcctccttacaaaaaac

SEQ ID NO: 5287 - DNA, 1327 bp, Glycine max
  misc_feature (483)..(484): n is a, c, g, or t
  misc_feature (487)..(490): n is a, c, g, or t
  misc_feature (504)..(508): n is a, c, g, or t
  misc_feature (514)..(524): n is a, c, g, or t
  misc_feature (537)..(539): n is a, c, g, or t
  misc_feature (543)..(544): n is a, c, g, or t
  misc_feature (548)..(565): n is a, c, g, or t
  misc_feature (567)..(570): n is a, c, g, or t
  misc_feature (575)..(580): n is a, c, g, or t
  misc_feature (582)..(586): n is a, c, g, or t
  misc_feature (594)..(600): n is a, c, g, or t
  misc_feature (602)..(606): n is a, c, g, or t
  misc_feature (619)..(624): n is a, c, g, or t
  misc_feature (631)..(635): n is a, c, g, or t
  misc_feature (638)..(655): n is a, c, g, or t
  misc_feature (657)..(658): n is a, c, g, or t
  misc_feature (660)..(661): n is a, c, g, or t
  misc_feature (663)..(678): n is a, c, g, or t
  misc_feature (680)..(687): n is a, c, g, or t
  misc_feature (689)..(689): n is a, c, g, or t
  misc_feature (695)..(696): n is a, c, g, or t
  misc_feature (698)..(702): n is a, c, g, or t
  misc_feature (705)..(714): n is a, c, g, or t
  misc_feature (716)..(723): n is a, c, g, or t
  misc_feature (725)..(747): n is a, c, g, or t
  misc_feature (750)..(758): n is a, c, g, or t
  misc_feature (761)..(764): n is a, c, g, or t
  misc_feature (767)..(770): n is a, c, g, or t
  misc_feature (774)..(787): n is a, c, g, or t
  misc_feature (789)..(804): n is a, c, g, or t
  misc_feature (808)..(811): n is a, c, g, or t
  misc_feature (815)..(815): n is a, c, g, or t
  misc_feature (820)..(824): n is a, c, g, or t
  misc_feature (832)..(839): n is a, c, g, or t
  misc_feature (842)..(843): n is a, c, g, or t
  misc_feature (850)..(856): n is a, c, g, or t
  misc_feature (858)..(864): n is a, c, g, or t
  misc_feature (866)..(880): n is a, c, g, or t
  misc_feature (884)..(896): n is a, c, g, or t
  misc_feature (898)..(911): n is a, c, g, or t
  misc_feature (919)..(922): n is a, c, g, or t
  misc_feature (926)..(928): n is a, c, g, or t
  misc_feature (933)..(933): n is a, c, g, or t
  misc_feature (939)..(947): n is a, c, g, or t
  misc_feature (949)..(949): n is a, c, g, or t
  misc_feature (951)..(953): n is a, c, g, or t
  misc_feature (955)..(957): n is a, c, g, or t
  misc_feature (959)..(961): n is a, c, g, or t
  misc_feature (968)..(976): n is a, c, g, or t
  misc_feature (990)..(991): n is a, c, g, or t
  misc_feature (993)..(993): n is a, c, g, or t
  misc_feature (1001)..(1008): n is a, c, g, or t
  misc_feature (1012)..(1020): n is a, c, g, or t
  misc_feature (1022)..(1064): n is a, c, g, or t
  misc_feature (1066)..(1071): n is a, c, g, or t
  misc_feature (1073)..(1077): n is a, c, g, or t
  misc_feature (1081)..(1091): n is a, c, g, or t
  misc_feature (1095)..(1096): n is a, c, g, or t
  misc_feature (1098)..(1100): n is a, c, g, or t
  misc_feature (1104)..(1107): n is a, c, g, or t
  misc_feature (1109)..(1112): n is a, c, g, or t
  misc_feature (1114)..(1116): n is a, c, g, or t
  misc_feature (1118)..(1145): n is a, c, g, or t
  misc_feature (1147)..(1152): n is a, c, g, or t
  misc_feature (1160)..(1178): n is a, c, g, or t
  misc_feature (1180)..(1191): n is a, c, g, or t
  misc_feature (1194)..(1212): n is a, c, g, or t
  misc_feature (1217)..(1218): n is a, c, g, or t
  misc_feature (1221)..(1229): n is a, c, g, or t
  misc_feature (1231)..(1231): n is a, c, g, or t
  misc_feature (1236)..(1238): n is a, c, g, or t
  misc_feature (1240)..(1252): n is a, c, g, or t
  misc_feature (1263)..(1266): n is a, c, g, or t
  misc_feature (1270)..(1275): n is a, c, g, or t
  misc_feature (1282)..(1284): n is a, c, g, or t
  misc_feature (1288)..(1290): n is a, c, g, or t
  misc_feature (1292)..(1293): n is a, c, g, or t
  misc_feature (1297)..(1304): n is a, c, g, or t
  misc_feature (1306)..(1307): n is a, c, g, or t
  misc_feature (1310)..(1310): n is a, c, g, or t
  misc_feature (1319)..(1319): n is a, c, g, or t
  misc_feature (1321)..(1323): n is a, c, g, or t
aacaatgttatctgtagcaattggaagaaatggaagcaacctatcatatggtaaggtgagaatagtcttgttaattattagtctcacaagcaacataaatgagcataaactttatgttttaggtttcatggaacagtagattctgtggcggcacagtttttcttaaagaatatacactctcagatgagaactgctgctctcaatttgtttagtgacccgcaagttctaggtatacggcctaatgtttttggggagctcatgagggttctcatatttccttcagaagatgttgaggcagctgtcaattgggttattggtggtggggagaatcctgacatctcattgcatatgcggatgcttatgaataggtaatggaactatggaagtatgcgttaatttctttgagtggaaatcatcatgcttgattgatgaattaactgaagaaatttctgataaaatggttttacttttactacttttgannagnnnntttaatacatcttnnnnngaactnnnnnnnnnnncaaagagtgtttnnntgcnntttnnnnnnnnnnnnnnnnnnannnnaaatnnnnnngnnnnnagtaagcnnnnnnnannnnnttgtcgaaaacannnnnntcttttnnnnnatnnnnnnnnnnnnnnnnnnannannannnnnnnnnnnnnnnnannnnnnnntntttttnncnnnnnttnnnnnnnnnntnnnnnnnntnnnnnnnnnnnnnnnnnnnnnnntannnnnnnnnctnnnnccnnnntccnnnnnnnnnnnnnntnnnnnnnnnnnnnnnntatnnnntcanaaccnnnnncactattnnnnnnnnacnntcaccannnnnnntnnnnnnnannnnnnnnnnnnnnnaatnnnnnnnnnnnnngnnnnnnnnnnnnnntaaaaccnnnntttnnnatcancttttnnnnnnnnnanannntnnntnnnttgtaannnnnnnnnttaaattttcattnnangcttttannnnnnnnttannnnnnnnncnnnnnnnnnnnnnnnnnnnnnnnnnnnnnnnnnnnnnnnnnnntnnnnnntnnnnntccnnnnnnnnnnnactnntnnncttnnnntnnnncnnntnnnnnnnnnnnnnnnnnnnnnnnnnnnntnnnnnnccaccccnnnnnnnnnnnnnnnnnnncnnnnnnnnnnnnttnnnnnnnnnnnnnnnnnnntcaannccnnnnnnnnnanaattnnntnnnnnnnnnnnnnctaataaaaannnntacnnnnnncccccannncccnnnanncaannnnnnnncnnatnctccttcantnnncccc

SEQ ID NO: 5288 - DNA, 571 bp, Glycine max
taaaagtgcgtgaggttgaagcaaaagagttgtcgtgtttgtttaggtttaggaaaggaaagggttttgcggtggttactgtcaatggcgacggcggggttgtatcggcgccttcttccttgcccccccgccgtcgagtttgcttcctcacaaggcaaggtatgagaatgggtgcagtaaatgttaacattttgactttgttagatagtatcatgtgttttttactcacctttttttgtttgattgaatgccagcaactatttcttgaatccattcagaatggaaccatggaaggcttctacaagttggtttcctatttccaaacgcaatccgagcccgccttttgcggcctcgctagcctgtccatggtcctcaatgctcttgccattgatcctggcagaaaatggaaaggtacataacaaacaatctaatgcttccatcactaacctaattaattatgaatatttgcttgaatcatttaatcaattgtctcgagttctattatttgccttgcaggaccttggagatggtttgatgaatctatgttggactgctgtgagcctctagaaac

SEQ ID NO: 5289 - DNA, 885 bp, Glycine max
  misc_feature (34)..(37): n is a, c, g, or t
  misc_feature (238)..(239): n is a, c, g, or t
tgctgatctgagtagtatgaaggaaaaggatacnnnnttttgacaatgcagcaatggaattttcacttgaaacattgcaaccaacttatagaatcctttggggatgtactggtgattcaaatgcgttaagcatagcacaatctattggctttgatagaaatataattgatcgtgcacaaaaatgggtagaaaagtttaaaccagaacagcagcaagagcggagaggaatgctctatcnntcactacaggaggaaagaaaccagttaaaggctcaggctgaaaaggctgcatctgttcacgcagaaattatgagtgtgtacaatgaggtacaatctagatgttttgctaggaagagatcctttgtttcttgattatatttttttttccttggtcaatgtagtattacaatcaatagtgttcctttccaagttcatatgaattttgcatccttaataagtaatgagttggtaaattgactggaaaatcaaagagtgatggggatttgtacaagtttgtagattaacacaatatttagtaccttgtgaatagccaacaagtggctttctggttgggaatggcctacaaatgttaatttcaatatctttgagggacttacctctaagaatatggctttctggttgactacatgcacaattataatatacaatatgtacatagatttttccttacaaaatgctcatatttcctttattgctggaaattttttgttcagcaaaagaatgcttgagcatttgccagcagactttaattgaatatcatcatatttggagttgcttatttttttcctttttttccttctttgccttttttttaattctttttaatattgcaaagatccaaggggaggcagaagacctgatcaac

SEQ ID NO: 5290 - DNA, 845 bp, Glycine max
agtgtggcttccagtatccacttcaagaatcttgtcactcttctcatcatcaaggcgtccaatttttaatgaagcatctctagtttgtctccatgaattttcttccatccaactatctaaccaatgggaaccaaaccgggctttctccacgtctatgtccctaaaatttgcattggaactacatctctgcaagttgaaaatggggaatgcaattaaagtgggaattaaattcataggttgatcatccaagtgatgatcccttgaaaatggacaatgcttggagtaatattatgagcaagctagaaccatgtgtaccttgagaatagatccatcaaactttgtactataggcacgaagtgagtgcttataatcttcagggacctaaattattcaaaacaaaaataataaaaaaaaggttcaaagaaaagattaatggttaagaatttatgagctatttgatgagccacatattaatgattaccattaccacaaggttacgatccaacctaaagattatctaaagaaccatgctctagcaccagtttaatttgcaacatgctgttctatactgggtggaaagttattctgtaatagattcctaattgcaacatttggtggggtgatagaaaaaagaaaaatagttaaagaaaagtccattaacaaagataacacgtttgaagaaagtgagatgccatgacaatgccatcacatagataaggatcatgtgtgtgtgtgtgttcactttgcttacagggtaatgagaaagtggagacttgaaagaatgcatattatctgacaagttccctcgagttgcacgtgcccgagactgcagtctcaccaaggtg

SEQ ID NO: 5291 - DNA, 408 bp, Glycine max
ttttttttgaatcttcttatacatcccaaaaaaacccaataaaaaaggggtctttagaaggttctggttgatgggtaggagaggaatcaagctattcgatgaagaaaggaacggtcttttttcaatttccaattttgggtctcaatggggtggtgttagaggtgatggtgttcaagaccctgtgaatttggctgtgtatgcaagcattagtcaaatgggaatggggtttggtgttcaagaaccaaacccttcttcttcttcttcttcttctgatggtgataattcccaacacaacggtggcatgagcatgagaatgaggattccgtgcaccgagttgtacgttcggtacgtgcaatccgaggggaaggtgaagattctgggggttcctgaggaggaggaggaagaggt

SEQ ID NO: 5292 - DNA, 377 bp, Glycine max
acgcgtcgattcctcttccctctctcccatgccatcgtccctccctccacccgcgtcgccggaatccggtgccgcgtcaaccgcgccggcgactcagcgtactcgccgctgaactcagcttcgtcatcgtcgtcgtcgttcagcgaccggcctcccacggagatggcgccgctctttcccggctgcgactacaaccactggctcatcgtcatggaccatcccggcggcgagggagccaccaagcaacagatgatcgattgctacatccaaaccctcgccaaggttctcggaagcgaggaggaagctaagaagaagatttacaatgtttcatgtgagaggtactttggtttcgggtgcgaaattgatgaagagacttc

SEQ ID NO: 5293 - DNA, 909 bp, Glycine max
  misc_feature (643)..(643): n is a, c, g, or t
  misc_feature (645)..(645): n is a, c, g, or t
  misc_feature (647)..(652): n is a, c, g, or t
  misc_feature (658)..(658): n is a, c, g, or t
  misc_feature (660)..(660): n is a, c, g, or t
  misc_feature (664)..(664): n is a, c, g, or t
  misc_feature (670)..(671): n is a, c, g, or t
  misc_feature (678)..(679): n is a, c, g, or t
  misc_feature (681)..(684): n is a, c, g, or t
  misc_feature (689)..(697): n is a, c, g, or t
  misc_feature (705)..(708): n is a, c, g, or t
  misc_feature (710)..(711): n is a, c, g, or t
  misc_feature (720)..(723): n is a, c, g, or t
  misc_feature (733)..(734): n is a, c, g, or t
  misc_feature (746)..(747): n is a, c, g, or t
  misc_feature (749)..(750): n is a, c, g, or t
  misc_feature (753)..(754): n is a, c, g, or t
  misc_feature (765)..(765): n is a, c, g, or t
  misc_feature (768)..(773): n is a, c, g, or t
  misc_feature (775)..(776): n is a, c, g, or t
  misc_feature (780)..(783): n is a, c, g, or t
  misc_feature (789)..(800): n is a, c, g, or t
  misc_feature (803)..(803): n is a, c, g, or t
  misc_feature (822)..(822): n is a, c, g, or t
  misc_feature (837)..(840): n is a, c, g, or t
  misc_feature (852)..(858): n is a, c, g, or t
  misc_feature (866)..(869): n is a, c, g, or t
  misc_feature (876)..(877): n is a, c, g, or t
  misc_feature (882)..(883): n is a, c, g, or t
  misc_feature (895)..(900): n is a, c, g, or t
gaataaatcttagggaggagtcggcgtgttcacacttccaacccaatcgggctgtcaaaacgacgacgttgacagcccggttctctggagatagacagatagatataggtacattcccagtttcaggtaccattcctaaggaataatcttttccgaaaccgaatatccctattattattcacattttttttttgttattattcttctctgttccgcgaatttcctacgggggatttcggatttcggcggggcacgtttttcttctccttccaattggggataccaaccccccctacccttttgattcttccttaaggggtaatctttgttttccttaaagcattgttcttttgcctaaattttagaattgacgccggattctcattttaggtcgggaattttgattctaaaaaaggacaagggtggctacttgtgggggttgggctgaagaattggtttgacaagcttttgcgttgagttgagttgggtggagtttagaatctgcaaggagttcgttttctggagccattcaaaaacctctggggggggcggccgcagtggcggtggcttctttctctgctgatctctccaaaaaattgccatcacgggattgttctacctccaatttggcacattctactcntngnnnnnnaaaaanancctngggganntaaaaannannnnaaaannnnnnnnnataaaaannnnanncgggggggnnnnaaaaaaaaanntagggaaaaaanngnngtnntaaggaaaaanaannnnnnannccannnnagggannnnnnnnnnnnggnaaggggggggggggggatncccccaattgggaannnnaaaaaaaaaacnnnnnnncggaaaannnnaaaaaannccccnngaaaaaaaaaannnnnnaaaaaaaaa

SEQ ID NO: 5294 - DNA, 667 bp, Glycine max
ctgattggaatgaaggtatgcatacattgattgattttgctaaatcatatacagagaaactgaaacttgtttctgttgaagttaaaaatgaggaaatactcaatgctttaccaaattaagagaaatttccacttgtatgtttcaggtaaaattatatattataccatgcccccaaatagggatcaaggggaaccttcagaggccaatatagtttctgatttttcaaaagagtttaacattgatgaagtttacagcagtgaatcttcatatattgggagccttatatctgttgataacttcaatgctgttgaagttccttcaagtcaccctctcactcttgatgagatgatgttagaggtatgtttcttgaagatgtttaaacttaggagaacatgcctagggaattgactattgttgatatcaatcatactcgtatttttagtcctttcacatttactaattaacccatcctcttacaaactatgattttataggacgagacacaaatcaaaccagctgaacaaggtgaaggtcctggaaacctggctgaggttgatgaatcaatggaagaagatgatgttggcaagaacaaggggaacagtgaagctggcatgcaaaatgaaaaattatatgctgcagatggtatgcttaatacaaaaatgaggcg

SEQ ID NO: 5295 - DNA, 383 bp, Glycine max
atatttataagaaacagcaagcttgagtagtcaacctttggaactgaacagcctggagatttttcacaaggacactcacctaagctgatttggatatttacaataagcaacaagcttaagaagttagtcttttggagctgagaagctggggaattttggactgcattatgtgttagggttaacagcatcatactactacattagcaatgttatgtagaatttgtttgaatgtcaaattagtttttgttttggggaagggggatttagctgtatggtttggtactttaatgttaaacctaaaagaaaaaaacatgtatgaaattaacagatgtatgtttttattcaaccctaaagttgggaaatgggaatgataggaagatgag

SEQ ID NO: 5296 - DNA, 404 bp, Glycine max
cgcctcgcagtcccagcctccgatcgcaacgccggcgttccgcgccttcatctcccgcatctcctcgtccctccgtcacgcctttgcgcagcgccgcccgtgggcggagctcatcgaccggagctccatgtcccgacctgacaccctcgccgaagcatactctcggatccgcaagaacttcggctacttccgcgtcaattatctaaccctaatcgcgctcgcgctggcggtctcgctcatcacgcatccgttctcgctctttgttctctttggcctcctcgcgtcgtggtcgttcctttacctctttcgcccttcggatcagcctctagtgctcttcggacgcaccttcgccgatcgcgaaaccctagggatcctcgttgtgctcaccgtgttcgttataaaaa

SEQ ID NO: 5297 - DNA, 412 bp, Glycine max
taaacagagttgagatgacagacacatattattacgatgagttcccttccagagtaagcaacttagcatcattgatttgagaataagcccttgtgtgtgtcttattatttgtataatttgtgagcaggatgtgtttgaaggagcatgtgactgtgctagagaatggaatggtttgttgtgggaagattcaaagaagatgcatatggttgttaagaccgaggtacatccgtatgtacgagattatttacgccgtcaaaagtaacagcaaaggcaacaccatctcatgcatcctggtcctgccaacatgcaaatggaaaaccggggggaaaatgcattttgagctccttttagaatttttttttaaaaagaatgtatttgccttcaaggtaattagttttgacttccttttttt

SEQ ID NO: 5298 - DNA, 376 bp, Glycine max
ttttcttcttctagaaaaaattacagaccctcatcccagagagttagctgtatgcattgcgagacatatcagaaattcattcagttttctggttgcggttggccaccttccattatacttgagggagattcttcaagggcacaagctaccttagaggctgaaattgcggctgcgtataatttgaattctggcatttgctgcatctgaatatctctgaaactttgtaagtcaacatggctttacagaacattggtgctgcaaacagtgatgatgccttctacaggtataagatgcctaggatgattaccaaaattgagggcagaggtaacggcatcaaaactaatgttgtcaatatggttgatattgccaaggcaac

SEQ ID NO: 5299 - DNA, 369 bp, Glycine max
atctctgactcctgcttaggactctcactgtctaaagccctcttctcttgctcttcctcctcttcaaccccattattcaccctcagaactccatttttttcattcatctccgctctcagcttcaaagtctccaacaactcctccaccgccttctctctcttgcgtctgttcttgatcaaaacctcgcttatatccgccggagtcatccgggccacgtcgacaacctcctccagccgcttcaaaatcgactcctcaagctcacactcttcacaccccaagtaattcttcagcagaatcttcagcgcggggaaagaacagtaactcatgaagatatgcatatccattctcccactccgcagcagagcaggg

SEQ ID NO: 5300 - DNA, 406 bp, Glycine max
tgtctggtcaacaacaccaaaaagaaactaattcattcaccatcaccatcaccttcaccatcaccatcaccatcaccttcaccttcaccctcaccttcaccttcattatcatcgccatcaccttcaccacttccaaataatcaaggtgttactcgtagttcaggcgctgaattcattggagttatgatgtggttgggggtgatgatgttattgctttaaattagagagtattgtgtatttacatgttaatttctccataactaatcactatatatgcaatatatatttgtgtggttagttaattaggtcaagcatgcattttcgctttcatttttgtatttttttaagtctggaagattttctattgattgtgcaattgtgcccttaaactccaatgcctactcgt

SEQ ID NO: 5301 - DNA, 382 bp, Glycine max
tccggttgtttattctcaaatctagagtctgtcttggttttcatgaaattcaaatttccaagctacatgattccatgctgtgcattccattttgttcatttagtttttgccttgttggtgttgtatgttcattattttggagatgaattgataatttctctttatctgaacatctgattcttatgtgattgagacttgagactttgagagatccttgaagcttatctgccaataatgctcacttgaatgcgtgattaagcgtttaagcaaaataattgacatacggggttgtggggtgcaaaggtgcaattacacttcaatattcacatgatcgattttatggtacaaaggtgcttggtgaatgtcgtcaattctggtcaca

SEQ ID NO: 5302 - DNA, 372 bp, Glycine max
caatagccttttaatgtgaatttttggggtggaagatgcagttccaatcatgcacttagcctctgaggatgatcagaaaaatacctttccgaattgtttatgaggaaaatacatggagacctgaactgaagaggcaatggctatgtagtggcttcttatacgtaggcattctggcttcaaaatattaacatgtacgtctaatgtttgtatggaatagtttcaaaatgtgtagttctttatgttcttgttcttttgtccttgtgtaattacgctggattatttattattgtagaatatagatttggtccatccaaattagatgattattggagactatcaatgttgtacactttggaagtgaagaaagcaggc

SEQ ID NO: 5303 - DNA, 557 bp, Glycine max
  misc_feature (412)..(423): n is a, c, g, or t
  misc_feature (437)..(451): n is a, c, g, or t
  misc_feature (455)..(458): n is a, c, g, or t
  misc_feature (462)..(463): n is a, c, g, or t
  misc_feature (470)..(473): n is a, c, g, or t
  misc_feature (477)..(480): n is a, c, g, or t
  misc_feature (482)..(485): n is a, c, g, or t
  misc_feature (492)..(492): n is a, c, g, or t
  misc_feature (494)..(494): n is a, c, g, or t
  misc_feature (497)..(506): n is a, c, g, or t
  misc_feature (509)..(517): n is a, c, g, or t
  misc_feature (519)..(519): n is a, c, g, or t
  misc_feature (521)..(521): n is a, c, g, or t
  misc_feature (525)..(529): n is a, c, g, or t
  misc_feature (531)..(534): n is a, c, g, or t
  misc_feature (536)..(537): n is a, c, g, or t
  misc_feature (542)..(544): n is a, c, g, or t
  misc_feature (547)..(549): n is a, c, g, or t
attgctgcattggagctggctatgttggtggcccaaccatggctgtaattgccttgaagtgtcctgagatcgaggtggtcgtggtggacattgctgcaccgcgaatcaacgcgtggaacagcgaccacctcccgatatatgagcctggccttgatgatgtggtgaagcagtgcagggggaagaatctcttcttcagcactgatgtagagaagcatgttgccgaggctgacattgtctttgtctcggtgaacaccccaacgaagactcagggtcttggagccggcaaggcagctgatctcacatattgggagagtgctgccaggatgattgctgatgtatcgaaatcggacaagatcgtggtcgagaaatcgactgtgcctgtgaaaacagctgaggcaattgagagaatatnnnnnnnnnnnngtcccctcccctcnnnnnnnnnnnnnnntcannnncccnncacccannnncctnnnnannnnccccccntnacnnnnnnnnnnccnnnnnnnnnantncctnnnnncnnnncnnttacnnnctnnncccccaaa

SEQ ID NO: 5304 - DNA, 369 bp, Glycine max
cagtcattgattgatacaaggagccagctactacacagatcactggttgaggaggtgaacaaaagaaggctattctacacagttggagccgtggaaaatattggatttgtgacaccttatgaggttaccaacaaaaagtcacatccagcatgcggtgcttttgatgtgaactcttctagaagtagcaagagagaaaactttaatagagagaaatttttttagaaatggttgtctcttgagctttggagtcaaagaggagaaaatggataacttctgtgtcatggactagagaaaatgataaggctgatgtgctatggagttattattacacttacaaagaataatggtactatttggaaaaaatcgttg

SEQ ID NO: 5305 - DNA, 375 bp, Glycine max
ggttgcattattgcatatttgctataaccacatatggggatccagacactgttcgtaggtaatggaagtttagttgtttgtcttccttttattattatatatttttttgcattggtaggttttgatttgatattccattcactaggatcagctgtttcttgcctgctttctaacataatttcagaatgcgtgcaacagtgatatctcccttgtatggcggaaaagctttgatgggattgcatgccagaatgttttctattctgatgtttaaatcctatgctttaagtccactatttgtggtagtttgaaaattttaggatcattttctccaatatacttttttcatttaatttcaaagtacatagttttctaggt

SEQ ID NO: 5306 - DNA, 371 bp, Glycine max
agcagagttggtaaacacaggactgcagggattatgatggagcacattgaagggcttgaggttaaaaatgttgaaatgagatggtcaaacgatcaactagagcagtggaataatcctctagagttcaggccatctactgtgaataacatctctttccttaattttaattctggtttgtatacaaatagcaaatcaaattattaactttgaatctgcaaagggagaatgtccaaatcattggctgcatgtcaaccatcaagggaacggggaaaaagttcaaaagaaagggaggagcatttgctctgtgcattataaaaaaaaaaaaaaaatcaactgttaaaccttgatctagggtttctttttctaaaaaa

SEQ ID NO: 5307 - DNA, 304 bp, Glycine max
gtgtcattatggcataaaatgaagaccgagtttcaaaggagatggttttatttcgagttcccagtattaactgatcatatacttatatttggtgaaaggcagattaaatttgaagataatgtggatgaagtagtttcagaaaatgattggaatcatgtagtggtctctgttgatgttgatttcaaatggaacccaacagagccgcttgttgtgcggactggactccatgtaatcaaaccaaaaagtagcgtggaagatattcgattcattgatccttataaacccaccttcttataaagaaaaa

SEQ ID NO: 5308 - DNA, 245 bp, Glycine max
ttctagtactactactgctctctctgcaactccatgccaatttttcagggctcatgatggtggcctgaactagtgggcaaataaagaccacagtgaaaagagataaccccactagtcataaaagggagagaagagaaaagaaagaaaaaaaaagagaggggctttatgagttatgaattatcatcatcacccgacttgcttttaacttttttttctttgtttgaattttcctttttttttttttt

SEQ ID NO: 5309 - DNA, 1166 bp, Glycine max
  misc_feature (55)..(57): n is a, c, g, or t
  misc_feature (647)..(647): n is a, c, g, or t
  misc_feature (1109)..(1109): n is a, c, g, or t
  misc_feature (1142)..(1144): n is a, c, g, or t
gctaggactgatggtgcaaagggatttgtcaagtaatctatatagatgatagatnnntttcatcatttagtttctttagtagataaacacgagtcttattaggaccccaactatttgataagtctaacaatgtccattgatatccatgtttgagtttatacctatagcttccatattgcaatatggtggtaaaagaaagaaaggtagaagtttaaccaaggttcatatgtacaatcatgttgtttaagtatagtgatgtcttccacatttccacatggtatgcctactaggtgggaattggatgacaaagagtttgttcctctttttttatttaaaaaggtgtaaccatgttctattttgttttattttttttcaccttgctttttttggatattttacttgcaggggagcaattgggcagccaagattactggttcctgttgttttggtcatggtctataaccgctggaatgcgtaagttctcatttgatatgttattgcaacaattattattttgtcaacgaagttaatttaatttgcaaacaagttttcttgatcttttctaggttttccaggtatagctcttctcttgcttttgttttttgtctcatatttgatttaaattaatttagagaaacaatctttcntttcatttttaccaacttactgaggaaacttttgaaaaaaagggattatatcctacaaaataacctttcccaaacattttgattaggttttatacacacagatatatattaatgatataatgtttagacaagatatccaaatacattgatgtttgagtgatgtattattgattggatgccatctatgccaatgacttctaggtctaatggcacttctttctcttttagtttcctagaataatggtcaaaccctgtcttttcttacaggattctggttccagaatttggatctatgcacttagaattgataccaatgctagtaggttttttcacatacaagattgcaacttttgctcaagctatagaggaggcaattactgtagctacaagaaagacctgaagaatattaggggtggagggggaggatgccatgtcattatatttgggtttttctctcccacntaatgggacatataattgtatttatgtttttcnnntatttggattattgattataat

SEQ ID NO: 5310 - DNA, 344 bp, Glycine max
tttggctggaatggcagcaaaagcaccaacagcagccaaggaggagcaaaagctagaaaaaactgtgtttgaattgaaactggagtcctatgaagcggcttccaaaattaaaatcatcaaggaggtccggggctttactgatttaggtttgaaggaagcaaaggatttagtggaaaaaacaccttctgttataaagaaaggtatttcaaaggaagaaggggagcagataatagagaaattgaaagctcttggtgcaaaggttgttatggaatgaagtgatgtatgttgtttcttccagctttcaatattttagttgtctgaaatttaaaaaatttcagatcgtt

SEQ ID NO: 5311 - DNA, 344 bp, Glycine max
  misc_feature (337)..(339): n is a, c, g, or t
tggggttaactcagaaattgaatcacataaggataattctgacacagatggcagtgacattcagggctctagatcagaaagcggaaggtaacagcaggcatgaccaagagaatgtattcttttttaggatcagtggggtgtataaagtgagtgattttttttttataatattcttatgttgttagattcttggatttgcctacccaagatgggcatggcagaggctcagcaggggataatattttattttatttttgtttcttttcctttcttttgtggtagaaggataggtatttctagaaggatatatattgtttgtgtatgaaggtggatggcnnnttttc

SEQ ID NO: 5312 - DNA, 410 bp, Glycine max
aatgttcaagaaatggtaaggaatgatccttttcatgtgcctataggatatgtgacgagtcaagaagaattggagaaagccaattatatgcctcacctttcatctgagatccctgtcattgatttagcattgctctcaaatggaaacaaggaggagttgttaaaatttgacgtagcatgcaaggagtggggtttctttcaggtaatgctagaaatataatataaaactttttcatgtatctttacaaaaaaacttgagctttggggctacgtaattagtccatggcattgacatatatccatgcaaaaacgagatatttgcttggttttcatcaaatattaatattgcttgaaattgcaattaacatttgcttgtagatagtaaatcatggtgttcaaacagagcttatg

SEQ ID NO: 5313 - DNA, 149 bp, Glycine max
gccgtaaaggctagctgttgtgagttgcagtgagagatgttgctttattaatgggctgatgccctagctatcagaggatacataacgtacttatcataataacatatttcatgaataaaatccggtacgtgttatgagaggcacatatg

SEQ ID NO: 5314 - DNA, 400 bp, Glycine max
gtttttgctcacatcatggatgccatgtttggtttgtagcgcatcctaggcaggttggtaacaaacatctatggtttcatcctttgtcattttactctttctgatattcttcatttaatagctgcataattgggttgggggtcctcccaatctctatgatataagtggaagtgcacacttcataaataagtgtgacaatggaattgttattcaccgtaatcgggatccggaagctgggcctattgatcaagtacaggtgagtgtgttagcataattgtgcttattttggtttcatactaaacaaaatatactaactttggcttgcttcaggtttgtgttcgaaaggtacggaataaggttgcagggacaataggtgaagccatattgttgtataataggt

SEQ ID NO: 5315 - DNA, 1174 bp, Glycine max
attgatgtcttggttctcatgcaggtaaatttttaccattttaaactcatccaaattatacaagaggccttaatgtataataaaaccaaaatttgccatggttctctcttcatcagtagttaaattaaaagcttctgatgaatttttacttgtttggattatattgaaggagcatacatcaactttgagtcctcagttaatcaccctcttaattatcatatttttcaattatccacctccattcaaaagatggtgccaattgccagataaactcaaatgctgcattagccatattaccccaaataccattttagattagtaataaatttgatgcgtatgtttgagctatatatatcaacaaggttatccattagtaaatttacttaattattgacaatgtaggagccagttcttcctggttgtttcctgcgagccagggccattggattgatgcctatgattgaccaggtatattctcttggctctttagctgataaaaaaattgaaattttgttccaaccatttaaacaataacaagcttgtccaattgtgacacagggggagaaggatgataaaattattgcagtatgtgctgatgatccagaatataagcactatactgacttcaaagaacttccacctcatcgcctcatggagattcgccgcttctttgaagattgtatccttaaaaatcttattccaataacttgatacatgagtttctttaagattacttcatagtattttcataaaaaaaataaaaaattgagtgcatttcttaatatattgatcagacaagaagaatgagaacaaggaggtagcagttaatgattttctacctgcatccactgccgttgaatccatccagtactcaatgtcagtgtctaattatctatagaacacctagtttatttgttttttaactctagtttctagttgaaattggcttctagagacacactttatggccaataagataatattccaataacaaaatattgtctatctcgtagatcaattattctaccatgcttatcagatttcttgatttatgtaacataaataccgcacctgtaatctgcatcattttacctcactgttatatcttgtctctgatttgttgcagggatctttatgcggagtatattctgcataccttaaggcgatagacaag

SEQ ID NO: 5316 - DNA, 1252 bp, Glycine max
ggcaaaaaggagtatataaaggaaaaaacaataatagctgcaacatcactaacattgagtaatctgtaaatagttttgagacagggaaagtactacaaacaactaaaattataaatggatgccatgaatgatgctaaatcttgacataccaaaaatagttgcttaaacttaggaagtatttagtttacttggtaaagaccaacaaaatttgactataaaagggggcaggaaaaaaaaccaaaatcagaggcatatttaaagtagtgcgacaaaagaaatcgtgatttctctgatttatctaataagttagccatgaatgtcagccaaaatgataagttacctttgaaacagggaaaacacattctacaaataaaaattaaaaataattataacattgaaatccaaaaaatataggaggtccgcaatatacttgaaattaacagttggtttacaggaacaaacagccaacaatcacctaattctcagaagaagaaaatgtagataaatatgtattatgtacagaaaccacagtagattcgatgatatatttaacaaaacaaatgtcaaaaaggagcaaagtacacaaatacagcaaccaacaacaaaaaagacagagaagttatctacctatttcatcatagaaatcacttggatcatatccatgagggtcaaatacatctttactgaagcaagaccctatttgatcaatatcctggtacctcactgcatgcagtaagaagtcagggtttcgatagtccttcctgttgcgaacttctgcattaaaactttttccagccttcttatactccaggaatttgtttatttttctctgccatgacataaaattaaggtaaagacaatgatgtcaagggaatgtaatgtctaaatactaaaccatcaaatagaaagctaacaattggaaacatcctacatcctacccattaccaagaacataaagacgaatcaatggctctaggaaccatattgaattggatatgaatcttatgattcttgtgattctaatatgatggccgcacaaaaaacagaggaaaggaccaaagcaaaccagcctaagcaatgcaagctactttataatatattaaaatggtattcaacaattgatagtaattgaaccattttaacggaacttacttgtaactcctcagagcatttagtttttgatgggggagggagaaatttatccaatggatctacatatttttgctcatcttgatctgcttctccaaattca

SEQ ID NO: 5317 - DNA, 355 bp, Glycine max
ccatgctaccatgttataaattaaggacccaagtttccatttgaacttgagtttaactttaacccacctattaaatcctcctcttctgatttgaagcattgctctctcctcctatcaatgaaatcctgcataagcctaaggctaaggctaagccttccacctgctagaaaggcatggaagagcttcacttccacccttggtaagcttcataagtccaaatccaaagccatgaagaaacctagaaagcattattcaaaaactaccactaaaaaggttaccaaggcccctcctaagttccttgctaccaaacgttttcgcagcaaaaagttagccttagccacagtgagaagcttca

SEQ ID NO: 5318 - DNA, 313 bp, Glycine max
atcgagtattttctggtagcaattcagcaaaaacttggaacttggtaattgaaagatttggatctcttgcaatttcagctaggtaattatccaagagcctactaatattgaatttcctagtcttctgttgctgttgaatctgctgttgttcatgcatcaagaagtattccacaattcgttgcactacatctatgtctagcatggtgcattcttcagatgaattagtcatgcaactaatgaaggaaaagaataagaaaagacaaaagatagacattagtgtcattagtcgttttcataactcttgggttttttt

SEQ ID NO: 5319 - DNA, 387 bp, Glycine max
tcttaaactaccaatgctacaagccccccaacgacagaatgctcggcaccgagttctgtggcaagcttatcagacgcaccgaaaacctgggccccagcgagtaccgcttcctcctcaaagccatcgtcagctccggcatcggcgaacaaacgtacgccccaagaaacatcttcgagggccgcgaggccactcccacgttgcgcgacagcatcggagaaatggaggagttctttcacgacagcattggaaaactcctcgcgaaatctaacgtctccccctccgagatcgacgtcctcgtcgtcaacatctccatgctcgccaccgtcccttccctctcctctcgaatcatcaaccactacaaaatgcgccacgatgtcaaggtctaca

SEQ ID NO: 5320 - DNA, 426 bp, Glycine max
atgcctttcctctcctccgttgcttcctcattttcttcatcagagttcaattcctgaatgattggtcccctcctttgtctactaggctctggagcttgacgcacaaggaagccagatggatccaaacccggggctggatgctcaaggaacccagatggattcataccaggggggaaaggaaatccagtaggaccaccaaagggactagactcaaacatccctccaaaaggtcgggcgaagaaaggatcattaaatgggtccctacccccaaaaaagcttgagattaaactcctgggaggtccaaaggaaccaaagcctccaaaaccaccaaaaggatcgccaaaatcaaagaaacgatccctgccacccccgggtccttgcattctgtctcttcagaaaatgctgcctcttcataagactcttcag

SEQ ID NO: 5321 - DNA, 391 bp, Glycine max
gatccggtacctacattgttatcacatactgttaaaaacaagaaacagcaaaaacccaggatcaagaagagtgaaaagaaaaatggaaagaagggccagaaggtcagttactctaaaagaggcagcagcaaagataaacagtatcgaaataggtggttttattctcatgatgaagtgtttgaagcttcctctgataatgctgctaaccatgattcctactgtggaactagctactacttggaaacatcactcacaaaggttcactggtcgtctattggagaagcgctgtaacatgcttggttgtgttgtatacagagactgcataaatagataattttctgttatgttgtaatatcaatagattgatcaaggctgttagaacatccaatga

SEQ ID NO: 5322 - DNA, 327 bp, Glycine max
gagactccttccactcacctccctccgccacctctccatcgccgcctcgcgtcgcctcctctcctctgcactccccgtcgctccccgcccctatccgcccctcaccgcccgcttcgccgtcgtccggtgcctctgcaaccgccccggagactcggcgtactcgcccctgaacacgggaaagcccacctccatcttgtcgtcgatcacggagcgccctccgacggacatggcgcccctgttcccgggctgcgactaccatcactggctcgtcgtcatccacaagcccggcggcgaaggcgctaccaagcaacagatgatagattgcta

SEQ ID NO: 5323 - DNA, 383 bp, Glycine max
  misc_feature (51)..(53): n is a, c, g, or t
  misc_feature (331)..(340): n is a, c, g, or t
  misc_feature (343)..(347): n is a, c, g, or t
  misc_feature (349)..(351): n is a, c, g, or t
  misc_feature (356)..(356): n is a, c, g, or t
  misc_feature (358)..(358): n is a, c, g, or t
  misc_feature (376)..(376): n is a, c, g, or t
ggtttagctaagcttgatgaagaagagaatactcatatcagtacacgtatnnntggaacaatgttagtactgtgacacatctattgacttgtatccatgatttagatcataaatagatgatattttataagtagcataaaaaaccaagagtccaagacttggttcatacttagttgatagtattatttcattattattattattatcttaaacaattggcttgcagtgttgctgaccatttgtctcctgcatgaagtaataatcaattaaataatcctaggaatactgatgcttcattgttatgtgaattccctgcctattggatactacnnnnnnnnnnagnnnnnannnggctncncaatatgatgtgatgggntgcttgt

SEQ ID NO: 5324 - DNA, 414 bp, Glycine max
catgaagaatactctcaggctccaatttcctaacatacaagctaatgtggagagggttcagcaagagagaagggaaagggagaggaggtcaaaagagattttattgaacaagtatgaatctttgaaggagaattcatcttcaataaagggagggattctttctacgatggacgagattgatgagtgtttggagattttgcatgcaaaacaggagtctgtgtcggatgatatcttagatgatgaagaacttggtgacttccgttctttggaactgcagcaacttcgtcttgaagcattgaaagaaggggagaaagtttatgaggacaatgataacaaggtagtttttgaaacattgagggagctgtacaaacttctggtcacaaagcatttggtttccatccaagagtggatatc

SEQ ID NO: 5325 - DNA, 882 bp, Glycine max
aagttaatggagctgtggaaacttgcagaggggacgatcagtgggtaatgtctaagcattttaggaactacttcaatttttcccatcctcttgttgcacaacatttggatcctgatgagtgtgcttgggcttatgggatgaatgtatttgatctgcgtgcatggagaacaacaaacataagagagacatatcatacctggctgaaagaggtaaagtcatatatactcaaataatacaatccataaatttaaacttctagcaaattctgaattttaaactattgatgtggtactgattcaaatgtttaccctcttgcatacatatatgcatatgtatcttgaataaaccatcaattttgtcctcaatttattaccctctctcccaagtaatccctaaagtaataaaattaatccctgaaatattgaatatccatcactttaatccttaagttggtggatttcagtaaagtttaaggaccagtttgacaggtttttaatattagagggacttgacactatttctattgcttccaagactgcctaaatagtaagtattttattactttggggactgcttaggaaaaagagtaatacttcaaaaggataaaagtggtggtttgctctctctacatgtgtgagtgtgtgtgtgagagtgtgtgtatacatgcatgtgtgtgtattaggtggtaatatgacaacagatgtgacctttagtttcttatgttctgtgacagaatctaaggtcaaacctgacgatgtggaagcttggaaccctaccccctgctttgattgcattcaaaggtcatgttcacccgattggcccctcttggcacatgcttggcttgggttatcagaacaaaactgacattgagagtgtgaggaa

SEQ ID NO: 5326 - DNA, 983 bp, Glycine max
cgttgccattgtaagcagttttctttactcttgattactttttcctttgggatctttcacttcagccatggatagaattctgagatggcaagatgcttgtattttagggtcctaatgttggaactagttcagcattgccaccagctgtgactaatgctgatagacagacaggtaatttctttattgtctgtatatttcttcatggcattgaaatttggcagtgttatattgaagtttttgctttctttagtatattcaagtctaatccatgctgtctagcttgctgttcttggtgtgatctaaccttttctatcatttttaaaatttaaaatttcaaatctaattttatttaattcattacaacaataaagccttgtcccgctaggtgaggcctgctacatggatcacatgacgtcatttggcatagttagaaaccaaagtttcagaaatgttatcaagtttgagatctcacttgatgatttcctccaacgtcctttttggtctccctctacagaaaccaattttatttaattctttctgtaaaaataattactttttgctgcctcacattggttgttgttgctctaatgttgtctttatttttcagcaacttgttaacatatcttgagctttctgtcgccaattttttaccccttacaggagaggaagaagggcgacctcctggtctggtttcaggggattccacaaggcgaagaatgacagggcccatcccaaactctgtaaacatttcaaagcagaaaaatccagtcaccacggatgctgcccttaataaggaagccatggtaagttgtttggattgcacggtttctttggggttctttttaaaaatcagatcattcttaactcctcattatgagtctaacgtgtgtcaaatcatgcagttatcgaggcccaatgtcttgggccagtcaagtggatcaagacgagctgctgtttctagtagtcgtgatgcatttgttggt

SEQ ID NO: 5327 - DNA, 410 bp, Glycine max
cggtggcggcgcgggtgccggtggaggaggagggtatggggctggtggagcacatggtggtggttttggaggaggtggtggaagtggtggtggccatggtggctatgttccctaagaactactcttcaatgcacaatagatgtgcaagtgtcccctttcgcgtatcaaggataataagtatgctattaataacaggatcataataattaataacgtaacaatcatatcatcaccattaattctaagcacgttgttatcaactcgtgatttttatgtaacaaaagtatttccataattattatttgcattatcgtgaaactactatcatcttgtaattgctcttctgattatatatatttgcataaaattaaagaaatatgtttagagtttgagaaactctttctgccaaa

SEQ ID NO: 5328 - DNA, 363 bp, Glycine max
gctgagaaagaagatattcagtttcacacatgtgagatgcagaagttgtgcttgtgatcggaacagatacaagaacacgacttttcatggtaattataggaggtgtccattggatcgatttgtataatcaggtatacgttcagatagtgaagccgatgacttttacatcatagctgactagtgactagatttcctgctagaaatctaatgccatcacaaatccttttctgaagatcattctaactgttgtagtattcatgttgtatttatagttgtggcatattagcgttaaagtttctgtaactgattcttattaatattgtttatctgaaatgtgtaactataacacaggagtggtgcaca

SEQ ID NO: 5329 - DNA, 396 bp, Glycine max
ggagaaagcggtaggatcattctttgttaagattcttcaggtgaacaagtgaacccaaacatcgtggaattggtaaggcaagcatccggtggatctgttgttacagatcacaagtcgcctcatagggtgcgtcaatctcaatcggatatagaagctaaacctaaattctctctgggaagcttgctatggtctcgattagaacgcctttccggtggttttgggcccattagatcgtgacaactttatacctccggaactattcttctacctcatggaatatgtcactactaaatatcggtgtacataagattttttttttagttatttagttttttttctcttcttttcctcgtttgatttccttggggttgaggtaaaggaatggttcggggggtt

SEQ ID NO: 5330 - DNA, 450 bp, Glycine max
cagtcttggtggttctcatcttagctcgtcagagccacatgtgcaaactgttggttattatgatagagcctctacttatggtgggattggtctgcaacattattaccaagcatcttattatcctcaatagatcaataattcacttaatttgccattactgaactggagggttgatatactagtttttccctgactttacatcttgactgcttagttatcaaaagctagtttgcaactttgcgccattgaccatgattgtaggacaagaagtagattcagtaattaagaattgtgagggaatgcttactgttacaattttaattacttgaatcacttcttaattgtatctataaaattatttctaggttaatcatggtcatgagttttctcattctctctttcttctctatttcctaggctttgttgttttgagtaagcaatgggacttgg

SEQ ID NO: 5331 - DNA, 651 bp, Glycine max
ttgagctaaggcttccttcaaattgtggttaaaagactgagccacctcattatatgcctttgcgcaatcatagctatccctttcagcagatggaaaattggccaaaattaaagggaggcaaccaatgggtcctgtgttgtgtatccaaaatgatctggcccccatgttgtatatgttcttcatcacacaagtttcaccaaattagcacagtaaattatgaaatctattaacaatagagatagctacaaagggtatttattatgcaactacctttatatttgatgtgaaacttttgattatatcaggtatagtagcattaaattgctgtagggtcatgttaccaaaaaagccagctgtaagatcattttggcctatatcaaatgtgtataaagcttcatgaaaatactcttcttttggcatcagtgttgcaaataccccacctgccaataaaatttttaagaaaactcaaagcatatcaatcattatttaataggatgaatatcataacgtatgtatcttagctggacaaatcttaattgaaactcagattcaccaaaagatatcaaccaaaataaattcttaatttaattaccttgctctctaatgaactgtgtagtgggtttaaaacgttggaattgcgagtactgaact

SEQ ID NO: 5332 - DNA, 331 bp, Glycine max
aagacatcaattattacgtttcctaaagatcttgctacctgatattcaaatacaaatcataatcaggattctacaagttaaacaaactaacacaattcttcaagacccttttctttccagaagagcccccaaatcaataataatttaaaaccctaactaggagtcagtaatgtgcttaaggcccaaaccatgcttgccacggacacacccaggcctcacaaacagataaggagatttcttcgaaccgtgcattttcgaaaatgcccttttccccaatttcctcatcctctgcctcccgaacttgttgctcacgttccatggcacaagctca

SEQ ID NO: 5333 - DNA, 400 bp, Glycine max
ctttgggattgctccgcagggtagttgcctgacggtgatatttcagttctttgtcccaggttctcgccagactgataaatcaatcagcttgcattgcaggcttcctgttcttgaccctggttctggttaaactccaacagtcttcttgttatgtataagttcttttttgataaccttagaaattcagttgagaaaatgtcaagttgattagtgtgtataacgactgttgtgataagctttttactagaatatcatattaatttcttgtatgcatgaaaaagttttatattacattacatctaatattttatgataatgatatagtttggtaatgtgacagatataaggtacaaagttgtcttagttaccctgatgtgcaagatagattaagggagcaaaa

SEQ ID NO: 5334 - DNA, 1045 bp, Glycine max
ctcttttttcttctttctcaaaccatttaaaccttctgccgccaccaagaggcatagctgaagaatactgtgagagaaagaaaaatgttaggaaaagagtgctacacaaacccgccatcaatcctaaattcctctagtgcggttggccatgttatcaatatcggtggtgttaattcttacgtcactggttcccctctctccatcctcgccataattctagtctctgatatttttggtattcattagttttttgaattccttgtttggtatatctagtgcttgcttctattgtagccaatatcttcattaacttcacatgttcaatttatcgtgcaggatttaaaccaccacttttaaggtatgtatggttaattctcatgtttgctttcgatgcctaatttactaagtttttatgttttgcttatctgctcgacagctggagcaaatccatgtttccttggatactattgttcaatcatatataggcttatgagaatttaaaagttggccaaaatatgctttaggtcctttatcttttgaaacttaaaagattcattttggtcccttaattttcaaatttgaatcaatttctcctctgtaaaccatcagctagctcatgtgttttagctagcggtgataaatttttaattttggaaggggaatgattgaaaactacatgtaagtgtagttaattgagtcgtgattcatttaaaacaaatgtcttatactgtatatagaatgttagatcctagctagatttttaatctccaaagatggtgcattttttatataattactttttttttcctattgggatgtcttgttttctcctacaattttatttatgttttggtatgttatccacctagagaatgggctgcttcattctgctgaattgctgtctttgcctattgtctttttctctttttatgatactaaatgcaaagtattctcctgataaataatactctgttatatattgtgaaggaacattgcagacaaggttgcagctactgggtattatgtcgtggttcctgacttcttc

SEQ ID NO: 5335 - DNA, 460 bp, Glycine max
cgttcgcgtggaaggttccggcgacaagtaccttgtcctggcccacggcttcggcacggaccaatccgcgtggcagcgcgtgctcccttacttcacccgcaactacagcgtcattctctacgacctcgtctgcgccggcagcgtcaaccccgaccacttcgactaccgccgttataccaccctcgacgcctacgtcgacgacctcctcaacatcctcgacgccctccgcgtcccccgctgcgcctacgtcggccactccatctccgccatgatcggcatgctcgcctccatccgccgcccggacctcttctccaaactcatcctcatcggcgcctcccctaggtacaacaagtaattctcttctccctcctcaattctattctattctattctattctatgcgagcaaataggagcaattagcgcttgaatttctcagattcctgaacgacaaggactac

SEQ ID NO: 5336 - DNA, 832 bp, Glycine max
agttgcagatttcatcatcatgccatctgggtcgtggaagaatagctgatcaacgtaggttccactttcctctactctgttcttcacgtactctattttcatttgctgcagtcttttctccaccgctgctatactttcacactacaacaatgcacaatttgttccgtaagtatacacagatatgactttgcgtttaagtttaaatgattctctttaggaggagtgttagtaacaccctatttgatacacccttttaaaattgattaaaattcattaaaaactataaaattttaaaaaataatcattagatatgtcatcagactcacaatttaattttttttgttatttttaatcaatttaaaccaataaaaaaatatattcaaaagagtatgtgagtcttccaagcatttctctttatacatatatataggaagagagaaaaatacttggaaagaaatgtggttgtccttgggattaatgggagcagtcttgggcatgccttctgggttttctgattggagaaggtgtatgccaatgccataattgaataacctaccaggatcattatcaaacaaaagccaattagtattcaatttctatacataacaataacgggatctttctgcttttacatagcatgttgaattaactaaaaaattggtcagattggtttttcaactgaagaaacatgtctatgaagtttttgcaatgatatatacaaatggttaaacataccatgcaccattgaagtctaaagaactaggtctcttaataggagaaaacccaagaacgttcacgtaaaaatcaacggatttctccactgatgcacaca

SEQ ID NO: 5337 - DNA, 834 bp, Glycine max
gtcttgttccttcttttactgttcctagctttgtttatgtcttgccattaaagctttccagatggggggatcttgaactgctctgtacactaatctttttactattattgttactaaacttagttttgaagaaaggtgggtggatacagttgcctttgtccctccctcgtgtaattcatttggatcttgatgaaaacatatttctatctctttttagcgacttataccttggttgataagtggttctgatgatgttagttgtaaattgtaagtaaatgtgaattgctcttgagtacaaaaaattagaaaatgtaaatcttttgcaggaacgacaacaacaggaggaggagcttaaagtaaaggaggcagagcttctgcgtggaaacccactgctaaataatccaacagcatctttcaatgtgaaaagaaggtttgactttagatatttttcaaactgctcgctaaaccaaaatgactgtttttcctgttaaccctgttggtttgctgtctcaatctcattttttttcggttttgcatgcacttgttttgtttaggtgggatgatgatgtggtgtttaagaaccagtcccgtggtgaaaccaaaacagctaagcgattcatcaatgacaccatcaggaatgatttccatagaaaatttctgcataaatacatgaagtaagtccttgtgccagaagtccgagttgtttggattttggtctcaacagaacttattaatttgcagtttgtatctaaatgtatgattcaatgttgatggatatatttgtttctcttataaccgtattttaacatgttactcgtagttgctgtaacatgg

SEQ ID NO: 5338 - DNA, 120 bp, Glycine max
aactgaggttaaagttccagtaatatactacctttcccgaaatggccagcttgaacatccacatctcatggaggttccaatctcttctctacagagagtgctatgtctcaaaggtaaatg

SEQ ID NO: 5339 - DNA, 896 bp, Glycine max
tcgtcgctgccgcctagtctaccataacgtaatcgagattttcgctattcacacaatcccttcacactcttaatttacgctttctgttcagcttcgttgtgcggtacattttctttgtcccttcccttctcctctcgacgcaggacactatggccgtcaccgtcaaactaatggctctcattgtttcctttttcggcctcttgtctttcattttgggagtcatagccgagaacaaaaaggtaatcaattatttttctgcaagtatttatctgtgacatctttttaaatcgaacgggttaatctttgtttgatcaattataaattgagtatgaatattgtatgatatgattgatatataacttgtctgttaagttaagtatgtgattaagattttgatggttagaattgggagattaatttccttaaatagatcccgataattggtatatcaaaagattagtccttcatatattaatagatgtttggattaaagttaaaaaaactcaaaaacatatttactgactaaacaacacttattttcttctgcatttggtgtattcaaatttgttattgtacattggaattttcaagatatcttaggtttaaaaaatgacatatatgaactgggtcatgtgtacacataaaatttgttaataagaggtattagattgatttggcgattaagaaagaaggaaaagaatgaaaagtcataaatttcacccttatgcggacaaaaaactaataaattaatcaccattgacctttaaaaaaatcaaatttgttgattgggcaaggtaatatgaaattgcttagtgtgtgataaaatagagcggaaattctgaatatttgttttaataattacagcctcctgctggaatgcccgtgcccgtcaagga

SEQ ID NO: 5340 - DNA, 247 bp, Glycine max
cgctcgcgcagctcggatccggccggaggatctacaattcggagaaggagacggtggattccaccgcggtgcgcctatcaccggcggaaacggcggcgagaggatgaaaatcggcgcgtactacgaggaaatgttgaggtctaatccgacggacgcgcttctgctgagaaactacggcaaatttctccacgaggtgcgttaaaccgttcctccaacaaaccaatcattggatgaataagaaaaaaaa

SEQ ID NO: 5341 - DNA, 214 bp, Glycine max
gaagaaggaagagaagtgcattggtaatggaaaaaaaaaatatatgaactatccaaaacacttctacaagtactaatgaactcactaatcttccatcgaatgattgcactgatgacaatcaggaacctgaacttgtgcctaaacaaagggaaaaaaaaaaggggtttggcttccttttcctataaaaaataatcaacccacaaccttcttaaaa

SEQ ID NO: 5342 - DNA, 668 bp, Glycine max
caagctagatcataaattagataagaaaggctcacggctaggacttgcatctgctcaaatcacagttcaagcattccacttttagagtcaaatccaaaacaattaaatgaagtgtgtatttagatgaacgttgataaaattgattttgaaatgaggtgatttatatttaaatatttttattataaaatcaaattaaaaataagaattcaaaatcaacacaaaagttactcaaaattacttcttctaaactcacaatcaattctctaagtgaaatcaaacatgcattaaaacatactataggtttccctcaaaagggcatggcatgcagttaatccaatacctgtttgggtgaagattttgatcccacaggacagattggacacctccaatctttaacagagagccaagccaacgttactgctaaagttgcatggagcgtcgacacaacgcggttgcagaaatcaaacgagcgtttgggaaagattcttctcactaagacaaaagctgatgtccatgaaacaactccaacaacaattgtctttataacgtagtcttccatttctctatgctgcaaaatgtgtgtttacaattgaagtttcagcaaatgccttaccatataagcaagcattcactaattaattaaattgacacacatgacacatatgcac

SEQ ID NO: 5343 - DNA, 383 bp, Glycine max
cgccgtcctcttcgaccggttccgcggcatcctggactccaccgtcggcgaggggacccacttcctggtcccatgggtccagaaaccctacatcttcgacatccgcactcgcccccacacattctcctcggtctccggcacaaaggatcttcaaatggttaacctaaccctccgcgtcctctcccgccccgacaccgagaagctccccaccatcgtccagaacctcggcctcgaatacgacgagaaagtcctcccgtcgatcggcaatgaggttctgaaagccgtcgtggcgcaattcaacgccgatcagctcctcacggaccgctcacaggtctccgccctcgtccgcgagagcttgatccgtcgcgccagagacttcaata

SEQ ID NO: 5344 - DNA, 567 bp, Glycine max
tttttctttttctctgagtctcagccatatccatcatctttctctctccgccgcatgcggcggtgacgtttgatacccttcttcttatacagatccgccgccccttcttcctcccaacgccgctttctggttccctctcttccccaacccttaaccacatcttttcgcccaatttttaattattgttattattattattattattttttaatttgttaccgttgtcactttcattatctaatagatttttcttttgattgcatgttggaacctttagctgtggacccggtttatgacgattccttggcaaacaacaaacgcatattgaagaatttgtggtttcacgattttacccctcgaaatcagaagtatcagtagcgtctacgcttgacaaccctacgatgatgagtcagcatccccgtaggaagctgccacgtggcaacccaagaaagggcaagcacgctgaagttgacaagccggctgcgccgaaagctactgagccgccatcctcaaatcggcttctagccggctaccttgcgcacgagttcttgaccaaagggactctgt

SEQ ID NO: 5345 - DNA, 701 bp, Glycine max
  misc_feature (663)..(668): n is a, c, g, or t
  misc_feature (673)..(673): n is a, c, g, or t
  misc_feature (681)..(685): n is a, c, g, or t
  misc_feature (687)..(692): n is a, c, g, or t
  misc_feature (695)..(695): n is a, c, g, or t
gactgcatgtcatcctctcaagggagtgatcaagggtggcaatggtttaaggatcccagattggtctgtcttggtttcagagggatcttcccgtcgaatataactcgttagttagcctttgctgctaataaattttgtctatttatcttgcaatcttttatattattgtgacaaatctctagactttagtctaaaggagtcccccacatctctacctgtttcagcacctctaattgaggtggacaaagagactgatgaacagaatttccttctgtggagaatagagaagggagtagcagaaggatcaactgagattccaaaaggtgtgtgtttgtttccttgtaaaaactcatcctcagtagaattcttttgataagttctgtgtctcaaatatcttgattaatcgatcatgtccaggcgaggcagtaccgcttgagtataatcttgcaggccttaatgcaattagctttgacaaaggttgctatgtcggccaagaactcatagctcgtacacatcacaggggggtgattcgtaagcggatagttcctctaaggtttctagataacgatgggaaaggtaatgctacaaggagtacatggcttctttagtattgatatattatataatgatgtactcttagccattccttttctgctattcccnnnnnnctaancaaagtcnnnnnannnnnnganaaaaaa

SEQ ID NO: 5346 - DNA, 394 bp, Glycine max
aattcaaaagagtacacatcagacttctctgtcaaacggtaccgtttataatactctgggtctaaatatccaaagcttcccttcacattggtgctgacatgggacttggacgtgtccgtgggcccaattctggaaagcccgaagtctgaaaccttggccacccatttatcatccaataagatgtttgtcgttttaacgtcgcggtggatgatcatgtgcttggcgcctgtgtgaagataatgcagcccacgcgcggcaccgatgcaaatctgcaaccgttgcttccacggtagagtggggttatcggtgttgtagagatggtcacggaggttgccacgtgtcatgaaatcatagaccaggatcatttccttattatcgttgcagtagccgatga

SEQ ID NO: 5347 - DNA, 372 bp, Glycine max
ttctccagttaagtctgtagctgctgtgaagagcaacactaagtctgtcacagttaagaaaaaaagcccaacctcccctgtctcttctgttaaaaagaagacaacgacaacaacaacaacaacatcaaagcagtccaagaagaggaaggctaaggatctaagctctgaggatgatgatgatgatgacacagactctgatggtgaatttgtattatcatcagtagcaaagaggagaaaaatggcttaactatgcccttctgtgacactcgtatttatttttcgcattttttctttaccatttattgctggtgacacaacttgtatggcatgatgttatataacttttaagatgttgcccgtgggtttaaaaaa

SEQ ID NO: 5348 - DNA, 429 bp, Glycine max
gccaatgtagatgttagcaccaatgatgactaatggtttttgttggcaaatgacattattttgattccaggtgaaagtacttgtgaaagacaagaagttggagacactgttggatccaaatttgcttggaaatcgttatatagaggaagtagaggagttaatccaagtggccttaatatgcacacaaaaatctccttatgagagaccaaagatgtctgaggtggtgagaatgctggagggtgaaggtttggaagaaaagtgggatgaatggttgaatatgacagaggatatacaaaatttcaccttcaacctctgcactcctactcctaatgactcaaatccaaatattcaaccagatgttctgtcaggtcctagatgatctttgaacactaactttttaaatactgagacgtttagcaaaggaagaga

SEQ ID NO: 5349 - DNA, 852 bp, Glycine max
tcagggatcataccactatggattgatcaaaccgagtcgaaccatcatgcttgcaaattctgctccttatatcaatggcaagcagaggtatgcggtcaacggtgtctcatacaatgaaccagataccccattgaaacttgccgactacttcaacttaaaccctcagggatcataccactatggattgatcaaaccgagtcgaaccatcatgctcgcaaactctgctccttatatcaatggcaagcagaggtacgccgtcaacggtgtctcatacaatgcaccagataccccattgaaacttgctgactacttcaacatcccgggagttttctacgttggaagcattcctacctatcctaacgggggcaataatgcctatctccaaacttctgtcatgggggctaatttccatgaattcgtggagattgtgttccaaaattgggaggactctgtgcagtcatggcacatcgacggctattccttctttgttgtagggtatgccttatattatatagtttgcgttgcattttagccatctaagggtaacaaacatattgatttgatgagatgaataataggtttggtagcgggcagtggacagcagacagtagagtacactacaatctgagagacacagttgctagatgcaccactcaggtatatccaaggtcatggactgcaatctacataaacatgtaagtgtaactaacatatgattttatttgatgagatgaaaaataggtatggtagcgggcagtggacagcagacagtagagtacaatacaatctgagagacacagttgctagatgcaccactcaggtgtatccaaggtcatggactgcaatctacat

SEQ ID NO: 5350 - DNA, 387 bp, Glycine max
attggagagaaaattcggggttttttttattgtggttggaattttgggtactgggtctaagcgataggcattgggggaagagagagtgagtttgtgtaagttgcgttgtgtgcgagaatgcctgcgacggactaccaaggttcgtcttctccttcatcgttaacccattttggccgttcaattctgagtcttcgtcaagaacaggttcactccatttccatggaagggtcaagcttggaggctgagttggaatcctttcagcaacacgtcactgaccggttccttgaactcacttcggttgttcatgatgatttgctttcgctctcgtgggttgggaagctccttcattgcttcctgtgttgccaagaggaattcaaggccattctc

SEQ ID NO: 5351 - DNA, 676 bp, Glycine max
  misc_feature (656)..(658): n is a, c, g, or t
ttattttctctcacaatttcctcttggtctttctcggatagcttttgatggaaagcatcctgctgggggaatgttgttcacgaaaaattttcttgctcctagatcatatattctctgccagaaaacaacaaatcaaataaatcccgttagtgatgttattgctgatgaatcttcttggttgacaagtgcaaacatgaatgctagcgagtgtgaatcattgaaagagaattcatgatgaagcacggcatacataggtcccattcttgttataactagtgtgataacatataattaattatatgtcacttgtgaggttcatttaacaataaagagagttttgaatattaaagaaaatatatagagggttttcactttgtaaggtgggttgcttaaagaactagtaaatagtaattactgattatagatatacatgtacttttcctaccgtgtcattttcaccatattttgtttttttaacttgtcgtgttatttctttttttatcggtaattataaattttattaaaaatattagttggagaatttaaaattatgatttttcttttttttctttatctttttttaatcactggaaccttatatatctacttgttcatacttgtttgcatcacatcacatctatcattttgttttctannncttctttttttttttccc

SEQ ID NO: 5352 - DNA, 381 bp, Glycine max
aaatacgtgtatttttcaaccaattgccattaaactttggcatacaatgatactatatttttctataatgaaaaaagaaaaagaaagacgcagatatataattaacgaacgggaagcaagagattactaggaagtcaagtttctggagcaggtttaactctatcggtggtgtcatggcgcgagcccatcatcatcatcaccctgaactcctcgaagtcgatggtgccgtcgccgtcgccgtcgacgccgctgatcatcctgcggcactcggcgagggagcagtcctcgccgaggctgcgcatgacggtgttgagctcctcggcggtgatggagccgttgccgtcgatgtcgaagacggcgaaggcgtccttgaggttctcc

SEQ ID NO: 5353 - DNA, 392 bp, Glycine max
cacacatcctccaggaacgggaatcccacgccgcttgtaactccatctcggtgtttgattctctgcttcttccttcattccccttcggaatcgatcgatccatcttcctcttccaatggcaacccctaccgacaataataacaaccctgcacaggaaaaccctaacaaaaccctagaccccaccgaaccagatccaatccctgccactgaggacgccaccgccactaagggctccgacgccaaggaccccgccgacgccgacgccgacgccataacttctccgccgcccgattccggaaacgacgctccgctctccgatattcagaagaagatgcgccgcgccgagcgattcggcatttccgtccagttgtccgagaaagagaagagaagat

SEQ ID NO: 5354 - DNA, 200 bp, Glycine max
tattatattcaagtaagtagctagcaatttactgataatatatctattggtatctggtgaatgacatgaaatttaagtgaagtttttttcattttgcagcttgacaaccatcgtaatcagctgattcaggtgccttttcacgtttctgcacctggcatgttgcatgtcatctatcggtattctataatgttttttttttt

SEQ ID NO: 5355 - DNA, 582 bp, Glycine max
atgtaacacaaacctacacgagcccaaaatttgagtatgctcttctggaatttcctctaaatatacaatatttggtggctgaattcttcttgattggtgctaagggttatggattagatgcttttgctccagggttagcccagggaggaccccctcccattggaggccaaaaggccaatctggatcccctcacaaaagacttcagcttgcagaatggtttagttgcaactggacatttgaggttctgatcatctctctagtctctctacacattacatttgtttagggagggaaactagaaaagaatattttgcatggcatgtttgttcttattttggaaatgaatctaatatctttatttttaagaaacaaccaataatatgatgattttaattttgataaagtaaagtgttgtttcatggttccttaatttacagggctataaagcgcgcagtaaaaggtttccctaggccattaataaatctaaacaaggaattatttgctcaaattgtcgatcaagcctttggacaacctttgaatccaccttttgatccctatgccaattccttgaactaaccaact

SEQ ID NO: 5356 - DNA, 1429 bp, Glycine max
  misc_feature (398)..(407): n is a, c, g, or t
  misc_feature (410)..(419): n is a, c, g, or t
  misc_feature (425)..(428): n is a, c, g, or t
  misc_feature (438)..(438): n is a, c, g, or t
  misc_feature (443)..(443): n is a, c, g, or t
  misc_feature (447)..(453): n is a, c, g, or t
  misc_feature (455)..(462): n is a, c, g, or t
  misc_feature (467)..(470): n is a, c, g, or t
  misc_feature (473)..(473): n is a, c, g, or t
  misc_feature (475)..(477): n is a, c, g, or t
  misc_feature (486)..(489): n is a, c, g, or t
  misc_feature (493)..(502): n is a, c, g, or t
  misc_feature (508)..(508): n is a, c, g, or t
  misc_feature (510)..(522): n is a, c, g, or t
  misc_feature (524)..(527): n is a, c, g, or t
  misc_feature (530)..(536): n is a, c, g, or t
  misc_feature (539)..(542): n is a, c, g, or t
  misc_feature (544)..(544): n is a, c, g, or t
  misc_feature (551)..(551): n is a, c, g, or t
  misc_feature (554)..(559): n is a, c, g, or t
  misc_feature (561)..(565): n is a, c, g, or t
  misc_feature (567)..(568): n is a, c, g, or t
  misc_feature (571)..(572): n is a, c, g, or t
  misc_feature (575)..(581): n is a, c, g, or t
  misc_feature (583)..(589): n is a, c, g, or t
  misc_feature (592)..(599): n is a, c, g, or t
  misc_feature (610)..(610): n is a, c, g, or t
  misc_feature (612)..(618): n is a, c, g, or t
  misc_feature (627)..(628): n is a, c, g, or t
  misc_feature (636)..(659): n is a, c, g, or t
  misc_feature (661)..(666): n is a, c, g, or t
  misc_feature (669)..(672): n is a, c, g, or t
  misc_feature (677)..(682): n is a, c, g, or t
  misc_feature (684)..(700): n is a, c, g, or t
  misc_feature (703)..(712): n is a, c, g, or t
  misc_feature (717)..(730): n is a, c, g, or t
  misc_feature (739)..(739): n is a, c, g, or t
  misc_feature (741)..(752): n is a, c, g, or t
  misc_feature (760)..(765): n is a, c, g, or t
  misc_feature (767)..(770): n is a, c, g, or t
  misc_feature (776)..(783): n is a, c, g, or t
  misc_feature (790)..(794): n is a, c, g, or t
  misc_feature (796)..(802): n is a, c, g, or t
  misc_feature (805)..(817): n is a, c, g, or t
  misc_feature (823)..(838): n is a, c, g, or t
  misc_feature (840)..(845): n is a, c, g, or t
  misc_feature (856)..(878): n is a, c, g, or t
  misc_feature (880)..(885): n is a, c, g, or t
  misc_feature (888)..(891): n is a, c, g, or t
  misc_feature (896)..(898): n is a, c, g, or t
  misc_feature (900)..(906): n is a, c, g, or t
  misc_feature (908)..(921): n is a, c, g, or t
  misc_feature (925)..(927): n is a, c, g, or t
  misc_feature (929)..(943): n is a, c, g, or t
  misc_feature (945)..(956): n is a, c, g, or t
  misc_feature (961)..(967): n is a, c, g, or t
  misc_feature (969)..(981): n is a, c, g, or t
  misc_feature (987)..(992): n is a, c, g, or t
  misc_feature (995)..(996): n is a, c, g, or t
  misc_feature (999)..(1000): n is a, c, g, or t
  misc_feature (1002)..(1015): n is a, c, g, or t
  misc_feature (1024)..(1025): n is a, c, g, or t
  misc_feature (1027)..(1032): n is a, c, g, or t
  misc_feature (1034)..(1036): n is a, c, g, or t
  misc_feature (1043)..(1048): n is a, c, g, or t
  misc_feature (1050)..(1054): n is a, c, g, or t
  misc_feature (1061)..(1080): n is a, c, g, or t
  misc_feature (1086)..(1121): n is a, c, g, or t
  misc_feature (1123)..(1145): n is a, c, g, or t
  misc_feature (1147)..(1164): n is a, c, g, or t
  misc_feature (1166)..(1167): n is a, c, g, or t
  misc_feature (1169)..(1178): n is a, c, g, or t
  misc_feature (1180)..(1180): n is a, c, g, or t
  misc_feature (1182)..(1193): n is a, c, g, or t
  misc_feature (1195)..(1203): n is a, c, g, or t
  misc_feature (1213)..(1219): n is a, c, g, or t
  misc_feature (1222)..(1227): n is a, c, g, or t
  misc_feature (1230)..(1234): n is a, c, g, or t
  misc_feature (1237)..(1237): n is a, c, g, or t
  misc_feature (1239)..(1242): n is a, c, g, or t
  misc_feature (1252)..(1254): n is a, c, g, or t
  misc_feature (1256)..(1265): n is a, c, g, or t
  misc_feature (1267)..(1269): n is a, c, g, or t
  misc_feature (1274)..(1277): n is a, c, g, or t
  misc_feature (1279)..(1282): n is a, c, g, or t
  misc_feature (1285)..(1299): n is a, c, g, or t
  misc_feature (1302)..(1309): n is a, c, g, or t
  misc_feature (1311)..(1312): n is a, c, g, or t
  misc_feature (1314)..(1314): n is a, c, g, or t
  misc_feature (1316)..(1316): n is a, c, g, or t
  misc_feature (1318)..(1324): n is a, c, g, or t
  misc_feature (1326)..(1333): n is a, c, g, or t
  misc_feature (1336)..(1339): n is a, c, g, or t
  misc_feature (1341)..(1345): n is a, c, g, or t
  misc_feature (1349)..(1357): n is a, c, g, or t
  misc_feature (1360)..(1366): n is a, c, g, or t
  misc_feature (1370)..(1373): n is a, c, g, or t
  misc_feature (1376)..(1383): n is a, c, g, or t
  misc_feature (1387)..(1392): n is a, c, g, or t
  misc_feature (1394)..(1403): n is a, c, g, or t
  misc_feature (1406)..(1408): n is a, c, g, or t
  misc_feature (1413)..(1425): n is a, c, g, or t
atgactttataatccaattcttgcgggtatgatgcaaatctaattagaagagcactgaaaggctgaaagcttcagctggtccccgaacatactaaaaagttagcatgcttcttctagctatcacaatgcacagcatacgctgtcaacttacaacatggcttaataatcttggaagaaggaagtaaaaaaacctattgcaatgcatcttgtagcaaatctacccccacaatggtatacgaaaacaatccattatttggttggggcagaaatatatactaaggaataacagaaaagaaacgatgatattgtttttcatatccccagttctgtatgtaaggagcgtgtttgggagttattcaaattctcaaacacgcgtgtttgagaaatgctgtttacannnnnnnnnnccnnnnnnnnnntctccnnnnactcccactncttcncatnnnnnnntnnnnnnnncttcnnnnccntnnnacctccccnnnntctnnnnnnnnnnaatttntnnnnnnnnnnnnntnnnnttnnnnnnnctnnnntnacaacanccnnnnnncnnnnntnnctnntcnnnnnnncnnnnnnnctnnnnnnnncccccctcccncnnnnnnnccctccccnncttccccnnnnnnnnnnnnnnnnnnnnnnnncnnnnnnccnnnnccccnnnnnncnnnnnnnnnnnnnnnnnctnnnnnnnnnntttcnnnnnnnnnnnnnnacccttccncnnnnnnnnnnnnctcttctnnnnnncnnnncctccnnnnnnnnatcttcnnnnncnnnnnnnctnnnnnnnnnnnnnaacacnnnnnnnnnnnnnnnncnnnnnnccctccttccnnnnnnnnnnnnnnnnnnnnnnncnnnnnnccnnnnccccnnntnnnnnnntnnnnnnnnnnnnnnacannnannnnnnnnnnnnnnncnnnnnnnnnnnntcatnnnnnnncnnnnnnnnnnnnnaaactnnnnnntannatnntnnnnnnnnnnnnnnatacaattnntnnnnnncnnncttatannnnnncnnnnncccactnnnnnnnnnnnnnnnnnnnnacatcnnnnnnnnnnnnnnnnnnnnnnnnnnnnnnnnnnnncnnnnnnnnnnnnnnnnnnnnnnntnnnnnnnnnnnnnnnnnncnntnnnnnnnnnncntnnnnnnnnnnnncnnnnnnnnncaccccttcnnnnnnnccnnnnnntcnnnnnccnannnntccctctccnnncnnnnnnnnnnannnctttnnnntnnnnccnnnnnnnnnnnnnnnacnnnnnnnncnncncntnnnnnnncnnnnnnnnccnnnnannnnntccnnnnnnnnnctnnnnnnnacannnnttnnnnnnnnacannnnnntnnnnnnnnnnctnnnccccnnnnnnnnnnnnncacc

SEQ ID NO: 5357 - DNA, 533 bp, Glycine max
ttgagccagcatttaggaagtaccctcttgaggtaagatatgcaccatgcaataggccaatattacaaattgccaactaggaaggggtaccaaacccttggaatagtgtagttttctctaaacttaacttccttttgtttattattggaggtggctacatgttatgtgatattgttcatagtttatgattgtattgtattggaaactgatttctctttctcttaactattcaggaagcaatgtcaaaggatttattagagaagagcacagaacctgacttgaacatagaggcttatttggctgatgcttacttgcacccaatcttcaggtcatttgaggtagacgacgaattggttgaagtcagagtagataaacaccaaactaatgtagctgattcccaaccaagtgagcctagttcaccatctccaatggcaataagaattcggccgataagaagcacgagcacattgtcaatcccaggacgatattcccggtgttgaattgggtacatgacaatgatctctactatcatt

SEQ ID NO: 5358 - DNA, 385 bp, Glycine max
gatctctgattacaaggttactttgaatgagcttatagtgtcgaagccctcaacggggtctaggtattctggtgatcctgggatacctgatatggatttgagtgagtttgaggagaagacacctttggatgttcacttgatttggattattgtgatattgcaattcaacttggatgggaagagtaagcactacagggatgcgtctttggctcacctttttgtcatgaacaatgtgcactacattgttcagaaggtgagggggagtcccgagttgagggagatgataggggatgactacttgaagaagctcacggggaagttccggcaggccgccacgagctaccagagggccacgtgggtgagggtcttgtattgtttgagggac

SEQ ID NO: 5359 - DNA, 366 bp, Glycine max
ccaaaagttagcactaacaacaacctattcctttctctccgtgtttagttctacacaaagcaccaacactggctagcaagaagggcatggcaacatgtgggagcctgcatcacatcttcgacacccttttgccagaaaagccaaccctgcttgaatccctctcatggaaccaaataaaacccctaaaacccacagaccaaacccactccttcactgaaatatttggagaacttcatttcaaggagagtcctatatcttcatcattcactccccacgtttctacttcatcatcatcatcaactgagataacaaacaacaccaacaggcacaagagtagtgacagcttctcatccttgagttctgaaa

SEQ ID NO: 5360 - DNA, 992 bp, Glycine max
tttctttttcctcttaattatccaatctcacataattaatgatattccattgttaataaattttggtgacgcaagtccaccatgcatgcttggttaacaccatgtttgtaagggagcaatctttttaattataagaaccaacgtggatgtgctaagcggaagaaattagtccccccgaaccatgtttaatgtgggtaatgtctccaataggagttatatgagagggaggatacaaagaaacaaaacaaaattataagcatataataatcatattaatttgaaagtgggcattctttttaaggctattaagcatgtaatatgtgggcgatgtcatatacctgtggatgatgggattgatgaggaaaatttgagcaaatgtttccaactttccacaaaattctatttaatttatcatgcttcaccagaatttcgctttgtcacgcctaagttgcttgttcttgtgcatttatatggccaaatcttaaatgttgtcattttgttcattagttcacaattattgtggcagaagtttcggggccgaagaggatcatgaaaaacaagcgactcaaaacatgaagtatcaagctgaagatgctgcttcaagggccacggagagagtgaaatctgcagcatcaggtaacgtatatatttgttcattctttaccataatcttttttaatttcatgtacctctcgattaaaatttggtatcaaattcaagcaaatgttagtatctttgatttgtttgtttaggagcctcggactatgcttctcaaaaggctacggatgctaaggaagcagtttcaggtgctaaggtcatcaaaatgccaacagatagcattaacaatgcaaaacacacaatgggagatacctacgaggatgctaagcaaaaaatgaacacagcttcagataaggcttcaagtatggctcacaatgccaaagataacacggctgagtccatggaataggaaaagatatagcagccaatgccta

SEQ ID NO: 5361 - DNA, 1221 bp, Glycine max
agctccgagcatggcggcgacggagcgcacggtgttgcagttctcttcttcgcagagcctctcgacgaaagttcaccctctcgttgtcttcaacatctgcgattgctacgtccgtcgtctcgaccaagcggagcgcgtcatcggaacgctactcggctccattctccccgacggaaccgtcgatgtccgcaattcttacgccgttccgcacagcgagtccgtcgaccaggtcctgcacactctttcgcctacattcgatttttacactccttacccttattttttttattcttgatttgtttctacgattttattttatggatgatgtttacgtgtagaagtccgttatttctgtttttggagtttacttaatttttgatttgttttttcacaggtcgctttggatattgagtatcaccatagtatgttattatcccaccagaaggtgaacccaaaggaagttatagttgggtggtaagtcctattcttttgaccctttactattttaaagttccgtgtattgtattcacaatgttgtcaatgggaatgtggaattcaataggtgatcattgtttgttaagaagcatggtgcgttgtgtgatgtggaatcaataaaccctctcaatgcaatttaaacctttattgtttttatgcgatggttgttggtagtcccaaattgactatgatatgaccaaaatagtgtagtgtatacaagtggagaaaaccctttgcttttggtgttgagtgggactcaaactcaaattttaagatggtatccaaacctatcccagtgcttattgttgagcctatccgccacctgctgtcggactgctattagattcctcgtgtatgtccaattccacattgattaatgataggaccaaaaaagtttatttaaataggagacaactttcaccatatgaactagcttttgaggttgagtgagttccaaatccaaattctaggaatagtattcagttcttgatgccctagtggttttaggtacgggtttttgttaatgggattcacttattgagtgcaaatggactgctgaactcatttaagcttgtatatttttttccccttttattccttcttactctttatgttcttagagaatgttctattataccagtttatgaacctcctttcactgtagctaattatggttatttcatgcaggtattcaactggtcttggagtaactggtggtagtgcata

SEQ ID NO: 5362 - DNA, 387 bp, Glycine max
agaagagccacataattcacaattcatagatagagaggctatggctggtcttcaaagatctgcagtgtccttcaggaggcagggttcatcaggcttcgtttgggacgataggttcttacaagaggaattgaacaaagtcaaggaagatcacaacaacaacaacaaccacgaccacgacaacgatgacggcggtgaaattaaagagcttcaagttcaaacaacgccgcccctccagagaatccgctccaacggcggagcacgcggctaccgcaccggaaaagtttcgccggcgattgagccaccgtctcccaggctctctgcatgtggcttctgcgccgcctttggaaaagcaggggacaacaagcatcgaccaaggtagagagacat

SEQ ID NO: 5363 - DNA, 339 bp, Glycine max
cgaaattgaagaaacccaattgtctcggaggcccatggaaagtttacggcgcagcccgcaggcccccgcctagttggttctctccttccatggtcgaccacttcatcacctttgacgctgaggactcttccgacacacgcgccaagctttcccccatcgcccacgaggtcacgcacctcttctgggtcacctttcagattcacgcagacgaagaatacaatgcaactgtcaacaaaaccatgctactcaaccttctaactgccctgaaatcttccacgacatcccggttggcccatgtaacggtccaaaccggaaccaaacactacatgggcccagttt

SEQ ID NO: 5364 - DNA, 407 bp, Glycine max
ggttggtgcatcagcagcattcccagttgtagtagcaggcatagatctcaaccatgcaaatctgaaaggaactcttgtgaaggagctctctctactcagtgatttgtcccttctccacctcaacagtaacagattcactggcactgttcctgaaacattcagagaccttgtgtttctggaagagttagacctcagcaacaaccaactctcaggtcctttcccttctgctactttgtacatgccaggcctcatctacttggacctcagattcaactacttctccgggtccctccctcaggaacttttcagcaagaaccttgatgcattgttcctcaataataaccaatttgaaggtgaaattcctcaaaacttgggcagttccccagcctcagtgataaacttagcca

SEQ ID NO: 5365 - DNA, 381 bp, Glycine max
attctttatctcaattaaccttcatctctctcacacactcctctcactagctctggtcactgtcttaggaaccctagaacagcaacccagataaactattccaagacacacaccacagaaagagagaatcaaaacaattaagccttggatctgcatagcaaaggcaagcacaagggtcatggattcaaatattcaagactttatagacacatgtaactctgacaacacctgcaatctcatcaccaatagcaccaccaccaacttaaccgcagctagtgctgcctcttcctctcctgcttccacctccatcaccagcagcagccgctacgagaaccagaagcgccgtgactggaacaccttcggtcaatacctcaagaacaa

SEQ ID NO: 5366 - DNA, 355 bp, Glycine max
  misc_feature (263)..(265): n is a, c, g, or t
  misc_feature (320)..(320): n is a, c, g, or t
  misc_feature (348)..(350): n is a, c, g, or t
gttagagattataggtataaattaatattttttacctacacatttgaaatagtaggtgttacctatagtgatagttaaatttgactgtaggtaaaaatatatccgtaggtaaagcctatagtgacagactattagttgtcactgtataccccctcaaagttgacgcaaaaaacgtctgtaggacaaagtcctttatacatctacctacggaattagatttaaaaataatgttattttccctttgcttgagggaaaaaattttnnnaatttttgccccggtgaaaaaaaacctctggactaaagggaaggataataaattncatccaattcgggtttttttttttttcnnnaaaaa

SEQ ID NO: 5367 - DNA, 415 bp, Glycine max
  misc_feature (407)..(407): n is a, c, g, or t
aggcttagccttatctttggaggcaaagataaactattgaggaagtctgtctcaaaagatcagacaaacgacgaagaaaagtcaggtcggcaatcattctccagtttctttgacagcaagtcatctttgtttggaaagaagcctcccaagtctggatccccatctccttctgagaaatcttctatcgatactggttggccagttgtttagacaaatttcatcttccactgtttattgaggataagcaatatttttgggttccccctccccctgcagataactgtaaattttctctattcttttgccaaatacttggtggttgtattctgtagaaattttaattaatacttcattcttttttatttgagggaattgaaaatataattttcgggcctttagtaaacatngtaaacag

SEQ ID NO: 5368 - DNA, 743 bp, Glycine max
tatttgtctcagtacaacattacaagattactgcaactgcatgcaaactggaataaaagcacacatgtttaatttattcagccaaaccacacggaatatagagatgatgatatatgatgccaccgagttttaacacaggaagagtgttaaaaagatgtggcagcaagtaccaagaattaaaaactacatacataattatagtactgttggcggtagtttcatggtaagcaatctttcctaatatacggatcacatggtggttttggtggcgatggggggaggcaagacctataactgccgccgggggaacatctaatattaggatcgttggtaccaggtgtcaccccgcctgcagcataataataatggtgttaatatttcacataattaattctttttgtatgactttgttagtcacaaaaatattttaattcaaaattttcatctccactctaccacccaacatacaataaataatagacagatttgataaatacatcatacatccatctacggactaataattggtgtgcgtggctgtcttccatgggagtttggcaggcttaatttcaaattgcgattaattcattttaatttcaaacataaacaaacgtgatatgcatgctgcatatataaagccttatatattttatattgatagaaaacaagtttattatgaacatgtgtatgagatttgaagtagagagtagctagttaagtgttaccctccagttgtcgagcaa

SEQ ID NO: 5369 - DNA, 385 bp, Glycine max
tatgagctagaggttgaaagaaaagccctgtccatggccaggtaaaatcatgaaacttttagaggcaacaaaattatgtttgatcagttttcaattttggtttcatagaattggcaaaagtagatgtgatgtggggtcagaagcattgtcaaatatattttcctgtcctattttagtccaaataaaactaattacataacttcctatcactgatatgttaattagacaaatgatcaccatacatttgttactttctgccgttgcattcctttattttgcaacagttattttctgtattaactgcttccaattgtatttgtgctactacatattgtgtctagatctacttgaatttttgacactgatgtggtcagcactactgaga

SEQ ID NO: 5370 - DNA, 410 bp, Glycine max
tcacaaatattatttgaatgtgatgttgaaaagcacaacatccggactgcagccctcataacctcataatcacaacgtgccacataactgaaaatccatagtatgcagtaggtgatcaataataatcatggtaacatctggttcctgcagattacactctagtagctgcaagaaacacaaaaatgaagtcatttcccactttctctaccaacaggacaatccccgaaagaatcctacttccgagagacaaaatacagaatgtcacacaactccaacagcacccaacatttcatatgacttccatcagggacctttttctcacaaagacttccatgggatactatgacaaaaaccctagttttgctcatgaataacaacggatttatctgatccaatcttcctatctccca

SEQ ID NO: 5371 - DNA, 1167 bp, Glycine max
  misc_feature (1164)..(1164): n is a, c, g, or t
gactgcacttctcatgcttgaacactgcgttactttgaactcaggtactggtaatgttttttttcttctttttattctcggggttaatgagtggattaagtgcatgtttggtttcatgttgaaatatcagttaacatgattttaggaaatttttcatttgtttggttttacacgtgcagaattaattctgggatgaatcaatttaggtagtttttgtgttggataagaaattttatactggattttaacttgcttttaaataaaaacatctaaacacaaatcacatcatttcaaaatcaacttcaaccaatatcaatttacgaatgcttatacaaacacaaacttaaattttgtgaatgtggatgtggatgtcaacaggagatgctattgtgcaaaatggggctaccagcatggttggccagtgtgtcattcagattgcaaaatcacgtggcattcacaatatcaatattataagggacaggtgctcatgggaaggttctttgctagttttgttattaacttctatgtatttattttgattatggtttgttttttcattacaacacaattttttgcactgttttaaaatataatgtgattattaagatatccttattattccctccctttttttcacttctggcagaatgagaatacttaattttgcattgcaaatccttctgctgcaggcctggggtcgacgaagtaaaagaaaggcttaagaatttgggtgctgatgaagttttcactgagagcgaattggaagtgaagaatgtcaagagtctcctggtataccttggcttgctattgttgttttggtctatgcaatgagatagatgtcaatttatcagatatgattctatttatttgtcattttgaacttgcttctatgagatgctaaggaagttgagagaaaatattgttttgaagcattattatatcgaattcaggtgacttattatgcatcaaattgacatgctagggtggtatacctgaacctgttttgggatttaactgtgttggtggcaatgctgcttctctggtactcaaatttttgaggtatgatatgagatattgggtgaaaaatttaaagtagaaacattctcttctgttattattatgacaatttaagtccataccttgcagacagggaggaactatggnact

SEQ ID NO: 5372 - DNA, 376 bp, Glycine max
cctcgctgacgtagcctccgacgacgccggaaaaataaacctggaatcggtgctggtttccatcgacaacttcttcaatcggtacccgtttttcgtcgccggttgcacctttatttggctggtggtgattcctctggcggaagagtacttgaagaagtgcaagttcgtgtcggcgattgacgcgttcaggaagctccgcgatgacccgaatgcgcagctgctggacataagggacgagaagaacgtgaggtttctgaagtctccgaatttgaaaatgttcgagaaggaagtggcgcaggtcgagttcgctgaggatgggaacgaggacgagtttgtgaagaaggtgttggggaggttcaaggacgcgcctaacact

SEQ ID NO: 5373 - DNA, 580 bp, Glycine max
  misc_feature (148)..(150): n is a, c, g, or t
  misc_feature (152)..(152): n is a, c, g, or t
  misc_feature (154)..(156): n is a, c, g, or t
  misc_feature (162)..(162): n is a, c, g, or t
  misc_feature (164)..(167): n is a, c, g, or t
  misc_feature (173)..(175): n is a, c, g, or t
gtcctgttctttaattcctttttcctcatcatttccgttgacatataatccctatggttttgccaacatattcagggcccaaatccaatcctcagctttcccgaatatttgcgcccaaaaaatcgccacccatcttttcaccatccannngncnnnaacaancnnnnctcttnnnacaagatgtagaagatactgttgttgctgttgaagagacccgggatataaccacagacaatactgggaaaactcatgatgaattgagaaagatgctggcacatatgtttgttgacaatgccagtttaaggaaacaaatcaattctgttattcgttgtgctctaaatgcaaatatcaattccgaagaggacggtgaagaaatccatttgcaaaaaactgtcctaagcaagttcttagaaagatagcttgttcaatactacaccgtgtatctattattgagttacttctctgttaattatggtctataaatttttgcacttgtatggtttcactgccattcgttccgagccgatcttaaaaaaacaaaaatgcgtttattgttccgccaaaattgatatgaatagtt

SEQ ID NO: 5374 - DNA, 349 bp, Glycine max
taaaaaggaaaattacaacatatatgtacaaaaatccctacatataatataatatatacaaggtcagatttcattattacttgatttcatattcttggccttttccatccactttctcttctcatccaagctctttaaggtgcctttccatttacaacctgactcttgaaaaatgtttcttcaatccttaacttcatattcttttgattcctgatgtatttctgagcaggcactgaaaatcttctaagaacagccctctgctgcagaaggaggggacttttcaatgtctttcaatgcattttcttgtttttcctggttactaacaccagcttcagatttattggtgcta

SEQ ID NO: 5375 - DNA, 782 bp, Glycine max
  misc_feature (57)..(59): n is a, c, g, or t
  misc_feature (730)..(734): n is a, c, g, or t
  misc_feature (737)..(739): n is a, c, g, or t
  misc_feature (741)..(744): n is a, c, g, or t
  misc_feature (753)..(758): n is a, c, g, or t
  misc_feature (767)..(770): n is a, c, g, or t
  misc_feature (772)..(776): n is a, c, g, or t
gatgttgtagtgttggatagttctcaggggaactcaatttatcagttagagatggtnnntttgtgaagagggtttaccctgagcttgatgtgattggggggaatgttgtgactatgtaccaggctgagaatctgattcaggctggggttgatgggttgagggttggaatggggtctgggtccatttgtactactcaggaggtttgtgctgtggggcgtggtcaggtatatttgattcgtcgatcaatcaattgattgattactgttttgatctttgttacccttatcattgaatttaagtgtgtggtggtttgttttgaggttttaaattgcaatcacagttgtggtttaagagattgcaaacaaatgcagatgatgtgactgcaattgcggtcgcagagactccaaaaaccttgatagataaaatcatgatcattgattgatttttaaagccttggtttgttgtgtaaatctttgtgttgtgatgagttttttctgaatctatgcgttttgatttggtgttggttggacttagagcttgaaggatcaactgttaggattgaaaatgcttgcttgatacttgtcaatgatcctttcaggaggttaggatgtctatagttaccaccttacccgcttgatggggcttgtgcggcatgcctgatccttggtgttccctaaaggctattttaactgtttcttgtaaagatgtttgaaaacaggaaataatgtgnnnnnaannnannnntttgttttnnnnnnatgaaaaannnntnnnnnctcccc

SEQ ID NO: 5376 - DNA, 382 bp, Glycine max
gatgctagcaaatcccacacaaggttcgggagagggcttcaagtttgtgttgaagaagtggcagcctcactactttgcctgtggtgagagaaatggcttccattgcaacaacggtaccatgaagttcgctgtgatgccaatgtttcgtcccttctggaagtggccatgagaaagttgcgccgttgcagcttcttatattttgtttttcttatatgttatgccttaagattctgttggcaattcagatttttctaagctgttataataaaatattttaatgactctgtacttttttgttttgcttgtaagtttggtaactttggttaacgtttgtttgtgctcagaaaagcaagttatagctggaggctaatatggtgctctc

SEQ ID NO: 5377 - DNA, 800 bp, Glycine max
tgagtattctacaaatactttgttgccctttttgtacattgtcctaaaccaaaatctgcttgtcctaaactaagtcagcaatgttggcgtgctttgagtcgaagcaatgatctacagccaccgttttgcagtcttggtgtctgaatgggaaggaggagttctagcatttccgtccttgtcatcttcaggtatgacacaaaactatggacttagtatattgctatatcatgaatatctatctttcatatcacttgagaaatgggaaatggcagttctacaggtttaacttacatgctactactggcttccctccaagtgaagatctacgggagttatttgacagtggtggttgagtccccgttagagattgcctctttttagttttctcagcagctgaaattggtgattttacatgatttgtatgaccagtgcccttgatgggtgacttgacttcaaccatattattttgttggctcctgcatatttttcacagtggaagattgagtaaaacactccatcactaccaaaatgaaacttaaaacactacgattaacattctctgagggataaacatatttatagtacttataggaagaggaaataagaaaaaacgaatcgagttgctcccataaattaaaatcaacttatgcacataaattttatagaagatttcccatttaactaattaaccattgtcttacctttttaatttcttcttctataagtacttatggagtaatttatcgaaatagggctcaggagtaataaagttaaaacacacctcttatcagggccattta

SEQ ID NO: 5378 - DNA, 631 bp, Glycine max
  misc_feature (589)..(591): n is a, c, g, or t
  misc_feature (605)..(612): n is a, c, g, or t
tcttttgcaccttattgaccgtctcattcaacgcaattacatcatagtatgcccatcttcctctcaattttattaaaagttacatattacttgattaatatattaatttttacattatcaattatgtcagtgttagcaacactctctttaactaacactagtatgtaagatctatcaaaattgataatttttaataaattaaaaatattagaaataaaatataaaataggatgtaattagcatttctttcatcaattaatcagaaattatgaaagatttctaattggttgacagtaataaaatactatacattgtgacctcatatactattttctctaaagattatatctaagatcgatgagactatatatacaataattttaatgcacacgtgacatgttattggctaagtactaagaggtgatgttttgaatgccaggatgcttttggtaaacaagcaagggagagggctgcgttgtgggagccagatagggaggcttggaagaaactctgtgtcacttttttgaagggtagattgtgacataaaaatggcattgaaaagaggaatttcagttctgtaaagaagcgnnnaatatttaaaagtnnnnnnnnggaggggtctatgcattag

SEQ ID NO: 5379 - DNA, 387 bp, Glycine max
catcccaatcagagcactgggaaaagcacgtgacatgtacgtgcggagcataacgaactgcggccagcacgtgagctactacggcggcgaccccacagaaggcgcgggaaggttctcgaggagccacagcgtggccacgtcgacgaggtccgaggttgtcagcgaggattatgcggagcttctcagggccgcgtccgcgagaaccttggcgaatcgaatcgacatggatttggtcctcaaacaacaacaacaacaacatgcgaactcatcgaaaggtaataatttgcccaagtctagcagtgttgggatggcgaggattgaggaggataagccctatgactctgaaaagggtgtgacggattcgtatccgaggagtagaagctatgc

SEQ ID NO: 5380 - DNA, 383 bp, Glycine max
aaccctcttcaggtttgttgcttctttacatgtgcatcttcttcaatgagaatcaaacatgaaaaattatagataattcaatgatataatatatatactttgataacaaagatgcatgcataactttagattttaattttttgtatccatatcactataaagcaattttacactgacaactgataagaaatcatgacaggtgtgattttaaaagaaaataacggtaaaagttaataaatttgtcatattaatttgttataattgaatgaccgtaaaaaaatttatattgtcaatttataaactattttatctaattcatatatgataagtctttgatttttataataactaaattaaaagtggtacctgtatgcatgattgaa

SEQ ID NO: 5381 - DNA, 959 bp, Glycine max
  misc_feature (921)..(923): n is a, c, g, or t
  misc_feature (934)..(935): n is a, c, g, or t
ctctcctacctccaggcttctcccacaaacttcaactatgcaatcgtgcttctgtaagctcttctcactgttttctttgcttccttggaaaatacaaacaatgaatgaatgaagcaaatttggtatcttgagtcacccaattgtgtgtttgtgcgtcatgctctctattttaccataaagttttttttctattcggtttttgaaatatgggtctggctaattttaaatttttaggacacacttggtttgattttattcttagtctgtgttgttgacattgaaattgcttataggagaaacaatctgaattccttccatttgtcattgaggaccacgttgttggattcattcacaatgggtaaaatttaatctctctttttttccttgtaaattgcttgtatcatctcttgcttagttatttgtaaatgtctcattggtttaccttgttggattctggctgaatcaattctttaccttgctctggctgatctatgtagctgaccttacctagtgagaaggctttcttgttgttgttgttgttgttgttgttctgatttattatgatgaaatgaactgctgcacctgcaccttagttaatgatagtggcaggtttattggctaaacttcaaattagttcaggtttgtggagcatttgagggactttggcgatgtatttgttttccccatagataaaaacaatggaggcccctatggtgactttgtttctttgcatccaacactgaagacagctgacgaaagaaccagcgcagttggatatgtggtagagcgtttgggagaggagcagattccaggcatacgggatgaggtattaattatgattattaaattttctcaattgtcatccttctatgcttttctaatgcctatgtatctaacttatgttttttgtccttgtttccnnngctttaccccnntgacatcatcatttggtgcaccca

SEQ ID NO: 5382 - DNA, 312 bp, Glycine max
tttcttgaaccatgtgcagtttctttacctagtggactcatgtcatttttgtcttcgggaaggtacatgagcgtaaattcacctttttatatttttgttttcttgttggcaattttattcacactttgtagttttattctctgagtaatcagaactgcttcaaagacttaatttgattttaatataactaaaactaaacaactgctgagagctgacacatcttctttttctcaaggaattctatttataactttttctccatgttttcccctttggctagcatttggtggcagagaaggaaatctcagatgt

SEQ ID NO: 5383 - DNA, 546 bp, Glycine max
  misc_feature (476)..(477): n is a, c, g, or t
  misc_feature (499)..(501): n is a, c, g, or t
  misc_feature (517)..(520): n is a, c, g, or t
  misc_feature (527)..(533): n is a, c, g, or t
  misc_feature (535)..(535): n is a, c, g, or t
  misc_feature (537)..(537): n is a, c, g, or t
  misc_feature (541)..(542): n is a, c, g, or t
gtctttctgaacattccgtttccttcctccaggtaccatcttgctttctcttttatagttttgattttgatgattccgttgctgagagaggcactttaatccatttgggtctttccagatttttgctttcttgtgttttcctctatccttggaaatcttgtgattccctctatcctagtaaatcttgtgtttgttgatctttctataggcttatgaaaaatgttctttcaggttctatcgggaatttttgtactttttttcttttcctttttagtttctcttagggtccttgtcaatggttggtggtttttccttatgttgctttacatttgatcgcttttgttccttttatctttgccctttttattaacatgtagtttttgtcaagttatgatgcatttggtttgttgataaaattaatgcttttgtgataagcggattaataatttgatatttgggtttcttttgcttgttgnngtacatttatagtgactgattnnnacttgcttgtcttttnnnngaaaaannnnnnngncnttanntcac

SEQ ID NO: 5384 - DNA, 274 bp, Glycine max
cttctctttctctttctcctcctcagtatttcatactctgcttcttcagttacctcactcaccgtaccgccgcgagggggggccccactcgacctcaccactactccgcaacaacaaaccgatggcgatgatgattccctcacctacctctggcccctccccgcagagttcacttccggcggcgacactctctccgttgaccccgcgctcaccctctccgtcgccggaaacggcggtggctccgccattctcagagaggcttcggcgatacaga

SEQ ID NO: 5385 - DNA, 732 bp, Glycine max
  misc_feature (687)..(687): n is a, c, g, or t
attttgaatggctcaggatttcccatatttccacttttaaatcttggacttattagttgtgcatcgtggcaaaaatataaattttctctctcattttttgttttcaaggcaacagcatccaacttatgagcattagaactctccatgttaggtgcaaatgacgattctttaaaagaaggagatggatgtccatcatgtccagacctagatccagacaaagttggaaggagggaagtgtaattagaagtatgacaatagcctgggtccattaggtcagtttgtatctgtatatgtcctaaagaattagaatccatgtctggtctgtgtttgtggatgctatcctgtgaagtgaccccactggaagaggctccaaaagattgcttcagatttgcatattgctccacaaacacagaccagacatggattctaattctttaggacatatacagatacaaactgacctaatggacccaggctattgtcatacttctaattacacttccctccttccaactttgtctggatctaggtctggacatgatggacatccatctccttcttttaaagaatcgtcatttgcacctaacatggagagttctaatgctcataagttggatgctgttgccttgaaaacaaaaaatgagagagaaaatttatatttttgccacgatgcacaactaataagtncaagatttaaaagtggaaatatgggaaatcctgagccattcaaaa

SEQ ID NO: 5386 - DNA, 390 bp, Glycine max
gatgcaagatggagcggtgcattgttaaaactcaagtcaagccaagtggagaggctaaagaagaaggctaatgatgaaccttcaagagaaggggcaagaccttatagcagatttgaatctattgctgctcatatatggagatgtgcatctaaggctcgtgctgaatctggtgagaattccaattcaaaccacccaactatagttcggtttagtgttaattttcgcaataggttactgactccaccaatccctgagaattatcttgggaatgctttggcaagaacaatgacacctaaatgttatgagggagatatcatatcaaagccattaggttatgctgctcaaaagataagggaagcagttaacgcggttacgggtgagtatgtaaag

SEQ ID NO: 5387 - DNA, 724 bp, Glycine max
tctatggcgattcgatctctaactgttttattgtgcaattcgtgtcgtttagagaaatgttgttgtggcagcaatgcattatagttcaattgtacaattagaatagtgcaggatcaaattggcggaaaaaaaaagaataatatgtcgatagtaggaactaaaagtgtaattaattaaggcttctattttctattcctttttcttaatggaacgtagtttgatttctgattggtttcattggtgactgaaatggttggttggtaggttcctggagcgttgtgtgtgttgcaggaagctggagagacagagcttgtgcttgagattgggcagggtttgcttagggagaggttgccaaagacgtttaagcaggatgttgtgttggctatggcgcttgcttttgttgatgtgtcaagggatgctatggctttgtccccaccggatttcattgcggcctgtgagatgctcgagagggcgttgaagcttttgctggtgattcacactcttatatgctccgtttgttcctttaaacacaatataagtaattaatagaataaataatatatgcactgatggtgtaaggatttttttacattgtcattgaatcacaaaccaccatataaagtaaatttgttgacttttctaataactatttaaaagtcaaacctaggatgattactaattggttgacattgtacacttttaacaactgcgcatgcttattgaa

SEQ ID NO: 5388 - DNA, 372 bp, Glycine max
gttcccttacgagttccgagtgtcttctccgccctccacggagaccgagagcagcgacggcgaagaggacttcctcgccggcctcactcgccgactcagtcagacctcgcttcacgaagctcgcaagcagttctctactgtttcggagattccaaggaagacccgtcagggtttggtcggttcccctcagtcgacgctcgccggaatcggcagctggtccggtcggagcaccatttccggcgaaggaagccccaacgggtacacgcgtgtcccctcgccctcgacgatgccgtttgacgaaaacaacgacccctgggaagtgatttacgcagtagcaggacaaatcgcaaggatgaagataaacagcaacaa

SEQ ID NO: 5389 - DNA, 359 bp, Glycine max
ttctgaaaagagtgtaggaagcaacttaggaagtgctggaagtaacaaccttggatgaggtgtaatgggaaattatgggatggaaccagattctaaggtgtatgtatgtagtgctgaactgtgatttcagtggcttggcaacctccacctacatcttatctaaaatgtaatgtaaatgttgtgttctttaatttacaacacaagattggtggctttggcatgtgtttaagggatgaaaagggagttttggttggggagattttgttatgtagatgcatgagggagaggcttttgctttgctacaactacaaagtgtttgatagaatgcaccagcccactttagatgtttgagtgagggc

SEQ ID NO: 5390 - DNA, 307 bp, Glycine max
attctttagaatagcctatgatgtttaggtgcaggtttgcaactttctcagacacgatcactacaataagaaactcctattttgtctacaattcataggttattgatttcaaatatagttgattttgatttcatttcttgttttggaattggtttgcacttcagtcgattaatcatcttaccacctttgatgatgcactgtcatctcacagattaacggtctgatctaaaattgaatttctgttgagtagaatgggtatagttggggcaaaaattgaatttctgttgagtagaatgggtatagttga

SEQ ID NO: 5391 - DNA, 378 bp, Glycine max
gatatgtaaaggtggaagacttaagaatgcgcaagagctttttcaacatctcttggttaaaggctgttgtatagatgtctggacatatactgtcatgatcagtgggctttgtaaagagggcatgtttgatgaagctttggccattaagtcaaaaatggaagacaatggttgcatccctaatgctgtaacttttgaaatcattattcgttctctttttgagaaggatgaaaatgataaggccgagaaacttctccatgaaatgattgctaaaggcctattaggttttaggaattttcatggggagtgatctccagatacaaattaagttattgttaattttcatggtgagcgaccaatgtttattgcgtttgattgttt

SEQ ID NO: 5392 - DNA, 1122 bp, Glycine max
  misc_feature (1112)..(1117): n is a, c, g, or t
gcgtatataaatcaggcaaaactgcaagaggttacaatgatatattgatgtgttaataataatcctttatatcctgtggctgccctgagggatctgtaattcttcataatcaccagcccaaacctgcttcaacattttaattagcccttggataaaccagatgcgagaggattataacaattttgaatcataacaagcaactggtaataccctgtattgattgccagcatagacgtactctacatacaagtctttaggacttcctggacatggatcacagaaacccatgatgcctgatttttttacaccttcatgaagctgcatcaacaaataggacattcatcatctaataaaaaaaatgaaccgtccgacatataaaccatgcatatttcaaaggagaaatgctagaaacaaattctttcgaacaaactcttaaccatgcatatttcaaaggagaaatgctagaaacaaattctttcgaacaaactcttaattacagggaagcccggttagtaaagcaggtggttagagaggtctgtttgatggtttgggaacaaagaggatagggagttataaataccattttatattgaatactattctttgggattgtaataaactggtttcacagttgtagaaggggttttaacttggcagggcagaataatagaattttctctctgattttcttctccctcgtgtctcttaattctatgtgttgatctctctaaggacctatcatccttgaaccctgagtctcattgatgtaaaattcaaggttcagaaatttggtttaaatcccattaaacagaaaaatatcaccctatctattagtttctattactgtctgaccaaagaagcatgctgcattttatctttatcccatatttactgcaattttatattcatctggataagtgggcagacacaaaaaaatgtagttattggaccgtgtagctaactagaatagttttgtgagaacatgcatagtaaaaagaaagggcgtaccttgagttggccagaatcattaactagaaaattcaaaggtattgtaacatcaatgacttctgaagttaattcaaaacttgtttcacttgatgactttaagtgtnnnnnnatctc

SEQ ID NO: 5393 - DNA, 506 bp, Glycine max
ccgtccgcggcgtccatttccaccactcccaacccctcttcgtctccggaggtaacaaatttaactagatctacatatcatttcctcagatccgaaccttgctaaccccaatctaatctaatctcacccgcaggtgacgattacaaaatcaaggtgtggaactacaagctccaccgctgcctcttcaccctcctgggccacctcgactacatccgcaccgtgcagttccaccacgagaatccctggattgtcagcgccagcgacgaccaaaccattcgcatctggaactggcaatctcgcacttgcatctccgttttgactggccacaaccactatgtcatgtgcgctttgttccatcccaaagaggatctcgttgtgtcagcttcgctcgaccagaccgttcgcgtctgggacatcagctctctcaagcggaaatccgcgtccccggccgacgatatcctgcgtctcagccagatgaacactggatctcttacactgatctctta

SEQ ID NO: 5394 - DNA, 1125 bp, Glycine max
agcacccaacagcaaaaccaaacattgcccatctgtagaaatgaaattacatattagtaagtcaaaatacatcagaacttgcacaacaatggggattcaattaagtgtgacaggtatgcaataaataggatgacaatcattaaacacaagaagctgagaagatgatgctttgaatccgagctacttagatttcaactcaatgacattgatgcagataagtgtgtcaagtttccatattaacccttcaattgcatttattcgttttcaacttggcccaaagaagctactataatccataaaacttttatgtttccaatctccaatagattgtgatagaaaactttcacaatgttattgaacacaaccccatcttatcagttgtgactcttcacaaaaaccattctgaaagaaaagttaataacaaaattgtaaaatttcagcatctgacaatgtaaatgttactgttttcattgcaaacaacagtgaagcttttgcagaacaaagaaattgggtatcctgaatcctgaattaggccaatttttggttatcctaaattaggtatcctcaaagcttcacaaaaagagcccattttttgccaattgaattaggccaaagataaaagagagaaaaaatttgttcagcaataaccctttatgttgagggagaaaagaacacaaaataatagaaaggaagcaatcaaccaatgagctagtcacaattatccaatagtaccatcataaagaaaatgcaattaatataaaccccacctaaagaatagctctaattttatactattccaatagcaaaatttttttaccttccattgctaatctcgtttttcccaatgaaaccaaagaaaggaccctgatctgcttcatcaagcttcttctgtttgaagtactcctgcaactccttagccttttgcctctgaaactccaatgtaatgacattcttatcatccccaacaacagtagctggcttctgagggggtgaaggggatggtgatggaggctgagaaggaagtgttggcttctgaagctgtggagcacttgatgatgatgatggttctcttattgggggtgccactggccttcttataggcccttcagcttgagaattccttat

SEQ ID NO: 5395 - DNA, 415 bp, Glycine max
gttttgcagtcatcatctactttttgtttgcactcgggtgaaagagtggaggaaggggactgttcaggtcaacaacggggaagcatcttgtcagagcacacctcacagaggcgtcttgctattcagtaaaccactgcatgtgttgatgctgaggttggtatatataattgagtgaactagtaggttgagtaccttggctatctatctgtaaacattggcaatttgcatgcatgtcaagcggcaaatcattcttggctgggtttcagctgttcatgatatggggagaagaatgattgattgggccatcatacttgtgttgttgaagtctaccagtccttcattatatcctctttttcattttttctgtttttgtacagagatagtagttagcaaagtcaagccaacggattagaag

SEQ ID NO: 5396 - DNA, 735 bp, Glycine max
atcccaagtttgctgccctgcgtattgctggtggcacaattaaggttctctatttacatatattgcttcttagagtcttagttaggtgtaagacactgcaaaaggagttcttacctagttttgactgattctcagggttatggttgtcctggtctttccatagctggaagtgctgttgctgcagcagaagttgctagagttgatgcaagctgctcaactttctttttggtccattcttccttggcaatgctcactattggtattattttttcttttttcaataataaatctctgaatggtaatcgttttgctaatagtaattcatagttcctgaaattttatgtctttgattggccatcaagtatagcattgtgtgggtctgaagctcagaagcaaaagtatctaccttctttggctcaaatgaaaactatagcatgttgggtaagttaccttccttggatttgaatgatctgtatcattttgctaaagttacattcttcaaagaggttgtttttcttttcattaggctttgactgaacctgactatggaagtgatgccagtgctttgaagaccacagcaacaaaggtccagtgcctaatgcatcttatctatcagttgcatttaactcatttgtctttacctgacatattttactatgctcaattgtgttccgatgttcaataaagtatttcttctttgcattgaaaatatcaggtggaaggtggttggatcct

SEQ ID NO: 5397 - DNA, 331 bp, Glycine max
  misc_feature (310)..(312): n is a, c, g, or t
actcgtcgatcttattctcatctcagcctccacttcggccgcgaccctcctctttattcccaacgcagacctaaccctaacaccaaccccaaccccaaccccaaccccaaccccaaccctaatcccactcctcatccccatcctcctcccaattacggaaactcttctccctctaatttatcgtcatcttcatctggatatccccacgcccatgcccaccctcctccaaggacttaccctccttccccttaccctgctccttcttctagggttcagtccactgaggatccttctgaggttttcaagcgcnnngctattaacaagcttgtgg

SEQ ID NO: 5398 - DNA, 758 bp, Glycine max
ttattaggttttatatttgctccaagtatgcttccaacccttatttggatttgttttaattatattcctactttacaatgaaatgcttatgcctattttttgaaaatatggaattcaatgagtaaaagggttcatcttgtataaagtagaatggtagaaatatattaatgctttgacggcttcagttcactttataatgagcttgagtgtctatgctttttataaggcttaaatatttgttgcaaatattatggtactaatgaaatacattccgtgatttttcattcattgtattcaaattggcattttttttgtaagttttgttctacaattttctggccttttttgtacaggttaatagagaaatgctggctgttatagaatcattacaacgccaggctgaagaaaattctgaagagttaagtgataaaaatgatgaaaatctgcatgatccaacagaggtttctaaacccagtgattctactgataaggtcttggaggaaattaaggacaatgagctgaatcagccacacaagcgaaggaaggagtgaaggatgactgcgaagttattttggtcgtttggattatggattttcattgaatagcaagggacggactgctgatgcaatttttttaagtgctagcatagattgctggatattgacttgtatggatttaaatatattttttagaggttcatgtgatagagaattggtatctcctttatttgtgggtttcatgtctctagaaggagaaaa

SEQ ID NO: 5399 - DNA, 574 bp, Glycine max
ctcctcattagcaccaacagtagaagttcaattacacaccatgattcagagcagttttcccgacatgcatcattcatgtcccagaactaatcataattcaaaagacagtaacagcatatcagcacattgaaagttaccaacttgcagcttgttatataactttatattcagttctgaatatctaatgtatcaacagattaaatagagcattgagttgcatgtctattacaatttcaccttttttttctttttaccttgaaagacaatgaggtggctgagataacacacaccagcaccctaaactaaccatttaaatcccaaaataaattaggtgatggatgacttgcacaccggacatgatgctttcctctgcaaccaaggatcgatacactgccataacagaataatgcaaattagcattttacaatttttgcatagaaaaaacaaatatattcatttaatggtctcacatctttgtgaaatttgtgcaaacaaggaaggtggcgaatagtttctccttggacagggatctcaagacatatggcacatgcatctgtgaagttgtcagtcagga

SEQ ID NO: 5400 - DNA, 529 bp, Glycine max
tatcaagtactgtaaataatggtccataatgaaccacctattaaggtggttcaccctagaatcctccttcaagacatggacactaaatatctctgtgactccactactaatttcaacgagaccatcccaaaccagaagtaccaacgtttccaactggttgaataggttctaccaagcccttcgtagaactgccaagcccttccccctgcacatcgatacaaaatgattactatacaatgataatttcttgtaaaaataagtgtgcataagcctgaagcatttgagaaagttgtgataggagttgaaattatattagcaattcttaagaattttcaataaaataaaaaggagtaatttgatgataagaaagtaagaagatacctccttccaacccatgctttttagaagttttctagcataactaccagctccaaatgacatctccaaggcctctgccgtagcttcttgtggacaatcatcaacaggtgaagatggtgtattataaatgtccgacagattcttctgtcct

SEQ ID NO: 5401 - DNA, 356 bp, Glycine max
cggcgtggagcacatgatggagtgcggagattcgaagaaggggaagggggacgccggagagaaaccgagggttccggcgagtgctgacgtggcggaggcgtgctttgcggtgaagcggcagatggaggttctgcaggcggagaacgggttgcttaggaacgccgtggaagatctccggcgagaaattgtcggcggccgaagcggaggctcgattttggggaaaaaccctaaaaagaacgagaggaaaacgacgtcggattacggtaattttcccgggaaatcgacggaggctgaagcgagtgaggaattgaagaaagcattaatgggagcagctggtggtagtagtgcttgaattt

SEQ ID NO: 5402 - DNA, 353 bp, Glycine max
tcatgaatgacgaggacgcacgcatcctctcccctcctttaaactattttgcagtttccatcatcctctctattactttcatagaaaggtcacaataatatttaaccaagccattgctgggctcgacggtctccgctagctccaacagaatgacgaatgctaatcttttcaccagcatatttttgttgaagccattcaaaagcattcacatcaagttttccattaactgacttcccttgcttccgacgagtttgttgctcccgtattgaagcccacaatttcccaacagcatccctctggcgagctgtaaatcttgccacattatcaaaggcatgcttcactaaaatatcaat

SEQ ID NO: 5403 - DNA, 377 bp, Glycine max
gacagagtgtggtgttgtttcgtgatgttcctctctctcaatgctcttgcaatagcattggaagatcacaaccttaaaacgacgtcgaaggatgacatcaagtgcactccttgcggtcaaattccctcgccgcctccaccttctccgccgccgccagctccgaccactacctactgccctccgccgccatcgcctccaagctccggcggtggtggtgcttactattactccccgccgccaccctctcagtacacctactcctcgccgccgccgccggcgtccaccagcggaggcggtggcggtggcgcgtactactacccaccgccgagagggtactacccaacgccgcctcctcccaacccaattgtgccttattt

SEQ ID NO: 5404 - DNA, 311 bp, Glycine max
tgacttgctccccatctcatcgcgcaatttcctctttagccgtatgattgtcaaattataactgtgggaattaggatcactcaccgacccaatactatagtccaaacagttattacacatcacaatactattttctaagaaattacgtattttctactctgtcgggtcctctttaacttatcttccataaaatatcaaaacaacttcaatatctattttcatcttccagttgtataactctaaatttaaatttgcaataaacctaaatattttcagggaaaaaaagaaagagagagaagccatccatgtct

SEQ ID NO: 5405 - DNA, 480 bp, Glycine max
tttgaacgacgtattgcctatagcaaatttcaggtgtgtataaaaataatagtttgacatgttgcttttctaatcccaatattaaagcaatgctgttgtttttttggaatcatggtatgttgtcatcagatatcttggtgtttcttcctaaattttgtttcttttatcattcataactttctaaaacttgtatgcagattgctagttttatcaagactcatatatttagccggaggaggccaattgatgggtggaaatatatgattgagttggtgggaccaaatgctaagagagggaagggtagtgtttctagagtaccaagtctatctgatccctctacccaaccattcaaggaggagaaaaattcagttgataagacatatgttccccgtgagagaaggtagcttggtcatgtggtgttgtgtaatcactttaattgtgctgagttgctgctacttagcctttactgacaacagatgc

SEQ ID NO: 5406 - DNA, 375 bp, Glycine max
gtttattcttgttggaaattttgaaatcagattaggagaaagcgagagaacgggtttccagtttccacaggttttctgcccctggttttcaaccttgtaacagctcctttggtcctgaatatggttgggcgctttcatactcttgcctttagcattgaattgtatttctgtgataagaaacatcttgttggcaggtttgataaaagcagttattgaagacatgttagaaacatttgtatttcggtgatttctctctactttcagctctgattcccaacaattactgcaagaggctctagttttcaaatgttaactgtagacaaatatgcagatactctgatgtatgacagtataactgtactatctagtattcat

SEQ ID NO: 5407 - DNA, 332 bp, Glycine max
attcggtgttcttcaaagaacacagactgcaccatcacaaacacctatggcgtctttccggaccgaagcatttgccacgccggtgaggttatgtacccaaacacagaggaggagctcatatccgcggtggcctcagcttcgaagaacaaaagaaaagtgaaagccgccacgcgcttctcccacagcatcccgaagctggtttgccctgatggcgaaaacgggttgctaataagcactaaaaatctgaacaagatattgaagattgacaaggaggcaaggacgatgacagtgcagagtggcgtgtcgctgagagagataatcagcaagggtgg

SEQ ID NO: 5408 - DNA, 241 bp, Glycine max
catagttttccctcacatattgttccagcattgtaatttgaccgtgctaaggttggatgtgcatttgtattttgtgcctctttgttttggactgaagttgactcttaggaatgtgtttcgggaaacaatttggaaattagattgatattattatagttggtattggctcattttcaagaaaatgacctgtacaaggttctgtggaaggcttagagaagtcatttgttgcaagggctactta

SEQ ID NO: 5409 - DNA, 348 bp, Glycine max
ctctgctttcacatgagagagtattattgggttgatatgaagaagattaatgaaatttaccggtacaagacagaagagtattctactgatgctgtaaacaagtttaacatctatccagagcaaattccttcatggctagtagactggatttccgaggaaggtggctacttcattggcaatttgcaacctgctcatatggacttcaggtttttctcactcggaaacctttgggccattgtttcatctttaggcacaacaagacagaatcagggcattttgaatttaattgaggccaaatgggatgatattgttggtcaaatgcctctcaagatttgttatccagcgcta

SEQ ID NO: 5410 - DNA, 503 bp, Glycine max
  misc_feature (402)..(402): n is a, c, g, or t
  misc_feature (410)..(412): n is a, c, g, or t
  misc_feature (420)..(420): n is a, c, g, or t
  misc_feature (422)..(428): n is a, c, g, or t
  misc_feature (444)..(445): n is a, c, g, or t
  misc_feature (448)..(449): n is a, c, g, or t
  misc_feature (452)..(452): n is a, c, g, or t
  misc_feature (458)..(461): n is a, c, g, or t
  misc_feature (463)..(467): n is a, c, g, or t
  misc_feature (470)..(474): n is a, c, g, or t
  misc_feature (477)..(479): n is a, c, g, or t
  misc_feature (481)..(485): n is a, c, g, or t
  misc_feature (490)..(495): n is a, c, g, or t
  misc_feature (497)..(499): n is a, c, g, or t
aagagaacaaggtagttggtgttctttgggctaataagagggacagtggactatggtttgcacctcctgagtggagagaatgtaggcttggcattcaactcttaccgatactgcctatctctgaggtcttgttttccaatgttgattttgtgaaggagcttgtggagtggacattgcctgctttgaatagggaaggtgttggagaaggatggaaggggtttgtctatgctctgcagggtatttatgacaatgaaggtgcaatgcagaagataagaagcttaaatggatttgatgatggaaactcattgactaatctcttgtggtggattcacagcagatctgatgacgaggaatttggtcatggaaaacactgctggtttggtcattactgccactagaaanagattagnnnatgagttncnnnnnnncattccttttaagctnnttnnctnctgcannnnannnnnttnnnnncannncnnnnngatcnnnnnnannncctt

SEQ ID NO: 5411 - DNA, 1330 bp, Glycine max
  misc_feature (1318)..(1318): n is a, c, g, or t
acgctaaggcagggatatggatagatattatgacattgtggagcagctgaaggaatcctatcgacgctgtggaccggtatattctattttgcccctccccatgcatgcactatttgtataattgtatgatagaacccaaatgttggaccagtaatattttagtgcgttcttgttctgcattcaacagtttctcaaaattttgttcatgcttaagctccttttgtctaatcttgtccatttacctttctgtattggattaaaaaatctttgaaaatacttgtaccgtctaaatcacatgtacgataatcttgaaggaatttatgtagattgaaagtgattgtgcatgatacaattaatcctctagttcacgtggatgtctaactcttaagccagttcatcttacatattcttcaatagcaacctgatatgcattgacagctatggtaattgaccgataattgtctggttcgactagatgcaattttggttgtgtttatcgttaagcaaattagtgatttaactttttatcaagagtttgtgtttgggatataggagtctttttttaatcttttctctaagtgtttcatgtattacctaatttgtaaagctctgctcgcatttagtatatatcttctaaacatgtctgcatgatgtgaattgcagaggcacaagagattgaagaaaatatttgttgttcttcatacggaattggaggtaattatttacattttctctaaccttgatctagaattgttttcttagagtaaatatacaatttcatccttgaaagtgccaacatatattgatttggtccctgaattttatccttgaattttatccttgaatttgtattttttatgagaaattagatcttccaacttgaaattaactaaatttggagtctaaatttgtcaggaagttgacagattgagggactaaattgatagagaagaataaacttgtcacaaagttaacagattcagggattaagttgtattcacataaacttagggatcaaattaacatagattgccatttttggaggcaaaattgtatacttactcttatttttattaaatggtcaactttttgtcttttctcataattgtttagttgtattgcttctttctacatgctcctgatgcttcttttttttcccacttgcagaatctcaagggaaggatcaaagacttttcaaactcgtataataaatgatgaaaatacaagagtactatatagataaaattgaagcctgtttatcaaggttaagaacttttgggtgatacatgatgcgcagttgagtagatgaaattctttngtaggttgggtg

SEQ ID NO: 5412 - DNA, 981 bp, Glycine max
  misc_feature (61)..(62): n is a, c, g, or t
  misc_feature (64)..(65): n is a, c, g, or t
  misc_feature (435)..(435): n is a, c, g, or t
  misc_feature (469)..(469): n is a, c, g, or t
  misc_feature (481)..(482): n is a, c, g, or t
  misc_feature (883)..(886): n is a, c, g, or t
  misc_feature (922)..(922): n is a, c, g, or t
  misc_feature (924)..(929): n is a, c, g, or t
  misc_feature (972)..(975): n is a, c, g, or t
gctttggctgatggaggagtagcagctggtttaccacgtgatctttcattaagtctagctnntnnactgtaagtgaaatgaaatactatccccatttaatgaataaaattcattctttatttctccgaatgtgtataatttttctgatgtttgcttttgcattgtcgtattctgccattttgtcatatatatatatatatatatatatatttaagatgaatcaagtatgttgaagttagtgaattttaaattttatattaaaaaaaaaaatccagttttctatggtgtggtatttttccagtttgccaagaaaaaaacttctggctttataactaaggagaagagtgtttgaatttcagtgttattattatctttactgtgtgcacaagtccaaaaaacaaaatttactctaaaccgtgtgtccaacaataaatncaaaatttgggttcaagtaatttaccaagtatcnctctatgttgcnntgtttaaacagagagagcaaattaatctcccatccccggtttatagaaaagtcagctactacactagtgcatccaaattatgttgaccaatccttatacttggtcgcaattttttactggttctagttaaccaacacacagtgcttgcacataggcatatactagtattaccttacctacatttgagaaatcccgttctatagttgtttgcttgacttgtgtatttgtgtgttttgcaggtattaggggcagcatcaatggtctcccagactgggaagcacccgggacagctcaaagatgacgttacttctccaggtgggacaacaattacgggcattcatgagttagaaaatggtgggttccgtggaacactgatgaatgctgttgttgctgctgctaannnnagccgagagctttcctgaatcaagagattaggattnannnnnnttttagaccaaaatctgatttcggtcgaattttcagtcactannnnagaact

SEQ ID NO: 5413 - DNA, 614 bp, Glycine max
tcatgaccatttggcactaccacggtggctgccaagtagggaaggttcttgatagggactacaagcttcttggtgtggatgcactgcgtgttattgatggctccacctttaactactctcctggaactaatcctcaggccactgttatgatgcttggcaggtatgtatgtatatatactcctaatattttcatataatatgtaatatgtgactttaatttaggaacttatatcaaatgaattacagtttcaaggacatgtttttttatttcatcaaatctaaagactacgtagtgacagcaaattgcaattttaagactaatttcaccattcatttgtcccatttgattttaacacgtgttgattgttggcattttcaatttgatgcaggtatatgggagtgaaaatattgagcgagagactaggtggtgcggctgctgctgctgctgaaacagagcaataagttgtatagttttcctttcaacaaagtgtcttcgtgtcactgaggaaaaacaaattcttgtgagaatgatttgtgaagtaacctttcaatgagaaaaataacaaattaaacattgttcctgtaatcgatgaagtgaaactagaggagggacg

SEQ ID NO: 5414 - DNA, 340 bp, Glycine max
aatatagagggtaattggccctttttggatcatttttgcaaacaaaaataccaatatgggcttgccataaaactatttactggcatggatctcttttgaccattgaccgggtcaaaatgttagtttgacttgtgatcaatgttgttaatggcggatgacgtagcggaaaatggcggatgtcatggcggacaaaaaaaaaatatacatatatataattataaataaccaagtaccaacaccaaataaactcattgaaattgaaaaaatcaatggattgcattcaaataaactaaaaaagtttcatgggtgtcaaaaataaaaaagggtgtcaaatagaaaa

SEQ ID NO: 5415 - DNA, 365 bp, Glycine max
gacggttgaaccagcaaaagtgtgcaacagtgcttcagaacctgatgtttctacttttgctgggaaagaaaatgtcttaacttcttgccacactgaacccttgattaaatcagctgaaactatattgaatgagaataataatatggttgctagaaaagttttccaggaatcctcatggaatggagctctggatttatctggatgtcatatggaagtagacggaggtggaaaatcagaaaccgagttcgtttctgatagaaatttctgtgattatagtagtttagatacaaaggccgaagtgcaagattttgtttcaggtttttcacctaaaagaaataatgtaactgtcagtggtagtttatctt

SEQ ID NO: 5416 - DNA, 667 bp, Glycine max
aaaaaaggttcactcactcttcatgccaacaactctttcactttctttaacggacagacatacagaaatttcaaattttttttttgttatctaggtttggctctatgtttaagtcccacattctaggttgtccctgcgtgatgatttccagccccgaggctgccaagtttgtgctgaacaaagctcaactcttcaagccaacattcccagcaagcaaagagaggatgttgggaaaacaagctatcttctttcaccaaggagagtaccatgctaacttgagaaggcttgttcttcgcaccttcatgccagaagccatcaaaaacatcgtaccggacattgaatccattgcccaagattgcttaaagtcttgggaaggccgtttgatcaccactttccttgaaatgaaaacggtgagtgagccctccaaaacagacacagcacaaaacagagctaaacagagctcctctgctttccttctctgctcatttttccttcgaaaacaaaaataataataacaaaagaaaaattacccatttcatgtctaattcctcgttggttttttttaacaaaataaaaaaagaaggggcttttacggtttttgattttggggtctcctgtcctgcagttcaccttcaacgttgctctgctttcaattttcggaaaagaa

SEQ ID NO: 5417 - DNA, 1302 bp, Glycine max
ctccgtgcgacatcgaaggtacgcttctctctccctacaactttgatcttggaacaaacttggaatctcacactcccaccccatttatggttctcatcatttcttaaaatttgtttgcacgctttctcaactcaccaacttggttcagtcttcattttttcccccattatttagttcactgttgttcaataaacctttcccttgtttaattgacagtgtagcactcaattctttagcaccttttttgttgagtggaagaaaaagaattctttttatctgtgcaatgcgtttttggagatagtttatttgttcatagaaatggacattttttcccatctttttctgtggatgcatgtatagagaaattataaagcgaaatgcgtttgaatctcagtgttgtgaaaaagaaaacttggcttctttagtctctacctttagatcacattgtaatttgccgctaggcttgttgtgaattttatgtctcaaatgaaattcgttcatttctggttttttgacgcatcttttcttgtttattacaacttttaaattcgtatgcaactgttcagattcgttattatgaactgactcttgttcatgaggtttttattcgtcacctcacgtcacctattgaatttcgaaatgaaaattatgaaattatgtgtggttatctcaatctgggtggttgtgctaatatgtaagaaagtgaagaaattgttaaatatttgggaaataaaaattatgatttgggtttgattcttacttgcatacacaagaaatatgtgtaatgtgttgatgttcctatttaaagacacaattagctgattcaatgttgttgtttgaactggttttctagtgtaccatgtatagctttcttttcattttaattgaaaaaaaaagaactgcggttgatcatgttgaacagtttttgggtttatgataatgattcatttgtcttttgctagagtaaagaatgggtgacaagaagaagaaggctcagatgtttgtaaagctagtgtctgctgctgggactggattcttttatgttaagcggaagccaaggcagtttacagagaagcttgagttccgaaaatatgatcctagggttaatcgtcatgttctgtttacagaggctaaaatgaagtgataggacctttaatggcttcctttgcattgtaactgaatcattcttgtatttctctgagacaattatctcatttggtattagattatgaaccatgcactcatgccaatccttttactgtctctgcctcttagctattcaggttcggtatcagttcatag

SEQ ID NO: 5418 - DNA, 365 bp, Glycine max
aaaacgcaacctttttttctccccctttctattctctctgctctctccgtgcgtgtcttttatcctgaacaaaaaaatcacctttcccttattagggttttgaaatgtggagggagaatggaaggctctgaatccgattctgtgtcactttccatttccaatggcgaagagccccaattggggcgaccttcttcccccgccgctcctcctgagccgtcagatctcaatcatgcggcggaggaagagacactctccggggagcttcagagcaagttggatttgaaggatgtggatgaaagtgaggagaaagtttcggactttaacgatggtggaggagtttgtgatgaagaaactggtaagggtga

SEQ ID NO: 5419 - DNA, 373 bp, Glycine max
  misc_feature (77)..(77): n is a, c, g, or t
atgaggaaacattcagtggaaagttgcacaagggagaaatgtctcctgagaaagcagtttcaaggaaccaggatgcnaataataaactggttttctttgagggatgtaattatgcctttgatttggaggatttattgagggcttctgctgaggttctgggaaagggaacgtttggaactgcctacaaggcaatacttgaggatgcaaccacggttgttgtgaagaggctgaaggaggtagccgttggaaagaaggattttgagcagcacatggagattgtaggaagtcttaagcatgagaatgtggttgagctcaaggcatattattattccaaagatgaaaaactcatgggatatgattaccacagtcaggg

SEQ ID NO: 5420 - DNA, 388 bp, Glycine max
aatgaactccaaccttttagtacaaaaaaccttatatcatatgctaaatgaaaaaagatgattcatctctaactctagacaaaataaatcagtaaaagtggatacaaacccctcctcgccttacttcttcacctcctcgtattctgcctcgggagcctggtccccaccctgagaaccaccagctgaggaaccgccactagaacctcctgacatgtgctctccaatcttggatacagctttgtttgcagcatcaagctttgacttgatttcatcaacattatcctctgacatcgccttcctcagatccgaaactgcatcctcaatttctttggccacttcactgggaatcttgtctctgtattcacctaaactcttctcaatgctatat

SEQ ID NO: 5421 - DNA, 856 bp, Glycine max
gccgaagctgcagattgtgttgttttctctcctttgggggtcaaacaagcggttctcttcatggtaatcaatcttatccttcttctttcatgcattatattcattcattcactgttcttctcttccacaactctgtctgtgtttttctcttttacttaaaaaaatatttggtgagaaattattgcgtatgatctgaaaccactgcatgttcgtaagttcagccaatattcatatcacacataatagaattgtattctctctcttttttttagtaaattcaaaaacttgttcacatgttaagagaagattgaccgacatgaaaacgtgataatcaatgaattaatcgctagacttagtaattagcttctaccgtgtgacataacagttttttcttcttatatatgttatttgttgaatttgtttaattttgagtttatatttgtttggttttttatttataaactttaatggggttgttttgttgttgtggttgttgtttgtttcctttttctcccacaaaatttagtgacatactgaatttggtttgatatgatatgattttgattttgctgagtctctgattggtactgttgcatgtgatagatgccaagtgttaaccctgacaaagattccgagccatttgttgagaccgatccaaccggtcgctatggtagatacagtgagttgctcggatgtggtgctgtgaagaaagtgtaccgtgcatttgatcaagaagaaggaatagaggtggcatggaaccaggttaagctgaggaacttctgtgatgaccctgccatgttggataggctttactctgaagtgaggttgctcagaagcttgaccaacaagaacatca

SEQ ID NO: 5422 - DNA, 720 bp, Glycine max
  misc_feature (605)..(606): n is a, c, g, or t
  misc_feature (655)..(657): n is a, c, g, or t
aagaagcttcagaagtacatgccccaattgttgcattagaaagtgatgaatgcaatgtcaacgtgtatgaatcacttgataatccaacagtaggcaaaaagaagataggttttgctacttttgcaacagggatagtccatggcctgcaaccagatgcattgatgatggtgttgcctgcccttgctttgccttcacgtttagctggtgctgcatttctcatcatgttcttaattggaactgttatagcaataagggaagaagcccaagtgagtttctcggttatcctaggtactctatccttcagtgcctggctacacgagcctataaacacagtataacttcccattgcaattacagttccaattaagaacatgatgagaaatgcagcaccagctaaacgtgaaggcaaagcaagggcaggcaacaccatcatcaatgcatctggttgcaggccatggactatccctgttgcaaaagtagcaaaacctatcttctttttgcctactgttggattatcaagtgattcatacacgttgacattgcattcatcactttctaatgcaacaattggggcatgtacttctgaagcttcttatatggtggtnntgtaattgcaatgggaagttatactgtgtttataggctcgtgtagccannnactgaaggatagagtacctaggataaccgagaaactcacttgggcttcttcccttattgcaat

SEQ ID NO: 5423 - DNA, 479 bp, Glycine max
tttgtcttcaaaaagaagggcaaccagtggatttatgtcgtctgggtttattctggcagtgattggggctccgttgaagctcttcattgtatatgctttcgtttctttcttcttgactctctttgtttgctactgttgctgtatgctacactgcattctgagccacaatactgtgaacctacctgtttcaatgcgattgaggccaaaaaggttcgtttggtgtgtgttgtttttttttatttccttggttttgttttatgggttttggttctgatgttttatttttcgtgttttttttaacaggacttgttgtggagtggagtgtttcggaggctttcacatacaaagattttcttatctcttcatattcttaagaggggatttcacctaagaccttgagagattttgctaccttttttttttttccttggaaattccctttttttattccattccgtttccttttcggggaactttga

SEQ ID NO: 5424 - DNA, 402 bp, Glycine max
tactcaaaaggccctagctatgattttttttttaaacaattaagttgccctagctatctatgtagcttgttagctaatagctatagctttcttgttcaaataacctagacaagaattgcgttaggttgcattgtcgatagaagactataatttataccactatgcttcatgtgatgggtcaataatttattaagatctatataatacttcttccttgcttgtttgtgtttgagtgttgtaatgcttcggatacaagcatggcctacaataatattagtagccttgcaaaagatatatagtaattggttatttcgtgtgtttgctgcacaattaaaggatatatagcgatgcctttgtgggtgcttaattaattgttaaaaagttggtgagggatatggaagg

SEQ ID NO: 5425 - DNA, 601 bp, Glycine max
gtccctacactttgagggtggtatggaccttaaagttaaaggatataccatatcaaaacatagaagaagaccgctacaataagagtcttcaacttcttgaatacaacccagtatacaagaaaactccagtgcttgtccataatggaaaacccttatgtgagtccatgcttattgttgaatacattgatgagatttggtcacataattcattacttcctgctgatccctacgagagagctctggcaaggttttgggttaaatatgctgatgatgacatggtaatttttaaaaacttaatcatgtagtactacttaaagtttctagcctttgatcttgatcaagagcacctgcatttatacaattaatattaaatttatctgaactttggcaataattaacttagcataccatcttatattttctcattaattactttatatgctgcaacatttcctattttgatccaagtgataataatatttggggtcaacttttgaagttttctgcagttattgcattcttccttagcaataatgatgaagagcgagaaaagagcatagagaagatatgggagcatctcagggttgttgagaatcagtgt

SEQ ID NO: 5426 - DNA, 214 bp, Glycine max
gaggcttctgctaggacagctcaaatgtagaagaggtgatgtatctcagtcaatagcaagcatgatacagtacatatgctttgcaaccccaacaatactgtgaattaccatcaaaagcaacttactgtttcttctgcaggcttttataagaactgctggcaagattcttcagaatatccaggaaggtgtgtttgatgtgtccaatgaggtaatt

SEQ ID NO: 5427 - DNA, 359 bp, Glycine max
tgaggaagctgtgcattaaggggtgccccgtgtcgaatgctgggattgcggctttggcttcagggtgtcccaatttggttaagctcaaggtgaggaagtgcagaagggttaatggtgaagttgtggagtggctgcgtgagaggaggagttctctggtgtttagtattgattacagtactgaagttgaggctttggatggaagtggtagtgatgttggcgctcaggaaagtagcatggcgtctcctccaatcgacacaacacaagtgtccatggttgatgatcctccttcaagcagtaataatagcagcagcaacaacaacaacaacagattgtctatgttcaggaacaagtttggattt

SEQ ID NO: 5428 - DNA, 1224 bp, Glycine max
  misc_feature (375)..(377): n is a, c, g, or t
  misc_feature (380)..(382): n is a, c, g, or t
  misc_feature (387)..(390): n is a, c, g, or t
  misc_feature (392)..(408): n is a, c, g, or t
  misc_feature (410)..(413): n is a, c, g, or t
  misc_feature (417)..(423): n is a, c, g, or t
  misc_feature (427)..(427): n is a, c, g, or t
  misc_feature (432)..(433): n is a, c, g, or t
  misc_feature (435)..(444): n is a, c, g, or t
  misc_feature (446)..(453): n is a, c, g, or t
  misc_feature (456)..(460): n is a, c, g, or t
  misc_feature (463)..(463): n is a, c, g, or t
  misc_feature (466)..(484): n is a, c, g, or t
  misc_feature (497)..(519): n is a, c, g, or t
  misc_feature (523)..(523): n is a, c, g, or t
  misc_feature (525)..(530): n is a, c, g, or t
  misc_feature (532)..(541): n is a, c, g, or t
  misc_feature (547)..(559): n is a, c, g, or t
  misc_feature (564)..(564): n is a, c, g, or t
  misc_feature (568)..(573): n is a, c, g, or t
  misc_feature (575)..(575): n is a, c, g, or t
  misc_feature (577)..(588): n is a, c, g, or t
  misc_feature (593)..(605): n is a, c, g, or t
  misc_feature (607)..(607): n is a, c, g, or t
  misc_feature (613)..(615): n is a, c, g, or t
  misc_feature (619)..(640): n is a, c, g, or t
  misc_feature (642)..(656): n is a, c, g, or t
  misc_feature (658)..(658): n is a, c, g, or t
  misc_feature (660)..(660): n is a, c, g, or t
  misc_feature (665)..(670): n is a, c, g, or t
  misc_feature (672)..(672): n is a, c, g, or t
  misc_feature (677)..(677): n is a, c, g, or t
  misc_feature (681)..(688): n is a, c, g, or t
  misc_feature (693)..(696): n is a, c, g, or t
  misc_feature (698)..(702): n is a, c, g, or t
  misc_feature (710)..(720): n is a, c, g, or t
  misc_feature (725)..(728): n is a, c, g, or t
  misc_feature (734)..(740): n is a, c, g, or t
  misc_feature (747)..(747): n is a, c, g, or t
  misc_feature (749)..(751): n is a, c, g, or t
  misc_feature (759)..(762): n is a, c, g, or t
  misc_feature (764)..(772): n is a, c, g, or t
  misc_feature (778)..(781): n is a, c, g, or t
  misc_feature (783)..(786): n is a, c, g, or t
  misc_feature (789)..(794): n is a, c, g, or t
  misc_feature (809)..(811): n is a, c, g, or t
  misc_feature (814)..(814): n is a, c, g, or t
  misc_feature (816)..(818): n is a, c, g, or t
  misc_feature (822)..(824): n is a, c, g, or t
  misc_feature (843)..(854): n is a, c, g, or t
  misc_feature (860)..(862): n is a, c, g, or t
  misc_feature (864)..(865): n is a, c, g, or t
  misc_feature (882)..(882): n is a, c, g, or t
  misc_feature (893)..(894): n is a, c, g, or t
  misc_feature (900)..(908): n is a, c, g, or t
  misc_feature (910)..(913): n is a, c, g, or t
  misc_feature (915)..(927): n is a, c, g, or t
  misc_feature (940)..(942): n is a, c, g, or t
  misc_feature (951)..(953): n is a, c, g, or t
  misc_feature (958)..(958): n is a, c, g, or t
  misc_feature (968)..(969): n is a, c, g, or t
  misc_feature (975)..(975): n is a, c, g, or t
  misc_feature (980)..(982): n is a, c, g, or t
  misc_feature (984)..(990): n is a, c, g, or t
  misc_feature (1005)..(1009): n is a, c, g, or t
  misc_feature (1018)..(1018): n is a, c, g, or t
  misc_feature (1020)..(1039): n is a, c, g, or t
  misc_feature (1043)..(1057): n is a, c, g, or t
  misc_feature (1060)..(1069): n is a, c, g, or t
  misc_feature (1074)..(1076): n is a, c, g, or t
  misc_feature (1081)..(1081): n is a, c, g, or t
  misc_feature (1083)..(1091): n is a, c, g, or t
  misc_feature (1095)..(1102): n is a, c, g, or t
  misc_feature (1105)..(1122): n is a, c, g, or t
  misc_feature (1124)..(1139): n is a, c, g, or t
  misc_feature (1142)..(1147): n is a, c, g, or t
  misc_feature (1152)..(1162): n is a, c, g, or t
  misc_feature (1164)..(1180): n is a, c, g, or t
  misc_feature (1184)..(1201): n is a, c, g, or t
  misc_feature (1203)..(1206): n is a, c, g, or t
  misc_feature (1208)..(1212): n is a, c, g, or t
  misc_feature (1218)..(1218): n is a, c, g, or t
  misc_feature (1220)..(1221): n is a, c, g, or t
tggtcattggtggagatggatactgtggttgggcaactgccctccacctttctaacaagggttatgaggttgccattgttgacagccttgttcggcgcctttttgatcaccagcttggactggattctctaacaccaatttcttccatccagaatcgccttcagtgttggaaatctctcactggaaaaactattgagctctacatcggtgacatatgtgattttgagttcttatctgaaaccttcaagtcatttgagcctgatgctgttgtccactttggggaacagcggtctgctccctactctatgatagaccggtcaagagctgtgtatacccagcaaaacaatgttattgggacactgaatgtgctcaaannnagnnnaacgnnnnannnnnnnnnnnnnnnnnannnncacnnnnnnnaagnggggnnannnnnnnnnncnnnnnnnnaannnnnacntgnnnnnnnnnnnnnnnnnnnaaaaaaaacccannnnnnnnnnnnnnnnnnnnnnncccnannnnnntnnnnnnnnnnaccccnnnnnnnnnnnnnccaanaggnnnnnngntnnnnnnnnnnnntcccnnnnnnnnnnnnncnacatannnccannnnnnnnnnnnnnnnnnnnnnannnnnnnnnnnnnnncngnaggcnnnnnncnccccnttcnnnnnnnntaatnnnncnnnnntttttttnnnnnnnnnnngcctnnnnctttannnnnnnttccctncnnncctttccnnnntnnnnnnnnnatcccnnnntnnnnctnnnnnnttctcttttcccccnnnccncnnntttnnnattttcttccccccccttnnnnnnnnnnnncccccnnntnnttttttttttttccccnccccccccctnncttttnnnnnnnnncnnnntnnnnnnnnnnnnncccttctcccctnnnccttccctnnntttcncccccccccnnttaccntcctnnntnnnnnnncccctctttcccttnnnnntcccccctntnnnnnnnnnnnnnnnnnnnncccnnnnnnnnnnnnnnntcnnnnnnnnnnccccnnntatcncnnnnnnnnncacnnnnnnnnatnnnnnnnnnnnnnnnnnntnnnnnnnnnnnnnnnntannnnnnccccnnnnnnnnnnncnnnnnnnnnnnnnnnnnactnnnnnnnnnnnnnnnnnntnnnntnnnnncctctntnncct

SEQ ID NO: 5429 - DNA, 411 bp, Glycine max
cttgaggtacagaggggtgtgcggaggaatagcatccacgactgtttggatttccaacctcattgttgctgagtccttcttgtccctcacagaagctatagggacagcatggacattcatgctgtttggaattgtggccattgtggcaatcttctttgtcattgtttttgtgcctgagaccaaaggggtttctatggaggaagtggagaagatgctggaacaaagatctgtgcagttcaagttttgggagaagagagattctggctctgagaagcactgactcaaagaacaataaaaagaaaaaagcaaaattgtttgagtcatgttttagtttttatagcttaaaatgttgaaattaagtggcttgtgaagttatggttatttgatgacaatggttgttctctttgggta

SEQ ID NO: 5430 - DNA, 357 bp, Glycine max
gctttctccttctccaaagcacttgtccttgcctgctccttctgcttatttgcgtctttggcttttggacgcgatttctccattgtgggctattcatcggaggacttaaagtccatggataagctcattgaactctttgaatcatggatgtcaaaacatggcaagatttaccaaagcattgaggagaagcttcttaggttcgagattttcaaggataacctaaagcacattgatgagagaaacaaggtggtcagcaactactggcttggcttgaatgagtttgctgatttgagccaccaagagttcaagaacaagtatctggggcttaaggtggactactctcgaaggagattgttc

SEQ ID NO: 5431 - DNA, 375 bp, Glycine max
ctcacagggtcagataaactcaaactcaatccttgtcgctctgttggactcccattacaccgaactcgctgagcttgtggaaaaagccatgcttttgcagactctggagaacactgtcatgaacaacagcaacaacatcacaatcttcgctcccagaaacgaagccctcgaacgcgatctcgaccccgatttcaagcgtttcctcctcgaaccccgcaatctccattccctccaaaccctcctgttgtcccacatcgtccccaaaagaatcaccaaacccgaattcaaaaccgggtcgacccgacacagaactttagcgtctcaccaccacctcactctccaagccctgaatttgactcactggaatgttgagtc

SEQ ID NO: 5432 - DNA, 976 bp, Glycine max
  misc_feature (634)..(634): n is a, c, g, or t
  misc_feature (719)..(720): n is a, c, g, or t
  misc_feature (723)..(724): n is a, c, g, or t
  misc_feature (730)..(733): n is a, c, g, or t
  misc_feature (735)..(739): n is a, c, g, or t
  misc_feature (742)..(751): n is a, c, g, or t
  misc_feature (763)..(766): n is a, c, g, or t
  misc_feature (769)..(769): n is a, c, g, or t
  misc_feature (803)..(803): n is a, c, g, or t
  misc_feature (809)..(815): n is a, c, g, or t
  misc_feature (817)..(822): n is a, c, g, or t
  misc_feature (831)..(833): n is a, c, g, or t
  misc_feature (840)..(841): n is a, c, g, or t
  misc_feature (843)..(843): n is a, c, g, or t
  misc_feature (848)..(858): n is a, c, g, or t
  misc_feature (864)..(868): n is a, c, g, or t
  misc_feature (891)..(912): n is a, c, g, or t
  misc_feature (914)..(914): n is a, c, g, or t
  misc_feature (916)..(917): n is a, c, g, or t
  misc_feature (919)..(921): n is a, c, g, or t
  misc_feature (929)..(936): n is a, c, g, or t
  misc_feature (939)..(943): n is a, c, g, or t
  misc_feature (945)..(953): n is a, c, g, or t
  misc_feature (955)..(955): n is a, c, g, or t
  misc_feature (969)..(970): n is a, c, g, or t
aattcagcataattttgcaaactttctcagctgtagcatgtgaatagaactccacaaatccataaccctctgataggccagtttgcttattgcgaataaccttgatggaggaaatctgcaaaattatacagcagtcagaaagaaggttggatatgagaagcacaggcaacatctttgtcctaagtcctaacaaattaagtctccaaaatgcagatatattttcatcaaattagactagcagagaagtaaaacttgtctgcaaacttatggtgtgaaagagttcattaatgtacttatgtacacacaaatgaaaaaaaaatgacatccacatttctatttccattcgtcaaccattaattcccaaactagaacgaatctatttccatctataagagtggcactttgattttattcctacaaagggaaacattatcatacactccactaaatacaattttggatagcataaccatactgactctcggtgtaccaaagaacttttccttttcaatatatcaaaaataaagttgacacttgacaaacatgcatgcgacgacaaccttgtagcacatcgtaacaaagaaattagtaccaagcaccaaccacaaaaaaaaaaaaaaaaaatttttttttncccaaattttccaaaaaaacgggaaaaaaaaccccccccccccccaaaaaaaaaaaaccccaaacttaaaaacttttttttcccnnccnnaagggnnnngnnnnnttnnnnnnnnnncgggaaaaaaannnnaantttttttttaaaaaaaaaccccccaaaaaatttnaaaaannnnnnntnnnnnnttttttccnnnaaaaaannanttttnnnnnnnnnnnaaaacnnnnnaaaaaaaaaaaaaaaaaaatctnnnnnnnnnnnnnnnnnnnnnncncnnannnaaaaaaannnnnnnnttnnnnnannnnnnnnntnttaaaaaaaaaaannaaaaaa

SEQ ID NO: 5433 - DNA, 379 bp, Glycine max
acaacgtacgaggatcaagatcatgatcatgatcatgaatatgaatccgatgatgttgagttgtttcctgtgtcgtcgcaaacaactagcttcattgtaagagtggaccgtggcgaccaacaacaacaagcagaagaagaacatagacaacatagtgagggagaaaccaacagtagcagtgaaggtgaattctcatttgtaaaacctgaccccgtagaaattagaaccaccacatagcagcatatattcacctctattcttttgcaatatcttcacataaaaaagaagaaaaaaacattttctagatcatggggtatcttgaaacttagagatgaatttttacattcttgatcagcataattcacttgctcctaatgga

SEQ ID NO: 5434 - DNA, 218 bp, Glycine max
agtgctttcttgtttggcaggtgtggcgattcctgttatgataacagaagagatttctactctatgattggctgctgcaactctatgaagattttttatgcatattacttgttttacatagtgggacagtttctagcctctaatttaaaggttggataactctgcaccaacgcgttctaccaagggggatataggaaaactcaaaagagtcagttttt

SEQ ID NO: 5435 - DNA, 944 bp, Glycine max
  misc_feature (931)..(931): n is a, c, g, or t
cgttcttagttggtaacgattaccaaagttctctaaacaacaaaccaagtcaatactcggttcatttgattttattggattaaactactacacctctaactatgctatccatgaacctcaactaaggaatgctaaacccaattacctcaccgattttcaagcgaaactcacgagtaagaacactttaatttattagctctctaaattgtgcagtgttgaattccgataataacatctttgttttgcgagggcagctcagcgcaatggaattcccataggttcaaatgtacgtatgtagctatgtcaaactatagttacatatcattattaatgttatatttgtgtgtatatatgtatgtaaccttttcttgtaattatatttacaggcagcatcaagttggttatatgtttatcctaaaggaattcaagaattattgctctacgtcaagaaaaagtataacaatcctttgatttacatcaccgaaaatggtaattacatcaaacaccatgtaaatcaataatgatttatattttgccattcatttgtttattatatgtcaacgaaacactagtgaatgacttttaatatatttagaaattgtgtgtcttgaaaatttaaatttgtgacatttatctctctctcacacgtatatatttggttttgttataaagtttcatgttttatgtgattttgttttcataaattaatcacatatataggacaatctgtccttttcatattgtgcacgctcacatacacatataatacatatttagttttgttataaagttttggatttactgtaatttttcttttagcatattaatcaacatatctgtgaaaatttacaatttgcaatacaaacatttaattttgttataaagtttcatgtttgcatattattcaatatatatttaaaaattaaacttnggatatgtactaa

SEQ ID NO: 5436 - DNA, 1094 bp, Glycine max
ttctctggttctcctggttcttggtatttatttcctcaccaatctctcatcatatatgtgacattatttacttgtgtttttttttatatagtttaatttgacttggaaatagacaaacttaaaaaatgtattctctcccaggaaaatttggattattggcacaatattcacgatacttgtatcctttacgaggggcaaatggggacccttgctacaattgaaaggtaagagatcaaccatgttaactgttagcaaaattgaattatttattggcaattaattaatattaattagacctgaaattttcacttgtgtgatgggcgatgtcgcagagaaagttgaaacaacaatagacgaagcacaacgagtagtagacattatagaggacgtggctgagggggtagataaggtggcagaagaggctgtgaagcatcttcccgatggaaaatttcgtgatgctgttgaatttgttgaaaaagtagctgaagatatagataagggtgcagaacgtgcagaagatgcattagaaaaggtttaaaattaatctctatctggatgacatatagacaaattatctctatttggatgacatataaacaaattgtggcgggatagttagatatgaattgaattatgtgattggtttttatgatttgacttagtctcttaatgtcaatgttagaagttttctattaatattggataaattctcttagacaataaattagactttaataaataacgaaattacttgtttaatcttcaacacgcaagttggctgattcagttttcggtccaattgcgttgttcagaatttcctacctagctagagccaataagaataagtatataacttgttaatcgctgttattgcttattgcagaattatatatataactttagttatcttttgaaggacaattgtacaagtttatacttaatttgataagttttggtcttatagatttgaataagacattatgaacaagatttgagtaattaagacatgatgaccaatttggattaacgtgtaggtggagaacatggaaaaggagtttgagtccttcattgaatcaaccactcatcatcaggaa

SEQ ID NO: 5437 - DNA, 400 bp, Glycine max
ttcccttcctctttctccttctccttcggctcttcgtcgaattcctcttcctcgccgccgtgcttcgggcggcgaggaagtaggtccgaggagcaacggagcttcatggcctcccaggcggcggccggaatggagaagtcctcgggaccggagaggccgaggctgcggcaaatctggtcgaactcgccctccacgccctcgattcggaagctcttgcggtcgaagagctccatcgagcgcgtgcagtgcaacgacgacgacgacgacgtcgaggcgtcgtactcatcgcgcgacgagcacaacgatccggcgtcgtattcgaagtgcttggcggcgttgcggcgctcgagcttcggctgctgatgcttcttacccttactcttcttcttcttcttcgtcg

SEQ ID NO: 5438 - DNA, 398 bp, Glycine max
tctcacacaagaaactagcattagcattctcatcactgcaatagaggcaaggatgctgctgaaacccttgagtctccaacttcttccttgcccttatgacaaggtctctattgcttagcagaggcgaattctccctcagcaccatctcaaccgcattgctgaaggctccatacgccttctggccgcaggccacattggggttcatgtcagcagaggtctcatcagcctggcagccactcagcagaatcccctcatcaggcctcagtggctccagcagatcgaggtccggcgccggaatccggaacctcaggctggcctctgagccaaagagctccagcagatgggtgccaatgtctgttgtgttcacttttgttagccatgagagttgctgcattata

SEQ ID NO: 5439 - DNA, 388 bp, Glycine max
tcttgacacagaaggccaccctcttgagcctggcagagattactacatcacaccagcggtaacagacattggaggccgtgccactatagtagacaacggcacatgccctttatttgtaggtcaagagaacacttttgtagaagagagctttgccgttttcttcaccccttttgcaaaggaagatgatgttgtgaaggtgaatagggactttcaggtggcattctcagctgcaacgttatgcttgcagggcacagggtggactttgggtgaaagggacactgagagtggaaggaggctcattgttgtaggaggtgttggtagttactttaggatttcggagacacaagttaaaggtgtttataatattggttggtgtcctattgatgtg

SEQ ID NO: 5440 - DNA, 389 bp, Glycine max
gggaggtgaagttgttaactctgagcctgatggtcagcacacatcaactcaaatgggaagtggtcatttccctgaagagggttttggcaaagcaagctacttcaggaacattcaagtggttgatagctccaataatctcaaggctcccaaaggcattggcaccttcactgagcaatcaaattgttatgatgtccaaacaggcagtaatggggattggggccattacttttactatggaggccctggtaaaaatcccaattgtcaatgagtaatgatgagaggtgaaagaaaaaaaagtaaaaaaaaaattgcggcctctcttgtatcattcaatgcttgtgttaaagtccttcctttcttctccttccatcttgtatacccttacccaa

SEQ ID NO: 5441 - DNA, 265 bp, Glycine max
cctacaccctcacttaaagctctctcactcctgaaccctaaaatgaagacacaacaacaatctctcttctcagcctcaattttactagttatagcacttataacctttttccacaccacttcagcccaactcacaccaatccaagccccagtttcatcacccccatccccgccactaccacaaccaccagcattcacaccaccatctccaccagccactgctccagctccaggattcaacacagtacccttaggttcccgtgaag

SEQ ID NO: 5442 - DNA, 558 bp, Glycine max
gacagtgaggacaaagaatttactcaactgttcatcaaatttacacaggtcggagcagtgattttttttatgtttaatttcgaatttattttcatgtgtgccatattcaagctgttattacaatgtgacttgatgtatttttgcacttgttcatcaaatataattactccttgcagaacatggctcttttcggggctctattgtttttcattggcatgaaaaactccatccctagaagggtacccaagaaggctccaaagacaaaaacctattagtttttgcagcattggacccctttcattgggggctgttgtttcctggttcttcatcatatcctctccaatctgccaggatttgggttgagtactctctggttcagaatcaatcttcctccctttgagcttggtagttttggcttcacttggattaaattattggctattattatttttgtatgatctgttatcatggcgttagaaactatctttcaattgctaaacttgtctttcaaaaaggaaaacaaaaggatgagaagcctttgcgcataatcttcagagt

SEQ ID NO: 5443 - DNA, 349 bp, Glycine max
actgaatggaacatatgagtatgggttagctgcaccatatgactatcttgttgacaacatgggtgactattatggaacatgatctatatggaatgatctgcaagatgctgcattcaacttggctatacactattttgtgctggttttttattttgcccgcctaaatgcttgttttttttgtcctccttttttaaagttacaagaaatcaaggtcattttttgcgttgtcaagatattttgtgaatagctcattctcactggagtgcagcattagaagccgctggatgctgaattctaactgcaaaatttggtgtatagtatatatgatgagcaatttggtgaatgctag

SEQ ID NO: 5444 - DNA, 365 bp, Glycine max
gtgtaatttcaaataactggtttcctgtctgggatgaacagtttgatttccctttgactgttccagagctggctttgctccgcatagaagttcgagagaatgacaagagtcaaaaggatgactttggtggacagacgtgtttgcctgtctcagagctaaaatctggattccgatcagtccctctgtatgatgaaaagggtgacaaattaaagtctgtgaagcttctaatgcggtttcagtttagatgaattataggatcagccatataataatctttagttgcttgcaatcgggtatttctggctttactatgttatattttctgcaccatcaacatcaatatgaaacagtattaagaacttcca

SEQ ID NO: 5445 - DNA, 634 bp, Glycine max
acttttctttaaccagcaaccaacatctgcaagggatcaaaagaagtctcaaacaggtgtgtttacacactacaattcttcaacttactcttcttttttatttttctgcacaaacaaaaacattattataattaattgagtaaatgatggtaattttttttattaactacggtggtttaactttcaaaaaagattttatactatcatttaatcactagtcactactcaaagcgttattatataactgttaaaataattttataaaagtaaaaaaaaaaattctttattaattaaaattttacatttttcatagactgaattctaatgtattgatgagatgatatggtggtatggggtttgcagagcaagagaggcaagtaatggatctgcacggggaagtgatggcatgtgggtatgaagatgttcaagtgatgtggtctattctggataagtcgaaatccacaaactgcaatataacctcttcaacctgacccaataaaaaaacaagaaagtggcacttcagcaattagcggatgtttttgtatgctaatgtttaaggtcataattgcatcatactaacatatctatttggtatgaatgtaattctcattctcatagtagaaaatgaaaaatg

SEQ ID NO: 5446 - DNA, 560 bp, Glycine max
tgagggaagcaagaaatgtaaattcacgcggtggtcgaggaagtggccgcggccgcggtcgtggtggtttcaaccgtgacttgttcaatgatgaaaattcatttgctgcccctgctggtcaagttgcttttgaaggagaaagacctgcttatggtggccctcctggtccttatcgtggtagtcgcggtggtggtggacgtggagctttcggtaatggagaagctgctgaagatggtctcccacgaagaccatttgaacgtcgcaatgggactggacgcgggtaaattttgtacatctatgagttttatagttggctgttactttggcttttggctttgctattgatataatttgttctacttgcagaaatgaattcaaacgggaaggtgctgggagagggaactggggtgtacagactgatgaatttgcccagtaagcacttcttttgaccaccctctgcacatggattctgttttatactattttcatgaatttttattgttgtgtatttcttttctctcttgaattttacttagggcaactgatgaagtgaatgaaac

SEQ ID NO: 5447 - DNA, 392 bp, Glycine max
ggtccaatctttgatgctgatccttccagcgagtactttattgacgtgaagtcaatcaagcttgacggtaaaattgttaacgttaacacctccctgctttctattgacagacagggaaatgggggctgcaaacttagtaccgtagttccttacaccaaattccacacttcaatataccagccacttgtgaatgactttgtaaagcaagcagcgcttaggaaaataaagagagtgacttcggtggcaccatttggggcgtgctttgattcaagaaccattggcaagaccgttactggacccaatgtgccgacaattgatctggttctcaaggggggagttcaatggagaatctatggtgccaattcaatggtcaaggtttctaagaatgtgca

SEQ ID NO: 5448 - DNA, 447 bp, Glycine max
tggcacttctggtgggtatggtggaggatatggtcctggggtaaccagtgcatgggattgattttcaacctgatagcattatatactgtcttattaggtattaggtgcagacatacacctagggtgatttttctcccttttttgtcttcttttcaagtttatggtctttaatttactcttacctttctagtgtttcaagccacaatatcattttgtacggtttacaatgctaatcaccaaagggagatgtgggtgtgtatgtagcatcatttccacatcagtaaaggtagtgcagtgtcagtaggtgttggcaatggcgattactaacatattaggagttctttttaacaactttctgtactcttcattttgggtggttattttggtgggagaaaggttgtagaatatgcggtgggagaggtggaggcatttctttaaagtcggatc

SEQ ID NO: 5449 - DNA, 316 bp, Glycine max
actaaccaattctttctccatttttaccaggtcacctcactgccaagagtgatgtctatagttttggagtagttcttttggaaatgttatcaggaagacgagccatagacaagaaccgaccatctggagagcaatgcctagttgaatgggcaaagccttacctttctaacaaacgcagagtttttcgcgtgatggatagtcgtcttgaaggccagtattcccttacccaagctcaaagggcagccacccttgcttttcaatgtctttctgtagagcccaaatacaggccaaatatggatgaggtggtgagagcatt

SEQ ID NO: 5450 - DNA, 900 bp, Glycine max
  misc_feature (342)..(342): n is a, c, g, or t
  misc_feature (372)..(375): n is a, c, g, or t
  misc_feature (377)..(377): n is a, c, g, or t
  misc_feature (380)..(381): n is a, c, g, or t
  misc_feature (389)..(395): n is a, c, g, or t
  misc_feature (398)..(406): n is a, c, g, or t
  misc_feature (423)..(433): n is a, c, g, or t
  misc_feature (440)..(446): n is a, c, g, or t
  misc_feature (451)..(457): n is a, c, g, or t
  misc_feature (460)..(465): n is a, c, g, or t
  misc_feature (467)..(471): n is a, c, g, or t
  misc_feature (481)..(485): n is a, c, g, or t
  misc_feature (488)..(494): n is a, c, g, or t
  misc_feature (499)..(503): n is a, c, g, or t
  misc_feature (509)..(511): n is a, c, g, or t
  misc_feature (518)..(519): n is a, c, g, or t
  misc_feature (526)..(528): n is a, c, g, or t
  misc_feature (532)..(540): n is a, c, g, or t
  misc_feature (542)..(544): n is a, c, g, or t
  misc_feature (550)..(553): n is a, c, g, or t
  misc_feature (558)..(561): n is a, c, g, or t
  misc_feature (563)..(570): n is a, c, g, or t
  misc_feature (572)..(583): n is a, c, g, or t
  misc_feature (587)..(587): n is a, c, g, or t
  misc_feature (591)..(602): n is a, c, g, or t
  misc_feature (604)..(615): n is a, c, g, or t
  misc_feature (617)..(617): n is a, c, g, or t
  misc_feature (619)..(626): n is a, c, g, or t
  misc_feature (633)..(638): n is a, c, g, or t
  misc_feature (646)..(646): n is a, c, g, or t
  misc_feature (648)..(654): n is a, c, g, or t
  misc_feature (656)..(658): n is a, c, g, or t
  misc_feature (660)..(660): n is a, c, g, or t
  misc_feature (667)..(672): n is a, c, g, or t
  misc_feature (676)..(698): n is a, c, g, or t
  misc_feature (700)..(701): n is a, c, g, or t
  misc_feature (704)..(709): n is a, c, g, or t
  misc_feature (712)..(714): n is a, c, g, or t
  misc_feature (718)..(747): n is a, c, g, or t
  misc_feature (749)..(749): n is a, c, g, or t
  misc_feature (751)..(753): n is a, c, g, or t
  misc_feature (756)..(757): n is a, c, g, or t
  misc_feature (764)..(777): n is a, c, g, or t
  misc_feature (787)..(795): n is a, c, g, or t
  misc_feature (797)..(799): n is a, c, g, or t
  misc_feature (801)..(801): n is a, c, g, or t
  misc_feature (810)..(814): n is a, c, g, or t
  misc_feature (817)..(825): n is a, c, g, or t
  misc_feature (828)..(828): n is a, c, g, or t
  misc_feature (831)..(854): n is a, c, g, or t
  misc_feature (857)..(857): n is a, c, g, or t
  misc_feature (859)..(864): n is a, c, g, or t
  misc_feature (866)..(868): n is a, c, g, or t
  misc_feature (874)..(878): n is a, c, g, or t
  misc_feature (880)..(886): n is a, c, g, or t
  misc_feature (889)..(890): n is a, c, g, or t
  misc_feature (894)..(894): n is a, c, g, or t
tcctaaggcatctgcaaaagttttagttccaatcaaagagaaggtagaaaatgatgatgccagtgaaaaatctaattccagctctcctggagatgttttaggtcttggaaattatggttctgatgctgatgatggagacaatgaaattgagagttccagtgtgccaactcctgcaagagatgctgcctatcagtcagggattaagaaacctttgtcagatacacatgatctatctgttaatggcatttcacaacttgatgagcatgatataagtgaaactaatttgatgaataatcaggtcaaaactatctctttaccatccagaagtagcaatggtgaggngtctcttctcgcgcccttgatgaatttctnnnngnctnnaacgttgnnnnnnnctnnnnnnnnncgacgaaacaggcggcnnnnnnnnnnngttctcnnnnnnncagtnnnnnnnctnnnnnncnnnnnccccctcccnnnnnacnnnnnnnctcannnnnctcttnnntaccgcnnctgttcnnncctnnnnnnnnncnnntctctnnnnttggnnnncnnnnnnnngnnnnnnnnnnnnctcncttnnnnnnnnnnnntnnnnnnnnnnnncncnnnnnnnnttgtatnnnnnntttttttncnnnnnnntnnnanctctttnnnnnntttnnnnnnnnnnnnnnnnnnnnnnntnntcnnnnnnttnnntttnnnnnnnnnnnnnnnnnnnnnnnnnnnnnncncnnntcnnacctatnnnnnnnnnnnnnntctccccttnnnnnnnnncnnntnctttctatnnnnnctnnnnnnnnnctnccnnnnnnnnnnnnnnnnnnnnnnnnccntnnnnnntnnncaaaannnnntnnnnnnnctnncccnctacct

SEQ ID NO: 5451 - DNA, 775 bp, Glycine max
gcaatggggaaattacatgtcaattttaccgaactaaattttcttcttaaaatttggggaattgaatttgttcaccacatctgctccttggaagcacagggcactcaatgagatttgacccagaagtgtccacgcacatgtacacttggtaaagttgactattacgagctgaatctctattgcactctatccctggggtaaacccagtgcctttttttatagcttctgtaaccctttctagggtgtaaatttcatcatctggctcaatccctgaaattcattaattgcattagaatgcttgataaaattatttcttttaagaaaatgtatatttctatttatttgttattttaaaacttcaaataacattaatgattatttatcaactatagttttgtaaaatatattagatatcaaaatatttttatcttcactgcagaatacttaggacttgaaactattgcttgagttagaaaactttattgctagctcattctcggtggttagatgtcaaaataataaataagatgaatgatagattaagaaattgtaaatgatatcaatttaagagtttaatggtcatacggggcaaaacacttttacattgtttattttctcttagttttaatatgtgtgttataattaactttaaatgctacataaaaagaaacaaggaagtgaaagtgttgtgcacctgcattcttgaggatccgaaggaggttaactttttgcttcagtttgagagttgtttcaaagtactcacgctgaatcaagc

SEQ ID NO: 5452 - DNA, 461 bp, Glycine max
gtgtctagacacattaaaagcctttcgagcagctcttggcattccaatgcaccaaccatgatagtcaaacttgctctacccttccagcatccaatggctattgttgaatcatccacttggaggggccctgtagcagctctgcttcctgcagaaaaatgagaagacacgtgtaaagagtcaatttaatgggcatttactctacatcatggtggtgcatactgcataccttcacccagaactacaacacaacaaccaggcattaggtttgcagccttttcaccaaattcggcatccacaaaatctgcaaattttacagttctatactgcagaagatgcttgaagtctatagcagatgcactaagaatctgtttggagatgtgagggagaataaggggcaatccttcagaagtgatccggaaagcacatggtgcagacctaccttcacatgatgtctgtctttc

SEQ ID NO: 5453 - DNA, 366 bp, Glycine max
tctctggtgttgaaaacaactttggatccttgacattgtgttttgtgctttatatggtgcctacaaggctcatgaagaagttattggcctcaagttcatagtgccagaaaagtttcctgtgttgttttcttggttgatggctattgctgaggttgaagctgtgaaaattgcaactcctccacatgaaaaaacagtgggaattcttcagttgttcaggctgtctgcactgaaatcttcttctgccacagaatgatatatacttcaacactttaatagactgtccatcgtttgcttcttctgcgagtctttagtgtatgtatctttcaataacaggatgagtaacacctgagtatgtaaagcgtgatg

SEQ ID NO: 5454 - DNA, 333 bp, Glycine max
acttggctattctagccaacgatgcaaaatatccttaccctgccggtgaccccgtcaatgaggctaacggcaaggttatcaagtttatcatcgtacctgatcaagaagttgacacgtcacgggtccctaaacggttgttagaataccctgttgttgatttatccagtgtggcgcacacacgctatgttgctatgtacgagtacgcgagcgacattgatgagccgacacacttgtacctaaatgcgaaaccgtatgaagcagcggctacggaaaccccgaaggtggggtccacagaggtgtggtatgtgatcaacttgaacggaggataaggat

SEQ ID NO: 5455 - DNA, 1261 bp, Glycine max
agacaggtaatgatgtgatccttttctctgaaaatttcttggttatatttgtctcataaagaaacccagatagtgccaaattgtgtttacatgtcaaatagacctgttcagagcagcctttctatgcttggtttaaatcatacattgagtacttggtgagaatggaaaatcagctattagtatggataaattggcttcaaaagatatttattgtgtcaagcctccttcgttaagattttagtacggaacttggaatgttgtaacgtatagatacatggccgggatgttatttttaaataattatgttatgtaaagaaaattatattgagagctcactggaagataaaacccaatagacattgatagatttaatatgatagtgatgctatcttagtacttattgccaagtaagtagttagaaattggcatctaacatgtatcatatagttattctaccatcccaaactgctagaaacatctcaaaaccttttaagagcattttattagttattgtaggcaaacaaatcaacaccttcttcaatgtttgtgaagtgaccgaattattttatggaatgtttccagtgttgaggtttggtaattaaggtatttatttggtaacccaagattgtgaaagatgttaatatttttgttgggtttgatttcatgagtagtatttatattttatagcatcaaggggagagcaggtttcaatgatgtgctgtttgacagggtattgatggttctagggttgagaaggtactggaagcagttcatatagctgccaataaaaataccgttccaggggatgtgtctgctatggttcctggaggcattcgaatgggtacagtctgttgctcatcttttttttatgcttttattagtggatctataattacatgttaataaagattattttcttgtgattcaggaacccctgctctcacatctaggggatttgttgaggaagattttgaaaaagtagctgaatactttgatgcggctgtcaagttagccttgcagattaaggaaaataccaatggttgatcctaccttaccttcgtacatctgaattgttatatttgcagttttaaaagcatagccagtgtcttaacgttacgtaaatcacttttcttcttgatggttacatcaacttcaggtacaaagttgaaagattttgtggcagctatgcaatcagatgaacaaattcaatctaagattgctaatctctgtcatgaagttgaggattatgctaagaagttcc

SEQ ID NO: 5456 - DNA, 597 bp, Glycine max
tattccttaagatatattgaagaatgagttcatgtttgaattattgttttcattttcacatcactccttgagtgtaagtccattcccttaagatgtgtttataaatgaattcatgtttgaagttactgtggtgtctttttatgcttgtaaaagttgcattaccttctttgttatctatttgcagttgttgcccgtagtagtccacctgatataagaccagtgctagcctcttaccaaggatgtgatattccaagtgagttcatcaggcgttccaaagagcatcaaaggtatgatttaatcctgtgttgaaggtttcttttgtgtatatagttgatgttacactaatgatttgtcctgtgttgtgttcaaccaacatttttactctgggtgtttccaaatggtgcaggagaatgcaagaacaaaagaatcgtggtcgcttctggaaatgagattcagtttcattgcaagttgaaaagaaatgttctttgttgaggcaagaaaatgagattgtcagtttaattacaagttgatcgatcagttcaacaaagattttgaagtcactgcaagttgacaagtgattacatgaaatagagaaaa

SEQ ID NO: 5457 - DNA, 320 bp, Glycine max
ctctgtctctgaagccagtgctgaggaacagtcattgaggaatggacgcatagaggatgaagaaatgaccagtgctcttgttccaaagaaatttggaaactcaagtcttcttgttgattcagtcagggtggctgagttccaaggccttccccttgctgatcattcatctatcaaatatggccgtccacccggtgctctaactctccctcgggatcctcttgatgctgctactgttgctgaggccatcaatgtcatctcatgttggtatgaagacaagactgaatggggccttagagttggatggatttatgggtcagtta

SEQ ID NO: 5458 - DNA, 381 bp, Glycine max
ggttcttagactaagaaatgttgagagtggggaagtggagctccagttgcattggattgacattcctggttcaagacatctctagatcacagtccaaaacatggttctaagatttgccatattgtaaaaattagatttgcagcctcataaaccagcaggcagcagcaccttatgctttaatttctcctatccttttatctcgttcgcataacttaaaattgttcaatatgttggtttgtaatcggtgttattgcaattactagtactagtagttagtgaaaaagaatgggagatgtagtttccctagctgtaatttagactttgaattatctgctactgctagtcttgtgtaataatgtacaagaaatgtaccagaaagat

SEQ ID NO: 5459 - DNA, 360 bp, Glycine max
gcccgagtggtacgtctggaatgggatcggaggtacctatctgttcttggggttgaaaacaaccaattgtatgagttgagattgcaggtgccagaaaatgtgttttcagaggaggaaaatgatcttcgtcgaatcatggattcgtttcgagtgaacaagattgccgcttagaactagagtgttggatacatgaagatattccacggtctttgaattttaatcttatttcttctttattctgatgatctctttctctaatctttttcttttttacttgattgaatttttttcttctttggctaaattttggccatactatcatatcatttgttacattattgttctcactttcccatttat

SEQ ID NO: 5460 - DNA, 355 bp, Glycine max
aaatgaattgtgctggatggtttatcaaggaaactctattattatgactacaataaatggtttcttgttcgtagtacttcattttttcgtgtagggaacttgtttatcagattttgtgtcaggtttgctccgtcatctcgcaacttttgttcccagaactgggttcttgatcgacggtggcaaggctatttctttttcattgttatgctttgtttctattacaatgtgtctctgtaagaacaataagctgcatagtactagtcctatgctgcaggtttggcttttgaatttcaagtctatattgtgttgttataattattcttattttaaatcttttgtgggtcattcatgtggc

SEQ ID NO: 5461 - DNA, 887 bp, Glycine max
gcttgcactatcatcataaggctctctactagcatcaggcaagcaaagagaacgcaaatgaagtacacaaagtgctcaaagtctttctgaagaccaggtaggtaataggctatagccccaggaatgattgaaaccaacaacaagtatgggattgctgaaaaggtgttcccaatcacaaatgcagtgacactataatgtccatttagtctttcacgttcaaacacctggaccaatggcaaaatgaatataaaacaataaatccagtaactacctatatttataaaattgagaaggataaaatgtaattttgttctttcatatcttaaatcgaaaaggttttactttcatctcttaaagtgtttcttttaaatcaaattagtctttttgacaattttcacactaatttaataaacttgatatagtaaattgtgaaatgcaaaatcaaatagacaaacgtttgcacgtcagtcaaattagcagggttagtgcaaaaaacttattaaagaactattttgtactaacaaaaatacaagaggctaaaataaaaattcttaaacttagatgagcaaactaaatccaataattgagatgagaaaacaaaattatatattatccatttgagaaacaacaaatagttgaatcaccttcatatcctccacaaaggaagggaatccgccaatggtcatgaaagtcatgaatgaagacacaaacataagaaatgaacctctatcctgacaaaatgaaaagtgatttttgaattagaagatattaattaactaaactaaaaggcaaataatgcacgagttattattagtcatatatcatgtgttacttttccactattacctgaattgagcgataactagtacccagatcatagaaaatag

SEQ ID NO: 5462 - DNA, 866 bp, Glycine max
  misc_feature (838)..(840): n is a, c, g, or t
  misc_feature (843)..(846): n is a, c, g, or t
  misc_feature (851)..(851): n is a, c, g, or t
  misc_feature (853)..(855): n is a, c, g, or t
  misc_feature (859)..(863): n is a, c, g, or t
tgtcgggttcgtcggctccacagcacacggatctcacgacgttgagagtgatccatggcaccgttaacgccatatcgtggggcattttgttaccaatgggagccatcaccgcacgctaccttaggcacattcaagcactcggccctgcatggttctatgctcatgcaggtcatcatcatcaactcaattctccatattactatactttttctttaatttcaccgattcatatttttattttcactatttttctttttaaaaaataaccatatagatgttgttattttatatagtagctagacacctaaaaagcttttaaaaaaagaaaaatataaatgtttatagtgacaaaatattcacatatcactgttctttatttggaggatcacaaataaaaagaacaacattaatgcagttctggatttagttttaattctaatctttggacactcaatacgttacatgatgcgaaaaaaatataaatataaatgaaaataatcaagtgttatatataatctaagcatgcatatccatatatcatcaaataagaagcaaagattttgacaaaaaaaaaactctttgcccagtcatttaatacttgtttgacaatgacttgtgttaaagtagtagtaactgcttataagaatttggactgaaaataaataatttgcatgtaggaatgcaagtgtttggtttcgttctgggaacagtggggtttgtgatcggaatcaggctggggcaactgtcgccgggagtggagtataggctccaccggaagcttggaatggcggtgttttgtctggggggtctgcagactctggccttgttatttaggccnnnacnnnnaggancnnngtcnnnnnaat

SEQ ID NO: 5463 - DNA, 361 bp, Glycine max
  misc_feature (343)..(343): n is a, c, g, or t
ggtgctcgctgacgtgggcggtggggtccactgcctgggaatcgggaggtccgagagattgggtgcggccagcaacatcataggcaacttccaccagcaaaatctatgggtggagtttgatctcgcgaatcgaagaatcggattcggtgtggccgattgtagcagatcatatgtataagaaaagaaaagaaaaaatgatagggtgtggctgtggggcatgtggctatcatgtgtagtagcattaaggctcagaagtgttgcaccactacttcataaattagtccatgacgcggtctaccaaggaaagaaaaaagaggtctttcgtgcggtaaggataaacaangtgcggtaaggctaaaca

SEQ ID NO: 5464 - DNA, 350 bp, Glycine max
tgggaggtctcgtgccgctgtgatgaagaggatattcaattaggagaggagatactatagactactaaaaattatcaagaaaacagtaaaaggagtagtagaatttctccaaaccaagacgccatcaaatcaaagagtcaaacacccaaccgcgctgtcccaaactcctcctgtgacattgtaacaatccccaaatgcataatacattgattgttcctgttacaaacccaccaacacaagaactcccacactaccaggttaccgtacagcggcaaacaactagatcaaaacccaataaactagatagcataaacgaacaaacaatcaaatgatgaatgtaagggtaataa

SEQ ID NO: 5465 - DNA, 396 bp, Glycine max
agtttgagaggactttgattgtcgccgatgatcggagctctgtggagtatctggaagggtgcactgcgccttcctatgaccggaatcagctccatgccgcggtggtggagttgtattgcggcgagggggcggagattaagtactccacggtgcagaattggtacgctggggatgaagaagggaagggtggggtttacaatttcgtgacgaagagagggctgtgtgctggtgccgggtcgaagatatcgtggacgcaggtggagacgggttcggcgatcacgtggaagtacccgagcgttgtgttggagggagatggcagtgtgggggagttttattctgtggctttgacgaataactatcaacaggccgatacagggacgaagatgatacacaaaa

SEQ ID NO: 5466 - DNA, 406 bp, Glycine max
  misc_feature (359)..(359): n is a, c, g, or t
attttcttagcgtgtacaaagaaattcttttcatttgttttccccagcctttgttaacattttatcctctgaaagtagagcctgtaatgttgttttcatgactaataaagtttccctatttcttcagccggttggaaatggatcatgggattcatggtttaagcctttgaaagagcaggtaaataggtcaggtattgtccatattgactatttctaacttttttttcttacatgtctgaaggctgagattgtctgtgaaaaggtgataaaaggaatgctgctgtcttgagataattggtcacatttcatactaggcttttgaatttaaacttgctactccatttcccaccatgaacatnataagcttttgaatttaaacttgctactccatttcccaccatgtaca

SEQ ID NO: 5467 - DNA, 755 bp, Glycine max
actaacagtagttttctccccttcccccacatcatcatctatgttctctaataaagacattcttttggacactctttatatcatgttctatttaatagttcttcctgagtttgtaatttttaatcaattttatccaataaaaaaagtatacttaaaagaatgtattaaagagtatattcttaacaaagttcgtaatcgtatcactaatcaatatctattataacaaattttaaagttggtgacaaatttaattatgactaaaataattggtgttggttttagggggtctgtgggcctctggaattggggcatcgcttgtggcttattcacgtacaaggtctccaatgaagcctagtcttagacttatccatgccaggtacattacattaattacatgtcccacaattcacgtacttaatagtgttccttttttaaaagtcaaaatatatatgcagaatttaatttttatttttgttgtttttttggattgtagattgcatgcccaagcgttaacactggcagtgttgtctggtgccgcggcttatcgctactacgagaatcgtgctgattagcccaaaccacaggcccagcttcttcaatgggagatcctcagtccttactaaggatattaattaaatattataaaaaaaaataatgcagatttaggaatttatatttcacatagatgatgaggagagggtcctctatgatatcatctactttgttgtaatcttttatttttctttaatattatc

SEQ ID NO: 5468 - DNA, 406 bp, Glycine max
gtactttttaaaagcataaaacaataaacctgtaataagagtattaaatttgcacacacaacaacaaaactaatctttctactttggaataaactcaattttgatgcctcctatgatgacatctcctttcccaaccttaggcaccaaagtaaccagcacaacatcatcttcttcagcttctaaacactccagcactttcgatatccctaccttaaaactagtgttgatattatggccttgtccatggaacaaattaacaaaagttcccacaaactctgtctgatccggttcactcaaattatcttcatcatcatcaatatgaacatcaaacttaacatatttatcacttccaaactcaatcccttctatcaccaaaacctcctcctcttgttctttctcttccttg

SEQ ID NO: 5469 - DNA, 427 bp, Glycine max
gttgcttttatatgaacttgactaatttaatttagagtggtgtatttcaatgttcagtatattggttctgttcatatattttacattgtaatatttaaatagttatatgtttgttattgttaaattagacataagtggctgtacatttttgtgtacatatcatatcacgactttttatcatatcatgacttttgttattgatgtaccaaatgagttgttactttattgtgattttataattatgtgataatttttcaccagtggtaatgttccattctttataacatgatggagaaaaaattgatattttatgtgataaatgagagggtggctgacatgggtgagttagttattggcactgctgagttcagaatgggaacaaaaggcataataggtcttgctaggcgtaggagactaggagtaacca

SEQ ID NO: 5470 - DNA, 762 bp, Glycine max
tcactaagtggcagcatattattcagagaaatagagaggccccaactattttctttgatgaaaatgtagatctagggttttcaactgtaggagcaatagcttctgaatttgaacccagaactgaatttgagaagaaaatggctgctctagtttatgatgatgaagttatggaagctcataaaaaggatggttctaagcttcttgaaatgaacaaggtatgagtattagttgataatatgcctgaatagaatattaattcatttaaggaagatcccaaaacttgcattacttctacctaaaagtaataatgggttcccgccaaacacactacataagctgaaatagcacttttatgattctagcaatatatatggaggtagacaaaccatatatgtcccaactagagtgatgccttcaatttaccccagtttaattttaacttttaagtgccatacaatgtttccttgtgtgcctgttggagtctaagaataaaatttgcattgattacatctttaaaggtctgtgtactgattcttcttctcaacccatgttttttatgcaatatggcatggaattatttttgtattggtgtttttcaattgttttatgtaatttcttatgtctgacaggtctctattgaagatgagaaggataggcaaaatcggattgctaaaatgcggagccttctttttcgtcgtgaaatgaaggcaaagcatattaaaaagatcaagtctagaacatttcatcgttgtgaagaaagat

SEQ ID NO: 5471 - DNA, 392 bp, Glycine max
tcaccgagaaaatgtacaagattgacgatcatgttgcatgtgctgtggctgggataatgtctgatgcgaacatcctaatcaataccgctagggtccaagcacaacgctacacatacgcctatcaagagcccatgccagttgagcagttagttcagtctctctgtgataccaagcaaggttacacccaattcggtggtcttcggccatttggagtctcgtttctgtttgcgggatgggacaaaaactttggctttcaactttacatgagtgaccctagtggaaattacggtggctggaaagctggagccattggggcaaataaccaggcagcacaatcaatactaaaacaggattacaaggatgatatcacaagagaagaagcagtgcaacta

SEQ ID NO: 5472 - DNA, 398 bp, Glycine max
ataaaggtcatggcaatgccaatcatgccacagaatccacacaaaagtcggcgtcacagactagaatagatcataacacagaagaagctcatccaagttcagatgtcaaggtccaagaaacacgtccaagttcagatgtcaagactccacacaatgactcacaagaaactaccgaggcaagttcatccacgattggttcaaatctaaatgagataatggcagatagggcagagacgagcaaccaacagaatgctatggctaaaagcagtaatgatgagacattggatgaggaagtggaaagttaccagaagtatgccgaaaccagttatgaggagacagtagaagaggcaagtaatcacaactatggtgatgagatggaggaagaggtagaggaaatt

SEQ ID NO: 5473 - DNA, 368 bp, Glycine max
tgggcttgcaaatgccaaacctccaaaagctttacctttatggcaacaatttaactggaccagtaccagaaagcattggtgacttgccaagactccaggaactggcactgcatgaaaataagatatctgggtcaatcccttctaccattggaagcttaaaaaagctcaaaagtttgctgctttactcaaaccaaatttcaggtacaatacccttctcacttgggaatttgaccaatttggtagaattggatgttcatgataatgccattatgggtcaagtacccaatagcataggtcagatgcaggctctggagaagcttgatctttcaagcaatatgcttagtggaagcataccttcttcactaacc

SEQ ID NO: 5474 - DNA, 713 bp, Glycine max
  misc_feature (709)..(709): n is a, c, g, or t
gtagagaagaggaagtcgcaggcttcccatgacacagccatcattgaccgggatgttaagagtcagcagcaagcaaagaaaaatgaggctgttgtgcctgagaggccaaataaaccagtaacagctgattccgggcctggcagacccccaaaatcaaatatgcagagaaaaagtaatatggagccaaagatgcagcaaaaaatggagaacaattcaatcacaaggaggcctccaaccggtcagctagatgtaagaaaaaaaatccttttgatgcattaaacttgtagatttcagttctctctaaccttgattttttctcttgtctatcagaaatccaagcgttcagatgactcggcagtccaagtgaagctagaagccaccaagaggaaacttcaggagagctatcaacaagctgaaaacggtttgttttttcttttccaaaatctatggttatattctttggcatatttgatttttggattgcctatcatgtctagtagtctctacattttcatagaatcttgtattccagtgttagattccataccttaaatgttcgatttggtttatgaacttttggaaattagagcttgggacactaaattacaacacatgatgattgtttttgtgcacattaggtgccaattaattttgatgaaactgacctctaatttttacatgaagccaagaggcagagaacaatacaagnacaa

SEQ ID NO: 5475 - DNA, 796 bp, Glycine max
catctgaacatgcagcgtcaaagccacattttcggttgcaatttcactaatatgcatcctgttttgttccacattaactagtgctcttgatgaacctggtatattttgcaataatctctctcgctcaattatttgtgtgtcagttttggtttatacataaatgtaccttcatttaaatacgatttaatttaagccttgaccgaagctagctaattctttgacatgatattgaaacttctaatcttacgctaagcttaataaatttacttttaaaagatgatatgtattaagttccattagaaaaagaaaaaatgaaaaaaaaaactatataaaaccatataaacaaaattatttattgttgttctaaatatatatgttcgtgcaattatgcagagtatggttacaatgaaaaaagtgcaaatgggccccaacattggggtgatctgaaagaagaatgggcagcctgtaaaatagggcaaattcaatctcctattgatttgtccactaatggagtggaagtgatccccaagttaggggggctaaagtactggaactataagcctcaacatgctactgtctccaacaggggtcatgatgttgcggttagtacaaacgtcttctaaaacgctcagatttaactcttctatttcatccacaattgttgtggttaatgaaaaataagatatacactagcggtataaagtattttcacaccgttattcaattacaaattattatcatgcgataagtttctcttaaatataatgatggttgcaggtcatttgggaaggggatg

SEQ ID NO: 5476 - DNA, 864 bp, Glycine max
  misc_feature (62)..(62): n is a, c, g, or t
  misc_feature (647)..(649): n is a, c, g, or t
  misc_feature (763)..(767): n is a, c, g, or t
  misc_feature (806)..(810): n is a, c, g, or t
  misc_feature (846)..(847): n is a, c, g, or t
caggttggagttcaggtctcctgtcacaggtggttttgaacttgagcagcaaaagtctcatnaacgtaccaaaaatgttgttccaaacaagcgcactcgaacttctatggttgatgtaagggtatgtgtctttgattttcccccatgcttgtttgcaagtgtaaacatgctcaatttcactctttttaattcttcctacaattgcttattcattttcttactgtttcaaaatttaaaataaatactgtacagtcataaataatagtatatatggcctagtagtatattttgattttgtaatatctctgatttacatggaaaccgccttttttaaaaattgtctttgcaaaaattgcctgctagaacatttctccagtggtattcttgaaaaaaaatatatgtaaatttattgtttacattatgtattctgtctgaagcttgtaaagagctttatgttcgtttatgcctttcccattttttttctctggaaggggtgaaatataggatattctactttttcagtttttaggttctaataaggcataattaagtggtagactcagctttaaaattttgttctttcctttatatggagaattatctttcagattaatgtgacttgtaataaaaccttttgagcaaaactnnnttgtttttataaatttcagatggatgtgcggattaattctctcgtcaggccatcagggacagttgacagagataaggaaaagctacggattgccaacaatggtgtggttcagannnnngaacgaaccttacctattggaggtgatggttgggaaaannnnnaaatgaagaagaagcgttcctgtatcaaactagatnnctccaagtcaacatgac

SEQ ID NO: 5477 - DNA, 315 bp, Glycine max
ctactccaaatgcggggattgggagaacgcactttcaatattccgcaacatgggccatcataagagagacttggtctcctggtctgctatcatctcctgtttcgccaataattccatggagtcccgagcccttctcacctttctccacatgctccaatgctcaaggaatatcatttatcccaatgaatattgctttacggcctcacttaaatcttgttctaatcctctattcttttctactggccttgcaatctttgcctttctcttaaagaccggatactttgattctcatgtctgtgttggctgtgctttaat

SEQ ID NO: 5478 - DNA, 1036 bp, Glycine max
  misc_feature (899)..(899): n is a, c, g, or t
  misc_feature (901)..(904): n is a, c, g, or t
  misc_feature (910)..(915): n is a, c, g, or t
  misc_feature (926)..(926): n is a, c, g, or t
  misc_feature (929)..(932): n is a, c, g, or t
  misc_feature (939)..(943): n is a, c, g, or t
  misc_feature (945)..(951): n is a, c, g, or t
  misc_feature (958)..(958): n is a, c, g, or t
  misc_feature (962)..(971): n is a, c, g, or t
  misc_feature (973)..(982): n is a, c, g, or t
  misc_feature (986)..(1006): n is a, c, g, or t
  misc_feature (1008)..(1017): n is a, c, g, or t
  misc_feature (1019)..(1032): n is a, c, g, or t
atcataccaacacatcaatttccaaagttatttaaaagaataaaggaaactaagaggatttttgttttttttggggaagggggggcctcctacccacaatcaccaccaacccattcctagtggcttccaagtaaaaaaaaatggaaaaaaaatattgaccaaaggttgcatacttctaaaacatgttctgaagtctatatattttcttttactaaaacttcaattttccttcacaacactacactgttttaaaaacgaggctgaaaattatagtcttgaaaatatgcaaaactggaaggtgtgttttagaactcaatacccttaagatttaggcagggagcttctgggggtgcctctcctgcttgggcctcgggccatctccgggccatgcaacctctgccctgaactggtctggagtagggcatgaaaaagaagcgaagccctggctctgcatgctaaggctcttctcttgatatggccacagcattaccacggaatctctctttgctatcagacgtgaaacgacatatttgttcttctcggatagttgaccatagtttaaattggaaagcccactgatctacagaaacagcatttgttgccaaacagaggcagcttttttttatccggcaagctgcagaaacaccaactaaggactttccagcaccacagggtaaaactattataccagatcttgctctacctgaagtggcagacattaaattgcactcagtagtaatttatgtttcaatgtgcaattacccatagcagacattaatgttacttcaagtcattaagaaaagttgatgcttaactacactagagatatctcaagttacgctaaatcacacatcctaatctttgattttaaatataactttggatttccaacacatcancnnnnagtttnnnnnnaaaaactatgntcnnnncaggatnnnnncnnnnnnntctctancatnnnnnnnnnncnnnnnnnnnntcannnnnnnnnnnnnnnnnnnnntnnnnnnnnnntnnnnnnnnnnnnnnaacc

SEQ ID NO: 5479 - DNA, 365 bp, Glycine max
aaatacaaaagccaaaatggtggcataaggcttgtatctgatacaaaatcactacttcaagaaaaacatcaaatcttacatccaggggaacaagccaagaatgtgataacagcatccatcccatttcctaaaaaacaaaacaaggaggggaggagtttggccaccatacagggttagcagttggattggaaaaccttacaaaaaaaactgtaggaaaatcctcaatgcactctgacttcattattcagcgattatccttagtagtgcagcgagacaatttccactctgtctttttagacttagacttcttggacttggacatgaatccttcatcatcagattcatcgctaatattgccatttttc

SEQ ID NO: 5480 - DNA, 404 bp, Glycine max
ggaaatgtttatatattttgtttgcttgtcaaaaacagaattatttttttttcttcttaaaatattaaagtaaaattaattcaatttaaaaataaaaaagtgctgatcttgtaaaaaaaaactcaccttcgttgtctcccttctttctcttctccattaaaagcttctaacagttttactagaagtagtttatgatttggcatatccaaacccaattccatcgtgatataagctttgttcaaatcacatgcaaaagagaggaagatattataaaatttgatattcatctggcagtttgaaggcattctgtgtttcatatgttttagcaatagtaaattacaaaaattaggtctgcctatgcttactgaattgtaaattttgtaggagcattgttgtttggtgac

SEQ ID NO: 5481 - DNA, 421 bp, Glycine max
cccaggccaatggcaacacaatgttcctcctcctcaagatcatgtggtctcaatgatgcctccaaagccatcgccaccgcctgctccaccagcttatgctggtcaacctcccccaccaccgcctcctttcatcatcagcagtggcggatctggatcaaacaattcaggcggtgaatttcttcctcctccttctccaggaatttcattggggttctctaagagcacattcacgtatgaggagttggcacgcgcaactgatggcttctctgatgccaacctccttggacaaggaggatttggatatgtgcacagaggaattcttcccaacggcaaggaggtggcagtgaagcaattgaaggctggaagcgggcaaggggagcgtgaattccaagctgaagttgagataattagccgtgtccat

SEQ ID NO: 5482 - DNA, 337 bp, Glycine max
ccattcctttgaaccaggctcggctctgttaccatctgaacctccattgttaatgatggaagaaagaccatttgtcttattgttattactactattgatatttttcattttcatcatcttctctcactctttcactttcacgactatgccagacaaaagggtgtgtgatgaacaaaacaccagagagagaggcttagatctctgtggatccagattctctgccacccatgacagaaaccacagtgacccaattcaccaaaagtctgctagaacatgtctcagaaatctctgaccttagcattccacaagtccacagcaagggagagagaaagacaca

SEQ ID NO: 5483 - DNA, 994 bp, Glycine max
tagatctcaacggggagccacttagtcttcaatgcagatgatgaatacttttctcctccacagagtgatatggagcgggttggaaaactaatggaaaactacattgctgaaatagccaccgaccgaaatttaccggttcctaagttcaccagtttggcagaattaattcctgaacagtcaaggccaacagaagatggaatgtatagagccatagacatctttcttaaggtgcagactacaatcctttttctatatcaaactaatcataccgcagatttgatatttagtctttatattgttgatagctcttatttgaacaaccgaattaacacacatttcgttaaccaagattaaatattcgagaaattatatggtttgagactatcttgatctaagacaatctccacatgacaaataattgagttttattaacgttcttgtaaattgaaaaatttcagtttcatgtcacttaagatttaatttgagaccataaacatgtggtagtctagtaccattaataatttctccaaacctacagcatattctcacaggcttctagtgtgttcaaattagtcttatggaaagaaataatcaattatttttttatagtgaaaataaagtaacaaataattcgttctactttttcatggcatcaccatgattttgtagggtagaaattattctgtgtgttattcaaacacactattcatcaaattgaattggctttggatctaacattatcatagttcgtttgctacattacacaattggatttatgagagtattatcatcaaattcaaggacttaatagcattactattttgatatagaattttctaaacgtgagtttattttgaattactgatgattctcaggctcatcctgctctaagtgacatggacagaaagaaagtttgcagcgtgatggactgtcagaagttatcgcgagaggcatgtgcacatgctgctcaaaatgaccggctaccgtccaaaca

SEQ ID NO: 5484 - DNA, 801 bp, Glycine max
aagggtttgtatttccttttccaaaatcaatgtttatttttctttttcattgtaattttaatttagattatacatttcttgagagtcttcttacaataaagttaacaaatggggtcttgttaagggtagaggtgtccatccttacccttgcatgcaatgaggctgtttctaagatttgaactcgtaacctgaaaaagtaaaaaaggcaacatccttacggttgtgctttgaatcgtcccactactcatgctaaagttgatcgcctaaaatgttggatttggaagattagtcttttgaaaatttagagcttgatttggaagcaaaaattcataacacatgtatctcaattcataactaaattgatgaaactgcttgattctcacttgcagctaagaggcagcggacggtacaggttatggagttgcatgacctcccaaagcaagggattggccatcgaaatccacatgtgaaacccggaaatcacaagaggcaatggggtcatggacgaagatagaactgttaattgtgaatttggctgcattttcaagcttccaaaatctgggcaagaactccctttgctagccattattgaagcttcttcctctttccatacaaaagcaacaattcagttcaccattcttacctgtattgaactgttctgattgagagggaagtaaactctgagtcacagtttatttcctaagttaaaaagttgaatatatatagaaattttgttgatccaaagactggatttggaagagggtcctttagcacttaagtgttgatgtggttctaaaactg

SEQ ID NO: 5485 - DNA, 387 bp, Glycine max
caaccttgccggaagacgacgtcttgcagaaaattgaagaacgggctgctgctagaattcaaaaggagtatgctaaatcggatgcaattaggaaggatttggctgttgttggtattactcttatggacagtccaaatggcacaacttggaggcctgccattcctcttccacttcaagagctgctctaagtcaagagttgttcaacatctccaaagcaaaaccaagaaatgtaagttactagttctggtatatggaaattaattataagggatgtcacgggtgtatctcgctatcaacttctcagaatgataaaggcgaccccttcttgattcttgatgccttaaacacatggattacaatttacgttttaatagagatgtgcttagt

SEQ ID NO: 5486 - DNA, 490 bp, Glycine max
ccaactccaagaagaaatcacaacacactcttacttcagtgctcactgcaagaagcaaggtagataagagataacaagaataaaatgaaagaaaaagaaaaagaaaaagaaaacccctttgtgtcttttcttgaagtctgaaccggtaccatgttgtaccatcacttgcatgatattatttattcctccttgtgttgttttatttgcaggcggcatgtggcataactaacaaaccaaaggagcagatcattgacattgatgcttctgatgttgacaatgaacttgctgctgtggagtacattgatgacatttacaagttctacaaacttgttgaggtatctaacgtggtttctgttatgtttttttgtgtgttgtgtttgattttgatggcattctaatattttgtgaatgtgcgtttgatttacaaagaacgagagccacccccacgactacattgattcacaacctgaaataatgagaggatgagagc

SEQ ID NO: 5487 - DNA, 654 bp, Glycine max
tttccggattcgctctggacttgcattctacttctgaatttaaaccccgaaatggttttgaaaacacacaaaaaaattacaccatgatatcatcatattttggatcttactttctcaataagctctcttcggagaatttttcctgatgctgtcttaggaacagcattgatgaatgtcactcttcttattcttttgaaaggcgctacctgcaaacaaatacaaaaaatgagtgtcaacaaaaacaacacaaaaagtcgtttaattgtgatcaatggacctgcagtgaaaacatgcatttttttaatgtctaaactttatttttagaaccccatttagtttgcttcgtttcttcacaagccaaagatcttataattccaagaatgcaagtcagaccaagctcattgtttatttttctcttacctgcttagcaataaatttttgaacatcttcctctgtgagtgaactattgggtgaacgaacgacataggcaactggaacctcaccagcttcagcatcaggatatctacagaattgaagtcaactatgaatttcaattactaataacatgagttgtataagtatttcttctgtacccatattaaataacgatgatcatgtatgtgaaacttacgggatgacaacagcatcaagtat

SEQ ID NO: 5488 - DNA, 892 bp, Glycine max
  misc_feature (841)..(841): n is a, c, g, or t
  misc_feature (855)..(857): n is a, c, g, or t
  misc_feature (875)..(877): n is a, c, g, or t
gaagaaaacccacccactatcccaattccaataaataccttcctctctatattttcgcacaataccctctcacccttcaacgatgagttactacaatcagcagcaaccacccgtcggtgttcctcctccccaaggttccattcttaatttattctctcaccgtttttttttgttaagattagattaggtttacactgttacacgttggattttcttgaatttttgtctcacagatttctgattatgatgacgactaggttacccaccgccggattcttacggaaaggacgcgtaccctccgccagggtacccgccgcaaggaggataccctccgcaggcgtatccagcacaggggtaccctccaccctacgcgcctcctcagtacgctcagcctccgccgcaacaacaccagaattcatctggcccaggttgcttaaaaggatggtaagtctctctctctctctctctctctgcatatttctgagtgaaggtgttcggggaaactcagatcgggattcactcgattgattgcggttgcgattacgggtgcaccatcatctatggtgcgcccgcccgcggctgatcattgattagctgtagttgcgttgtttcactgctgtcatctgacgcgacacgcgcgcacgatactcgaagtggatgtcatctttttttttcgccgggccccgccacttgcgggtttcttaagtatgatgggccaagaggaacgaaaatattcatcgtgtaaattatagaaaaacgaaaaaatatcataatttttttctcctaataaaattatttttatttttaattctaagttctttaaccaatcttatggctccgnttctttgccattgnnnaaataagcattgataaannnttcttaatttgaaat

SEQ ID NO: 5489 - DNA, 408 bp, Glycine max
cctcctgcttccgattcgcatttattctattctaatttcaaaacctaagccatcaatctacactccctcgcgctcataattagtagcacatttatcctgttctctgattgtgcgatttctgaattccattgcaaatcctttctcgctaacggaatctgcacttgcagatcaatctcaatggcgtgttttgattggtaaagtacgcgcgacggaacgaggcatggcagaagtggctaaaccgagttctgtgcctccgagctctcatcgaattggttcaggacctttgaaaagtggatctttggttagaaagaagacaccgtcagaacttagggtaagttcccaagctcacgacctcaatttagcattcgatatgtgtggttataatggaaaatgcttcggttatcctag

SEQ ID NO: 5490 - DNA, 347 bp, Glycine max
gagaggagatgctgctgcagaacaactccaatgtcgagactaatctccctttgcgcaaaggggtttcgtacaattctgctcacaatttgttgtctgtgggtgacaaagatgaggatattattttctgaatgtggttcaatgttgtgatgctgctgctgggtgagactgagacttctctgctattgtttaggtcacagtggagtgtatcatgaataaatgttgttactggttagtatatgtttatttatttctttcttcattaaattgggacaatcctcgtttttaaagtatgcttcttatctgagcctatgaatttttttttatgttgctgtgattagttgtatttt

SEQ ID NO: 5491 - DNA, 338 bp, Glycine max
gggttgagacatagaaacgggtgtagtgggagtgcttgtgggggtctagttcgtgattcctcgggatgttacctaggtggtttcacagttaacttaggcaacacatcggttactttagcggagctatggggtgttgttcacggtctgaagttggcgtgggatcttggttgcaagaaggtgaaggtggacattgattctggcaatgctcttggtcttgttaggcatggccctgtggctaacgaccctgctttcgcgttggtttcggagatcaacgagcttgttcggaaagagtggttggtagagttctcgcacgtgtttagagaatctaaccgtgcggc

SEQ ID NO: 5492 - DNA, 384 bp, Glycine max
gcggcggcaaacgcaagcggtcggaggagctggcaaagcttcaggcgcagccgaatctcgatctccggctgacgccggttttttcgcagaaggttgagagccgccggccggaatctccgtcgatgacatcggtggaatccggaacgacgacggagaacagatttggggatcagtggggtcaccggaaagttctcaaccttttcatttgagaactctcctatatgtttcttcgagggttatgttttttgtgaatctaattaacgagttattattagttttgttttgttgttgtaatagtccttttgtttttggaggggttgttcccggatttgaagtccggcgagttttggtgagacactggcacaggatttctctagagaaatc

SEQ ID NO: 5493 - DNA, 512 bp, Glycine max
ctctcgctcgaccagctggagctcgatatgtggaggttccggttgccggaatcgactcggccggagctcgccagcgcggtgttcgtcgacggcgagctcatcgtcacggtgccgaaggggcacgaagaggagaatgatggggatggtgatagaggtatgggtggaggtagacttgtgcttgtacagtagtgatgaatgaatgaatgagtgggtgaggtaatgaatgattcttttgttaacgccttgtggcctttccaaacgtggccttgttagtatgtcggttagatttcaggttgttgttggaactagtttctctgtgaattttattgttgctattgttcagtcaggaacaaaaatgttttatctggattctggagaatggtttatccagaatccagataaaacatttttgttcctgactgaacaatagcaacaataaaattctcagagaaactagttccaacaacaacctgaaatctaaccgacatactaacacggccacgtttggcaag

SEQ ID NO: 5494 - DNA, 663 bp, Glycine max
ccaccttatggaattgacatcgataacaaccacaatccccctactggtcaaggccaacacctgggaaacgttctcaccgtaagctttaatatttctcaatttatttatttatgtttaaattattcattccatccttatagttttatgattattatctttttagttcctatagtttgaaagtagttcttttagtttatataatttatattttaattctctttagtcctataattttaaaagtgatttttttaattttatagttttatgatgcttacttttttagtctctataatttttaaattagagagactaaaaagaaaattaaaatgtaaactatataaactaaaaaaaatacttttaaactagaaaaagtaaaagagaattaaaatataaactataaaaattaaaaaaataacaaccataaaagtatagtgaccaatttaacctttatttattagttagacattcaattaataatcttggtttcttttttatcaatgcttttaataatgaatcagaatcgtccatcgacaaaagttcaatcggttccaggtggacactcatcgcttggatacttgttcggagacaagtgatatcgatcatgttttcattttattatctcgatggatatatcgaattccctgatagtactgcatattggtg

SEQ ID NO: 5495 - DNA, 365 bp, Glycine max
gagtgtttgcgtgacgccaagatagacaagagtcaggttcatgaggttgtgcttgttggaggttccactaggatccccaaggttcagcaactcttgcaggatttcttcaacgggaaagagctttgcaagagtattaaccccgatgaagctgtggcgtacggtgctgctgttcaggccgcgatcttgagcggcgaaggagacgagaaggttcaggatttattgctgctggatgttacaccactcagtctcggtcttgaaactgctggtggtgtcatgactgtgctgattccgcggaacacaactattcccacgaagaaggagcagattttctcaacctattctgataaccagcccggggtgttgat

SEQ ID NO: 5496 - DNA, 351 bp, Glycine max
atatcctcagaagctgccttttcaaaagcaaatacatttcgatttataaaaaagattgtactagtagtagtagaaaccaatattaaaaaggaaagaaagaaaaataggagaaaaagatgaaaaatcacacatagaccctttcctctctcgatactataactgcgaatgcgtaggggacagtgagagccagatgtctcctctatatagttcgtaacgcctctttcttacctctcattcatgcattagcaatatttctcaatctctcttcttacccatttcctgccccccctctttctcttttcttgttctgtttttattttcactgttctctgataacaacgttgttagttg

SEQ ID NO: 5497 - DNA, 260 bp, Glycine max
gtcacagattttgagttatgacatgtgacaatgcagttaaatttgaactgttagattaatttaagttatcttaaccgttggagtaagacacttgagcatgtaaaaaatcgtatgggattgtatgcgtagtaaaagaatcgttccattccatagggtaacaaaaaaaaaagggaaaaaccatgggggattggaaccgttggggaggggccccctttgaaaggtttggaattggtttgatttgatgattggtgggggttaaa

SEQ ID NO: 5498 - DNA, 478 bp, Glycine max
ataattatttggttataggttaaaattttgtagaaactttttgacagtgaattgattcagttatggttataaggaacttgtgaagtatcttacataattaaaaacaattaaagaatttgataaaaacagtcaggaggaccagactatgagattcctttgggaaggagagacgggctaacctttgccacaagacaagtgacattggacaaccttccaccaccttcaagcaacgcctcaaccatcctaagctccctcgccaccaaaaacctcgacccaaccgatgtcgtagccctctcaggtggccacaccataggcatcagccactgcggttccttcaccaacaggctctaccccacccaagaccccgtcatggacaagaccttcggcaacaacctcagacgcacgtgccccgccgccaacaccgacaacaccaccgttcttgacatccgatcccccaacaccttcgacaacaagtact

SEQ ID NO: 5499 - DNA, 320 bp, Glycine max
gatgtgcgccggttgttgttacagacatggctgcagcctctgatgaatgactacaactggctgcagcatggatgcaggtcatttgataggaaacttgtggaggaaggaattgggaggactattctcaccttgcctcttgaggatcaacaaagcattttgctttcatggttggggagtttcttgaaaactggtgatagctgtcccaatcttcaaagggcatttgaggtgtggtggaggagaaccttcattaggccatatgtggagaaccaaggtaatgttgctgtgtcagatagtagttcaatgttgccaaagcagcgtga

SEQ ID NO: 5500 - DNA, 406 bp, Glycine max
cacacacgggggtaaaaaagtcaatccaatgggtggagttggggttcaacctatgaacggtggattccaaaacatgggtggtggtccccacgttatgtctgggcctaatgtggggcccatgagcatgcctatgcccaacattcccgccgttcaagggcttccggccggccccgtcaacggcggtgggttcttccaaggcgcaggtccggatgcgatgcccggtaaccctttccagcagcagcagcagcagcaacaacaacaacagttacagcaacagtacatggctgctgcgatgatgaaccaacaacgcgcaatgggtaacgacagattccagccaatgatgtacgcgcggccccctcctgccgtcaattatatgtatcctccttacccttatcctcctccagac

SEQ ID NO: 5501 - DNA, 391 bp, Glycine max
  misc_feature (371)..(371): n is a, c, g, or t
ccaaatagctgcttctcaatataaccgtgtaagctcttcatgctgtttccctttgatcttactatttacattaacctatcaaatcgatgctgtgctgattctactcatcatgcaggagttgaaagatatcatataggaaacaacactgtaaatcctttttcctttttgtgtatatcgtctatttctgtttcccacgtctacactgcaatagttgatctctggcatccttcagttcttattttaattaacagagaggcgttcccaatttgcaaattattgtgtagtcaagattttgctagttatgagagacagattgtaatgagtacaatagtgtataaatgagataggtttatgaagtgatgcttcgtggngttatgaagtgatgcttcgg

SEQ ID NO: 5502 - DNA, 400 bp, Glycine max
tagaagtaagtttgaatggtagggattttattggggtttggagaagtttggcagcaggaattgatcaattgatttttaatggtattctcataagcaatgtaaaatttcacaatagtggtgttgaaagatttggtagcgacttggatgttttatttggggtatttggagcatggtgtttgcgacctgaaggttttttcccaaaatcaaatgaaggtctgaagttgttgaagatggatgaaaatagactgcaagaatgtatgggaggggggaagagatggttgaaggagaatgggctcaggcgtttgagtgtaactgaagcagaaaagattttgaagaacagggtgttcacaagttgaagcttttgggcttacattttaagcgcatgctctgctggaatggc

SEQ ID NO: 5503 - DNA, 633 bp, Glycine max
tgtgcaatcattggagatctgaaggattcaaaaagaagagcacccaagcaaaaacaaatcgagcatctaattgtggagcatctcacactggtggctctattagtgcttcacagcatagagctaatatggttaagttgtgaattaatataatttattgtattgtttatctcatatgatttactgtaataatctcttggtttaacttgaaatctaacaatatcttgtattctttgttctattttagatgaaagagactggaaccattcctactccattggagttgttccgtcgcatgcaccaacgtaaggacaacacatgggtggataggagatcacaacatgtaaacgtaatgaactttcacgtttataatcgtgtaattgtttgtggtgttgttttaattctattttggtttgttatgaaacagttattaggcttatattggtgatgacaggaggtatttacacgcacattgaaacaattgaccaaaagagcatcggcacaaggtaaacctccaccaagtgagttagatgtgtggtgtgatgtagctagatcaaagaaaggaaaagtttatgggtttggaatggaatctacagtaatggcaacaagtccttgctatcgttgctcatcttcttc

SEQ ID NO: 5504 - DNA, 981 bp, Glycine max
  misc_feature (632)..(632): n is a, c, g, or t
  misc_feature (636)..(638): n is a, c, g, or t
tagtttgctgcataagttacatgaaaaagagtcctgtattactccttggtcttttatttggacatacataattcgatgatatatgctcttgtaaaccgaggagagcaatggctatcttggttaatgaagtagagttccagtttctctctcaaatttgtcttgagaatttcactctggtattatgtttaattttttattggtgttggtacaattttttctaagccaataacttgtacttgagaatagagaaacagagaatcagaaaccaaaaataacatacttggtttcgtagttgcattttatgccaaagaaatttcttagccaaagttttcatattaatattatacagctttcttttaccaaataaggaactctttacacgttaatagaagtcaaattcttcatctatgtcttgcaggttgaggtgttgtggagtagtggggttaggaaattgcctccactatctcctttgcttgtaaagggccggaatctctataaacagaaaacttacagacaggtattaatcagtgcgtacaagcctttatctctgttttcttttctatcctctggatgttacagtttctttcttacttttattgtttctttgatgctctagagatggaaaaaggaanttgnnngaatcgaggtgcttcgtgagaagcacggacgtggtgcagcagcgagatctataagatcattgaagcgaaaaaataaaagctgttatgcaaatgaatctaaaggtaattttgaactttaatggatgcatttgttgcactatcttacaatttttcacattattggaaacttgtcactcatctcctgcaattattaggttcaaaacggcagcatgaaatccatactaaaaaacaatcaaaaataggaagatccaatgtagtagacaaggttaggcaccaagatggctccaaaagagcaaacaactttcaacctcgagaggtcacttcatcaagtcaagcaacacag

SEQ ID NO: 5505 - DNA, 749 bp, Glycine max
  misc_feature (720)..(726): n is a, c, g, or t
cttctatcatctttatattgatattgatcttcatcttcatcttcttcgtcatctgattccaagcaatacctaacgtctgcatctgaatctaattctaagtaattcctggcggcaatggcctcatctgtacctgatagcaagtagtttttaagggcttcacggtaatcagcagggtcgtgccaccaagttggtgtatccagaatggccttctgcaaccaatactcgtcttcctcttctttctgagctgtcatgctttcatagagttgtccccattgatacatggcatttttcagtcggacactctggcttcccccaaatagatacttgatatagtctctagctagctttgtgagttcctccccagtgagaatataaatgtactggaaaaaacaattatatgtacgaaatgaggaatggcctatgtcttattaactttattaatcatgtccaagatgattactatcccatcagaagtttgcatatggacatttattccacactcaaaagcctcatacactctaaagtacttctgcaattagctacttctatcattaatttacattataactgtgcaacttggaaggcttcttccattaataatacacaaacacgattatgattttttttttctcaagttacttccacttaaacctttctgcttccagttttcatatttcccatttttgtgcacaaaattaaaaaaaaaaatgtttaaaagtnnnnnnnaggaaaatctttaatttttgtgg

SEQ ID NO: 5506 - DNA, 312 bp, Glycine max
tttgagtggagaaattccttctcggattgggaatttaaggtcactagaatcacttgacttgtcaagaaatcacatctctgggagaattccttcttctctttctgaaattgattatttgcaaaaattagacttgtcacacaactctctttctggaagaatcccatcaggaagacattttgaaacctttgaagcctctagttttgaaggaaacattgatctttgtggtgaacaacttaacaaaacttgtcctggggatggagatcagacaacagaagagcatcaagaaccaccagtcaaaggtgatgattcagt

SEQ ID NO: 5507 - DNA, 957 bp, Glycine max
tgatcatttcattcccttgacctatgatcatttcatttccaagccattcagatgggatgtcacctctaagaatttgaacttcaagtatgactttcttgtcactgctttccatgagctcaaaaatgcaagcatctccaaccctcaaacaattatcaataacaaattttttccagcctgtgacaccaaaagccttctgtttgctttgtccataatacaccatgtcccagctcttgcccccatagatgagaatagtagggacctcattagaaggaagttttgaccgcaagttcatccccggcatctatatacaatacaagatttttaaaatgattttcctttgtatacaaacatgaaattgtcttgtgtgcctcaatgtgttcaacatttctcaaggcatagtaaggaaatcaattttcactatgatatatagcgtgtttggattaacatctgtgattcacgtttgatcaaattttcatgtttggattaacatctgtgattcacatttgatcaaattttcatgtcaagatgcaccaaaaacaactaaaagttgcttttgtgatccacgtttgagttatgcggatgtgaatccaaactatagacacatggacctttatgaaacaacaaatgaactgatgaagtaattaaactccaatgtttccaagcataaaataaaatgtgctaaaatcagtggggccatgagtatgtttaactaaatataagaccatgataagagaggtaataagttagacataacgatgcatcaacaaaagcattagaacaagagacattgaatttagtcaagtctgtcctttattagaccaaattatggtcatttggcttctttatcatttttgtctttatttactaaaaacgaatgaaatagcatatgggttctgtaaaaccaagtacaaaattaccaagttataacggggttgaagattgtaggcgaaagaacac

SEQ ID NO: 5508 - DNA, 384 bp, Glycine max
agtgggttctctatcttccgaaatggagacactgaatcatgtcctagccctagtggaggcattccgagcatttgacgcggacaacgatggccgaatcacgcaggcagagctaggaggaatcttggggtcactcgggtacaaccctagcgagcaagaagttagggcaatgattgaacacggcgacaagaacaaagacgggttgttgagcatccacgagttcttggagatgaacaccaaggatttggagggtggaaatctcgccaacaccctcagcaccgcgtttgaggctttggatgaagacgggaacgagattttaaccggggaagagcttcatgaggtcatgcaaaacttgggtttggacttgtctcttgagaattgtgtgca

SEQ ID NO: 5509 - DNA, 1358 bp, Glycine max
attggagaaaatcagattacatggctatcacccttctctgcacgctccttacccttctaatttttccaacgtaaacctctctattctcttctttaattttttcctttcgataaaacaaaacaattctttttcttgaattccttaaattcaatggagtttaatttgtccctctgcaggaagatccaagagtgcaaatagcatattcatcggtgccatcatcttctttttcttactcatcatcatacgcagcttcctatggattccaacccaacatcatggttaatttaatttggctttttcaaatgctagttagttttattcttttacttaaatgacagtataattttaccaattaattaactttgattcttttgtcatggatgacatgttccgcacatacatatttttcacctatctgactaataaataaccatcactgataagtcaatctatgcaagtgtacagtgtatatataactgcaccgcacgcgaagcagcaatcaagtatggttatttttctacaccttgtaattttttatttgattatataaatccatgtgatatacgaacttgacaatataatatttaaattctgaactaaccctcctttatatttcgttgagtttgaattaaagtacactctactactactttatcagggtagtacaacttatgcaagtactaaccctaggcataaagggctgaattactctgagttctggtagctaaataatgaccaaagtcattatttagcgtgacgagaagcgtcaagactgtctttgaaaacatcatcgataatattcgtgcttacagattttcacatatctatttgcagatagtacaagtagttccttatttctttctttcaactcttttttcataggatgaagtgtgacaatatactaatacacatgaaaagagagtgatttgggagaatcctgcaattttgacaattgtttgcttgtgcagatgggcctatccgaatatcaaaaaacaaacatcagatatggagattctcagccaactaatacagcaaggtacttaattaagtcttctccagccatcgatccttgccattgataaaaaaagagtgtgtttatatataaaagatgattattttttctctctcttgttttgctgtcatgatgaattcttgctgatatgtgaaattctttttctcaaacaagatgggaaactaccagcgtcatcttggagagccagtattctgctccatccaacatagctcgaccctttctaaacctaaatgttaggagattttttaaaagtgcatgcaactcgtttgatattccatgcagaaaatatgtaaattgaaaatgatcttactatatttgttgcttt

SEQ ID NO: 5510 - DNA, 393 bp, Glycine max
tgatcgacatttcattaaggagaaattggacagtggtcttatagctaccaaatacatcccttcaaagcttcagttggctgatatgttcaccaagggacttcccacggagcagcttcaagaccttacttgcaaggtgggaatgatagatgtacattcactagcttgagggggagtgttgtgatacattccataattagcacagattttcttctgtaattagtacagatttgattttttttttatttgtacagattttgttccattttatttcttttcttaattaggtcgttggcagcttataaataagtcttgtattcactctttgaaagacagaattacaataatattcaaattattatctttcaagtactcaggatctacagggaccagtta

SEQ ID NO: 5511 - DNA, 380 bp, Glycine max
gtggcggcagcgtgtacttagacgacaacgttttgttcgaggtgctgaagcacgtggacgcgcggtcgttggcgatggcggggtgcgtgagcaagcagtggcagaaggcggcgcgtgacgagaggctatgggaactgatctgcaccaagcagtgggcaaacacagggtgcggtgagcaacagctacgatccgtggtcctcgccctcggaggcttccgtcgtctccacgcgctctacctctggcctctctccaagccccacgcgccttcttcttcttcttcttcttcttcgtggcctgccatcccgcacgtgcttcggtccaaacctcgttggggcaaggacgaggttcacctctccctctccctactctccattcgttaa

SEQ ID NO: 5512 - DNA, 1240 bp, Glycine max
  misc_feature (668)..(670): n is a, c, g, or t
  misc_feature (676)..(678): n is a, c, g, or t
  misc_feature (681)..(681): n is a, c, g, or t
  misc_feature (746)..(746): n is a, c, g, or t
tctttcctttcgctttagctgatgttgttgcagctttgaagaggaagaggtgtcatgtgccttacaggtaagtattctgctggtgttgatttgtcatttttaatttatgtccttctagcttctagatgttatctgtacctgaaaaagtaatttaacttcaaagagtcccttttactgcttctagttttttgtactatcattatttctttctagacaatcaaagtatctatagttagttaatttatgctacttcgcttgcaggaatagcaagctgactcaaatactgaaagattctcttggtatgatactatttcttctttagatagcatacactacccacttttgcgcatgagatgtagtgataaatcttttacaaaattagaaattcatagaatttgaaatatttacccgtgttagtctttagctcatttagactattgagtaagaacagggagacccaatcagcttcttttgttgatgtgtcaacatctgtatgaaccatgcatttgtaaatgtgataagatggaatgaactaccaatttagtctcctaagtattattaccctctctcttaagtagttcctaaagtaacaacactatataagtaatttccctaagcattaaattaccatcgatttagttcctaaattgatgtattctattaacgtnnngggatnnnctngaaaggttttttaatatttgaaggactacttatcatgatttctaatatttcagggattttttttnttaaatttagggatgatttaggagagggtaatgcttcaaggaatcaagaatgaaattgatagtttatttgatattgatggctcgtgatttctgtacagagtattttgtttttttttttttttatctaaaatataaaatgtctaatctttataatcaaatacttaagggtatggctcaaaggtattgatgttggtgcatataagcccttccgaagaagatgtttgcgaaacagtttgttccttgaactttgcaaagagagcgagagcaatagagtccaacaaagaagtgccagtggtaatttactgaattttttctaaagcaagttcctcggtggtaactgttagaagattgctgactacatgcatatatatactgtaggaagtgaagaagcaaagggagaagaagattatggaactagaggaagacatcaaggaagccgtaaaacagcgccagaatttaagggaacaaatacagaagatgagtgaagtaaagag

SEQ ID NO: 5513 - DNA, 1162 bp, Glycine max
aggcgttactacccctaatcctgaaatagcatctctgaatcggaatagtttcccaactggcttcatctttggcacagcatcctcggcatatcaagtacacacattcaccaaatgatttatgattgaataataatttacaattattgtataacatctttgtataattttttttctcatatatatattacctacgtacatgcatgacataataagttaaaatgttaaaatgtttttagtttttttcttactttttcttaatgcagtttttttcttactttattttgtggtgttcatgattatgtattatgcagtacgaaggtgcagcaaatgagggtggtagaggaccaagtatttgggataccttcacccataaatatccaggtatgtatgtatatatatatatatgtttcccttctatttttttttctccaaaatttatacaattgtttatatgtaaattgacatgcagataagataaaggatagagacagtggagatgtagccattgattcatatcatcgctacaaggtattgcggattcaaagtttttgtttcttctaaagtaatttaccaattatattatccttactaatgaaaagtactaaataataaattaaaactcatcaattatttgcataataaaatatgaaacggaaaagatgcttttctaattttcttatcacgatcatgacgtacacttttattaatgattggcactagcttgtatcatgctgtaaaaagagaaactatagagtatcatgaaatattgtaaccaaattaattaattaataattaattaagaaatcaattaattagacccttgcagattcaactaagagataaattttaaacactaaaaagttaaaataaatgttagtatcttttgtttttcactgttttcatttttcaagtaaagatactgatgtcatgttgcatacttttaggaagatgttgggattatgaaggatatgaatttggatgcttacagattttccatatcttggtctagaatactcccgagtaagtcgattatagatcaatgactattttggactaaaatgtacctgtttggatcgatgttatactttaacctttgtttttttcctcataaactatatttctatagaaggaaagctaagtggaggtataaatcaagaaggaa

SEQ ID NO: 5514 - DNA, 704 bp, Glycine max
  misc_feature (645)..(646): n is a, c, g, or t
  misc_feature (679)..(680): n is a, c, g, or t
tgtgagcattgccaagcctagtacatgtgtgaaatcagatacaatgcaactatgtttggtacgagattacctttaagaaataatagtttgtttttttttcaaaacttctttcaaaaggctgaaaaataagtaattttcaaataaaattcctttatttctatgtttaagcaggctattgggattgggaatttttcagagatattatttattgttcagggttcatcacttaccagaacctcaagcgatccgaaaagcaagcatgtggtaaatctgttcaagtaagtatctgagatgaagcctccaacaagggaaagcaggtaggttgaagccatgaagtttgtgagggtgttggctgaactggccaaatcaaagtgcatcactccataaaagtataggactatgctcaccatgtttgccacaaaacccatgttgtccaatgctgacaagactatacaatgaacaacaagaaagggaaagggggcaaaaaaagcttaacatatatcttgctgagaaatcacataacatagagtaagagtcttttttttttttttttttcccaaaaaaaaaaggggaaaccgaaaccccccctttttttttcccccttgggggggggggcctttgttttttttttttaaagggggaacnnggtgggaaaaattttaaaaattcccccttttanncccattggggaaaaaaaaaaaggg

SEQ ID NO: 5515 - DNA, 402 bp, Glycine max
tcgcagcctagtctcgaagctcagctccgtctccgaagccgcccgcatcgacgccctctcccagctccgcctcatgtcaaaacaatcccccgaaacgcgccccatcatcgcccaagcaggcgcaatcccctacatcgcagaaaccctctattcctcttctcacccctcccaagaagacgccgctgccacactcctcaacctctccatcaccctaaaggagcccctcatgtccacacgtggcgtcctcgacgccatcgcccacgtcatctctcaccaccacaccacctcctctccccctgcggttcagtccgccgccgccaccatccacagcctcctctcctcggtcgactcctaccgccccgttgtcggctccaagcgcgagattggctactccctcatcga

SEQ ID NO: 5516 - DNA, 408 bp, Glycine max
ctcaaaagtgtataactccataacacaaaaatagttaaggctgtgttcgtttttagtggtgaagagaaatatacagaaaaataatgtgaaatttactattttacattttatctgattcaaaactttggtctcaatttatttttcttttcaccctacccaacagaacctcactcattttccacactcgcagactcagtgattcatttgctccattttccgattttccatgtcgttcgcgtcatcattctcgatgctccggcaccgcgcggcggcttccgcggcgcctctcctcctcctccgccgcttccgctgcctccgaatcgccgccagacaccaacaacaaaaccctaacaaacaagccccccctagccgcaacctcctgaaggcgaaacagacactgaaggaatt

SEQ ID NO: 5517 - DNA, 1238 bp, Glycine max
  misc_feature (33)..(36): n is a, c, g, or t
  misc_feature (1228)..(1229): n is a, c, g, or t
  misc_feature (1233)..(1235): n is a, c, g, or t
ctttagtgagcgaatgctagagttgtttttcgnnnntatatgatccgttgtgatgtaaataataggcttggcttgaccctctgaatataccatcagggagatcatctgtgtgtgacatttgtggagatcctttacaactcttgcttcaggtatgaagttaatccctcatatcattgacatttgtatggtttgtgttgtacctgtggattgtgatatatagtgtattaaatgcttgaattgctaggtttatgcaccaactgacaaggaaaccacatttcaccgaatgttgtttgtttttatgtgtccctccatgaaatgtcttcttagggatcagcatgagcaatggaaacgccatccagagaagccatctagaaggttaatgatcatcctctgtgaaataaacttttccattgttctagttcctatgattgttgatctctgattatgtaatgatttattgaagtgtgaaggttttccgttgtcaactaccccgcattaatccattttactcacctgaatgccctcagtataatgagagccacgaacctgctggcagtggaggttggtttactcgtcataatatttttgcttcatttgctgaaaataatcccatcttacaaatatttgttgtgaccatttatgtagttatgtaaatccatggtaaattcgtttgagttttatcaatttttacttgtttgaatcctttggtttggtatggtgaagagagtttgttgtttctgtttgatcattatttgctggcttgtgtttgtgtatgtcgatttgtgaatatatatacccatgattgtctcattgtgagtactgagtactagtgttagggagtcctgcatgaagtaaaaaaagttcatgattacttgttatcctcccttcttttattgcacatagtgacaccatgcttttatctggaaagaaaataatatgatgtcattctcaaacataattttggttaccttgaagctgaacatgccatttgcatagttgcattgtattcttatttttgttatatgccacattatttctacagttattatactaaacatataggtaatatatggcatgcttgctcattaagataagttgattagcacttttgatgacttagaggcgttggactaaatgtatgtgcattctataacacaaatttgttctgaatctacctccattttgatagaatgttttcttactttcagctgctctttgtgattggtgnncacnnnaaa

SEQ ID NO: 5518 - DNA, 1169 bp, Glycine max
  misc_feature (318)..(323): n is a, c, g, or t
  misc_feature (329)..(354): n is a, c, g, or t
  misc_feature (358)..(370): n is a, c, g, or t
  misc_feature (374)..(423): n is a, c, g, or t
  misc_feature (430)..(476): n is a, c, g, or t
  misc_feature (478)..(484): n is a, c, g, or t
  misc_feature (486)..(491): n is a, c, g, or t
  misc_feature (493)..(525): n is a, c, g, or t
  misc_feature (528)..(531): n is a, c, g, or t
  misc_feature (535)..(547): n is a, c, g, or t
  misc_feature (551)..(551): n is a, c, g, or t
  misc_feature (553)..(554): n is a, c, g, or t
  misc_feature (558)..(566): n is a, c, g, or t
  misc_feature (569)..(571): n is a, c, g, or t
  misc_feature (574)..(584): n is a, c, g, or t
  misc_feature (587)..(601): n is a, c, g, or t
  misc_feature (607)..(624): n is a, c, g, or t
  misc_feature (626)..(646): n is a, c, g, or t
  misc_feature (648)..(655): n is a, c, g, or t
  misc_feature (659)..(678): n is a, c, g, or t
  misc_feature (684)..(697): n is a, c, g, or t
  misc_feature (704)..(704): n is a, c, g, or t
  misc_feature (706)..(722): n is a, c, g, or t
  misc_feature (724)..(734): n is a, c, g, or t
  misc_feature (737)..(746): n is a, c, g, or t
  misc_feature (753)..(771): n is a, c, g, or t
  misc_feature (773)..(787): n is a, c, g, or t
  misc_feature (789)..(792): n is a, c, g, or t
  misc_feature (800)..(808): n is a, c, g, or t
  misc_feature (813)..(829): n is a, c, g, or t
  misc_feature (831)..(832): n is a, c, g, or t
  misc_feature (836)..(871): n is a, c, g, or t
  misc_feature (873)..(877): n is a, c, g, or t
  misc_feature (879)..(883): n is a, c, g, or t
  misc_feature (895)..(898): n is a, c, g, or t
  misc_feature (900)..(916): n is a, c, g, or t
  misc_feature (922)..(943): n is a, c, g, or t
  misc_feature (945)..(955): n is a, c, g, or t
  misc_feature (961)..(961): n is a, c, g, or t
  misc_feature (963)..(967): n is a, c, g, or t
  misc_feature (972)..(980): n is a, c, g, or t
  misc_feature (986)..(994): n is a, c, g, or t
  misc_feature (996)..(1005): n is a, c, g, or t
  misc_feature (1007)..(1009): n is a, c, g, or t
  misc_feature (1012)..(1012): n is a, c, g, or t
  misc_feature (1014)..(1014): n is a, c, g, or t
  misc_feature (1018)..(1019): n is a, c, g, or t
  misc_feature (1022)..(1029): n is a, c, g, or t
  misc_feature (1035)..(1035): n is a, c, g, or t
  misc_feature (1037)..(1039): n is a, c, g, or t
  misc_feature (1041)..(1044): n is a, c, g, or t
  misc_feature (1046)..(1046): n is a, c, g, or t
  misc_feature (1048)..(1048): n is a, c, g, or t
  misc_feature (1050)..(1053): n is a, c, g, or t
  misc_feature (1056)..(1070): n is a, c, g, or t
  misc_feature (1072)..(1077): n is a, c, g, or t
  misc_feature (1079)..(1085): n is a, c, g, or t
  misc_feature (1087)..(1098): n is a, c, g, or t
  misc_feature (1100)..(1108): n is a, c, g, or t
  misc_feature (1111)..(1113): n is a, c, g, or t
  misc_feature (1115)..(1122): n is a, c, g, or t
  misc_feature (1128)..(1130): n is a, c, g, or t
  misc_feature (1132)..(1135): n is a, c, g, or t
  misc_feature (1138)..(1151): n is a, c, g, or t
  misc_feature (1160)..(1162): n is a, c, g, or t
  misc_feature (1164)..(1166): n is a, c, g, or t
atgatagtcagctacttgatccctaagtagtagtgacgatgaggattttgtgggtaatggctttggttattaattttcaatcgaggagaagctgtaattatttatttcttcatcatattcattttagagcgaaatgttaattttggctcaaaattttgctgttttcttttacctttttatgtcctctgcgattttatgatgctgaaagggtctagaagcgcagttgtatataataatgttaaaaaaaccgatggcctatgatctttcttttttgatccggatgttgggagcagagatgtcaatgttcgtagtaaagannnnnnttgcannnnnnnnnnnnnnnnnnnnnnnnnnccannnnnnnnnnnnncccnnnnnnnnnnnnnnnnnnnnnnnnnnnnnnnnnnnnnnnnnnnnnnnnnnccccccnnnnnnnnnnnnnnnnnnnnnnnnnnnnnnnnnnnnnnnnnnnnnnncnnnnnnncnnnnnncnnnnnnnnnnnnnnnnnnnnnnnnnnnnnnnnnccnnnncccnnnnnnnnnnnnncccncnncccnnnnnnnnnccnnnccnnnnnnnnnnnccnnnnnnnnnnnnnnncccccnnnnnnnnnnnnnnnnnncnnnnnnnnnnnnnnnnnnnnncnnnnnnnncccnnnnnnnnnnnnnnnnnnnnccccannnnnnnnnnnnnncaaaacnannnnnnnnnnnnnnnnnannnnnnnnnnncannnnnnnnnncacaaannnnnnnnnnnnnnnnnnncnnnnnnnnnnnnnnncnnnnaaccaccnnnnnnnnnacaannnnnnnnnnnnnnnnnannacannnnnnnnnnnnnnnnnnnnnnnnnnnnnnnnnnnncnnnnncnnnnnccaaccaaaacnnnnannnnnnnnnnnnnnnnnaaaaannnnnnnnnnnnnnnnnnnnnncnnnnnnnnnnncccccncnnnnnaaccnnnnnnnnnccaccnnnnnnnnncnnnnnnnnnnannnaananaaanncannnnnnnnaacaanannncnnnncncncnnnnccnnnnnnnnnnnnnnncnnnnnncnnnnnnnannnnnnnnnnnnannnnnnnnncannncnnnnnnnnacaaannnannnnacnnnnnnnnnnnnnncacaaacannncnnnaca

SEQ ID NO: 5519 - DNA, 983 bp, Glycine max
  misc_feature (487)..(488): n is a, c, g, or t
  misc_feature (500)..(500): n is a, c, g, or t
  misc_feature (507)..(507): n is a, c, g, or t
  misc_feature (510)..(512): n is a, c, g, or t
  misc_feature (523)..(524): n is a, c, g, or t
  misc_feature (527)..(530): n is a, c, g, or t
  misc_feature (534)..(535): n is a, c, g, or t
  misc_feature (546)..(547): n is a, c, g, or t
  misc_feature (557)..(559): n is a, c, g, or t
  misc_feature (564)..(564): n is a, c, g, or t
  misc_feature (566)..(575): n is a, c, g, or t
  misc_feature (577)..(584): n is a, c, g, or t
  misc_feature (587)..(598): n is a, c, g, or t
  misc_feature (600)..(602): n is a, c, g, or t
  misc_feature (609)..(609): n is a, c, g, or t
  misc_feature (615)..(618): n is a, c, g, or t
  misc_feature (620)..(625): n is a, c, g, or t
  misc_feature (629)..(630): n is a, c, g, or t
  misc_feature (633)..(636): n is a, c, g, or t
  misc_feature (646)..(653): n is a, c, g, or t
  misc_feature (655)..(662): n is a, c, g, or t
  misc_feature (666)..(672): n is a, c, g, or t
  misc_feature (678)..(678): n is a, c, g, or t
  misc_feature (681)..(683): n is a, c, g, or t
  misc_feature (685)..(686): n is a, c, g, or t
  misc_feature (692)..(694): n is a, c, g, or t
  misc_feature (696)..(700): n is a, c, g, or t
  misc_feature (702)..(704): n is a, c, g, or t
  misc_feature (706)..(722): n is a, c, g, or t
  misc_feature (728)..(728): n is a, c, g, or t
  misc_feature (733)..(735): n is a, c, g, or t
  misc_feature (737)..(745): n is a, c, g, or t
  misc_feature (748)..(750): n is a, c, g, or t
  misc_feature (752)..(761): n is a, c, g, or t
  misc_feature (767)..(769): n is a, c, g, or t
  misc_feature (771)..(776): n is a, c, g, or t
  misc_feature (778)..(778): n is a, c, g, or t
  misc_feature (786)..(787): n is a, c, g, or t
  misc_feature (789)..(795): n is a, c, g, or t
  misc_feature (797)..(799): n is a, c, g, or t
  misc_feature (801)..(808): n is a, c, g, or t
  misc_feature (812)..(812): n is a, c, g, or t
  misc_feature (814)..(814): n is a, c, g, or t
  misc_feature (816)..(818): n is a, c, g, or t
  misc_feature (825)..(826): n is a, c, g, or t
  misc_feature (828)..(830): n is a, c, g, or t
  misc_feature (836)..(843): n is a, c, g, or t
  misc_feature (852)..(864): n is a, c, g, or t
  misc_feature (868)..(868): n is a, c, g, or t
  misc_feature (870)..(882): n is a, c, g, or t
  misc_feature (884)..(886): n is a, c, g, or t
  misc_feature (890)..(903): n is a, c, g, or t
  misc_feature (912)..(914): n is a, c, g, or t
  misc_feature (919)..(929): n is a, c, g, or t
  misc_feature (931)..(946): n is a, c, g, or t
  misc_feature (954)..(962): n is a, c, g, or t
  misc_feature (964)..(966): n is a, c, g, or t
  misc_feature (972)..(975): n is a, c, g, or t
atacaccactagttttatttttctgcgtaccttttatctattatacttattcatgaagaaactcaaacagtattatagtattatatgtatggcctgatcataattcacatgggtgattcattttcagtttggtaggtgctgttggagttattgctggtttatatattgtgctttggggtaaagccaaagagtttgctgagattaaaccagaggcggcaccacaatcatcaaacttacaagatgatcatgatataagtagtaggatagatttggaacaaccccttctgtcagagaaattgtccgaacatgtaacagaagcagatagcaaggtgtagccatgcatgatgattgaaccaatatatatatatagaagttttggtgaagttttgatcattgcagaattgaagaaactgaaacatggaacaagttgcagcttaaacaaacttggcttagttcctttcaccaaaaaggcttgtatttcacattnnccggtggacctnatgtatnccnnnctgaatccctnncannnntctnntaatcctccanncaacatgtcnnnacctnannnnnnnnnncnnnnnnnnccnnnnnnnnnnnncnnnttcctcncctccnnnnannnnnncggnnccnnnnctggcctttnnnnnnnncnnnnnnnncccnnnnnnntctcgnctnnnannaacaannnannnnncnnncnnnnnnnnnnnnnnnnncccttnactannntnnnnnnnnntcnnnannnnnnnnnncatctnnncnnnnnntntctctcgnntnnnnnnncnnntnnnnnnnncccntncnnnatcctcnncnnngccccnnnnnnnnccccccccnnnnnnnnnnnnnctcntnnnnnnnnnnnnntnnncccnnnnnnnnnnnnnnctccatcannntactnnnnnnnnnnncnnnnnnnnnnnnnnnnttctcctnnnnnnnnntnnnctcctnnnncctctcct

SEQ ID NO: 5520 - DNA, 368 bp, Glycine max
tggcctccaaatcaccgccaattcctcaagatgcctgcaagcctaaagattcagcggacaatgagagtaaagataagaaaatagaatcggaatctataaaagaaagctgttcaagcctggtagaagagaagaatgaaacactaactcttccggataaagaggatagtaaaacagaaattgatgaaactatgaatgatgccgagttgaatgaaaacccggagaaatccgatgctgtattggatggttaaaactcaatgtctagtagacagatatttgttgtaccgtgtaatcatagtagtctcaatcagcatttttatcacattaaaagtgaagtaaattataaacaagaaggcactacagcatatgcg

SEQ ID NO: 5521 - DNA, 487 bp, Glycine max
aactcgactgcccccccattggcaacagttcgctgccgaggaaatttctgcccaggtctctctgtcgtctccgtcaatacttgttattattgttgattattgataatacctttacaactggtactgaattgtatgttatataggttctgaggaagcttgttgatgatgcttccaagtttttgaacgataaggttaccaaggccgttgttacggtgcctgcttacttcaatgactcccaaaggactgccaccaaggatgctggtcggattgctggtctagaggttcttcgtattatcaatgaaccaaccgctgcatccttagcctatggctttgaaaagaaaaacaacgaaactatccttgtttttgaccttggaggcggtacctttgatgtctccgtgctcgaggttggcgatggagtctttgaggtcctctctacttcaggtgatacccacttgggtggtgatgactttgataatgactttgatac

SEQ ID NO: 5522 - DNA, 1476 bp, Glycine max
ttgataacagcgtttaggttgtcaagcagtatttttagaaattttactcattgcaatcgtttaaatcaatttgactcgtgaaatactttttgaccaagaggatgtagaaaaattgaagtaacaatttatgctcaatcaacttttaaaaaatgctatttttcctgtcctatctgatattgacaacctgcagtatgcaataacttctacaggtaggatagtgattggattatatggccaagttgtaccgaaaactgtgggtatgtcattgttcttatgtttcatgttcctttgtctgcaacttaattgttttaagaatataaattttcattttgcatgaaccaagggtcggcttctttagtagaaaatgtaatatttgtgggtattcattttctttcacccttttgtacagggtgtctactttggacttcagttatttttgtaaattcaaacttaaatgtgcttgatggagctttctccttgtatatgtatgctatttacatacagtaaggcttatacattataacattgcaatttctaatgactgaattttctgtctgcagaaaattttagagctttgtgtacaggtagctgtagtctcttcattttgtttattaatttaatccccatcggtccttgcactgattaggagtgttccatgatgtgtaggggagaaaggaaagagtgaaaatggcataaagcttcattacaaaggaacaccatttcatcggataatatctggttttgtgattcagggtggagacattgttcatcatgatggtaaagggtctgaatctatttttggtggcacctttcctgatgagaatttcaagattaaacattctcatgccggtgagtaacaatttgcttggatgaaagcatttcattttattattaatatttttataacttgatgtttttctgtcatttctaagatatgtgtttgagttgtttctatgaaatcttactcccatgattgcaggagttgtttctatggcaaattcaggacctgattccaatggctcacagtttttccttaccacagtgaaggccagatggtaagttatttttgtccttgtagtgtatggtttggacgatttctagactggggatcagatgcagttggatcaaattctcgtaggttaagagcagtctttttagggtgcgagcacacacacttgtgagaatactgatttattgagaaaaataagaactataaacctagatcatataatcatacatggatggttaagatcatatatttaacttttaatctcattcattcaaatatgatctagtggtcaaaatttatagttgtgatttctcgcaatgacaagaattctcgcttggtatactttctatatatagattgattgacactacctttgaatttgttcttttaaaggcaaaatatatattcattgtgtcatcatcactggtttatagttatgagtatgatatcaatttacttgtaaactt

SEQ ID NO: 5523 - DNA, 701 bp, Glycine max
cacacagctccaacaacaggttctgcagcagcagcagcagcaatactttcaacagcagcaacctctgcagcaagaacaccctgaaaaccttatgcagcaacagcagccatcaacacaggtacaccaagtaggaaaagagaatatgaatactgatgaatttatgatcttgaattgatttggtgtgtgtaatttgtaaataagaagcaccagcacctctagagataaaagttctagcagactttcttaacgcagtgggtgagagattcttgatgaacagtttttattacagtgagattgtggaacatctttctctgaacctttagaactcaattctattacttttttgcaattgcagagcagcagtcatcccgtagcagaccaagggcaggcaatagtgacattgcaggtgagttaaatcgttattcttataggggaaaaaactagagagtgaattgcttttgtgttggtaaattccaatgcatctaaattggctgcatgtatggcttgttctccggccctttcaaacatgaactttaatttttgaattttgatcatgtagggccacggagcagtattatcgcaacaatcagacaaacttgggccgatttcttctccagttgtgcaccatcctcaagagaaatctacccaacaagagtgacatttccctggagattcgacagaatttcagtagtaaaataaga

SEQ ID NO: 5524 - DNA, 1180 bp, Glycine max
  misc_feature (1143)..(1145): n is a, c, g, or t
  misc_feature (1154)..(1156): n is a, c, g, or t
  misc_feature (1166)..(1169): n is a, c, g, or t
  misc_feature (1171)..(1176): n is a, c, g, or t
tattgcacataagtatccttattggaatagaactgaaggggcagaccattttttactatcatgtcatgattgggtaagatattatatcttatctatgtatagttctgcttttcttaattacttcctctttccttatactaatttgagactaggggcaaaacatatatttcgtactttgattactaattacttgattacagtggttagtagtaaatttatgaattataaaagcaaacaaatgctttaattgcttgatgattctgcaacaaaaaaattatatatatctagtgtgtgtgtttgtcaatgaaatatattaaccagcttaaaacctccaggaaatcatactccaacaagattcgcctttaaagcattacaaataaaataaaaattatacatttgcatcacatgcttagtcataaggtctgtaacctaattagactcccgcacattcacccaaaacacttcactttcatctctatatatctagtgtaaaacacgttatatactaataaaaaatattatttattaagttcgtactggacaaaaaaagttaataaattactagtctataacaacagaaacaagtctaaaccttagtaaattatcttatctgctaccatagatactcacaatatttatgtcatcaacctttcaatttcagctaaataaagactataacaatagaaacaagtctaaccctttttttttctagtgttttccagcccttagtaagctacttattttactttcttttttttattatttcatgtttcttccacttaggtgccagctaaggaaattttcattattgttgtgattagcaattttgttttaagaatgatattcattagtaacataagctttatatgatgattcagggtcccacaatttcgtatgccaatcctaaactcttcaagaactttatcagggtactatgcaatgctaacacctcggaaggattcagacctaacaaagatgtttctatacctgaagtgaatttattacctagaggaacgctaggctcacccaatcgaggacaacacccaaatgaccgtaccattttagctttctttgctggtagagaacatggtgcaattcgaacaatcttgttgaatcattggaaggacaaagataatgatgtcnnnaatatatgnnntctccaaaannnnannnnnncccc

SEQ ID NO: 5525 - DNA, 1396 bp, Glycine max
  misc_feature (903)..(903): n is a, c, g, or t
  misc_feature (908)..(938): n is a, c, g, or t
  misc_feature (940)..(944): n is a, c, g, or t
  misc_feature (959)..(968): n is a, c, g, or t
  misc_feature (972)..(974): n is a, c, g, or t
  misc_feature (980)..(981): n is a, c, g, or t
  misc_feature (987)..(995): n is a, c, g, or t
  misc_feature (998)..(1011): n is a, c, g, or t
  misc_feature (1013)..(1022): n is a, c, g, or t
  misc_feature (1027)..(1036): n is a, c, g, or t
  misc_feature (1041)..(1041): n is a, c, g, or t
  misc_feature (1043)..(1051): n is a, c, g, or t
  misc_feature (1055)..(1060): n is a, c, g, or t
  misc_feature (1063)..(1074): n is a, c, g, or t
  misc_feature (1077)..(1082): n is a, c, g, or t
  misc_feature (1084)..(1119): n is a, c, g, or t
  misc_feature (1123)..(1138): n is a, c, g, or t
  misc_feature (1141)..(1175): n is a, c, g, or t
  misc_feature (1177)..(1187): n is a, c, g, or t
  misc_feature (1191)..(1199): n is a, c, g, or t
  misc_feature (1208)..(1217): n is a, c, g, or t
  misc_feature (1219)..(1227): n is a, c, g, or t
  misc_feature (1229)..(1235): n is a, c, g, or t
  misc_feature (1237)..(1237): n is a, c, g, or t
  misc_feature (1240)..(1247): n is a, c, g, or t
  misc_feature (1250)..(1251): n is a, c, g, or t
  misc_feature (1254)..(1256): n is a, c, g, or t
  misc_feature (1259)..(1277): n is a, c, g, or t
  misc_feature (1284)..(1286): n is a, c, g, or t
  misc_feature (1289)..(1314): n is a, c, g, or t
  misc_feature (1317)..(1334): n is a, c, g, or t
  misc_feature (1336)..(1346): n is a, c, g, or t
  misc_feature (1348)..(1366): n is a, c, g, or t
  misc_feature (1369)..(1378): n is a, c, g, or t
  misc_feature (1380)..(1381): n is a, c, g, or t
  misc_feature (1384)..(1392): n is a, c, g, or t
gctcgggcagggccgaaccagtggggattgaaattcgacggtcacgagctggtgtaggcttagaagatccccacaaggagaagaggaaaaatgagggaatcatgatggacaggaaaaggaggaaagaggaggacctaatgaaagaatttgggtccaggcaaaagtcacagtggcagagtaggagagttataattaattacaataaggcaaaggctgcccttgatcaattggagaatagggaaattgtggagccacaaaagaatgacgatgacgcagagggtgaagaagaagaagaggaagaaataactgaagaggtgtgtgtgtaacttaaccatatctttttcacttatatttcttttaacctagtttttggtattcatttaagttgcatgccaaaaaatagtctggaaactgaatagttgcattttcttctcatgatcattatttctagattttttactactaaaaaaccataactaatggggtcagttacatgagtcaaacgatgccagaatgttctgccataaattatttctgtagacaaattgtagattcttcttaattgtttctcctatagtttttttaactgcattctgaaattcttgtaattcatttattattttaagctcattattgttgaacttagttatatttggattggttttaactttgatggtgttggtgatggaatgtaatggatgcaggacttgcacgatgttttgatgaaactgagggatgaatttaattattgcctcttttgtggatgccaagtgagtaaacaccaatgaagctcattttaatacattttataagatgaaatagcaaatccagtatggttgacaaataagaagcctctaatttgattgcaatatttttttcttcctccttatttgttcagtacgnatcannnnnnnnnnnnnnnnnnnnnnnnnnnnnnncnnnnnttttttttttttttnnnnnnnnnntttnnntttttnntttttnnnnnnnnnaannnnnnnnnnnnnnannnnnnnnnnataannnnnnnnnnaatanannnnnnnnnaaannnnnnaannnnnnnnnnnnatnnnnnntnnnnnnnnnnnnnnnnnnnnnnnnnnnnnnnnnnnnaaannnnnnnnnnnnnnnnaannnnnnnnnnnnnnnnnnnnnnnnnnnnnnnnnnnannnnnnnnnnntttnnnnnnnnnttatatatnnnnnnnnnnannnnnnnnnannnnnnnanaannnnnnnntanntannntannnnnnnnnnnnnnnnnnntatattnnnttnnnnnnnnnnnnnnnnnnnnnnnnnnatnnnnnnnnnnnnnnnnnntnnnnnnnnnnntnnnnnnnnnnnnnnnnnnnatnnnnnnnnnntnnttnnnnnnnnnataa

SEQ ID NO: 5526 - DNA, 804 bp, Glycine max
  misc_feature (749)..(749): n is a, c, g, or t
caaatcttggttcttttcatttcaccagcttctacttttcttgttctgaagcaggggaaaatgacaatggttttttggtagtggtaatttgtgaaacattgatttggtaaagatggcgtggagaaaagggtgtgaggaagtggctaattcgaagcctctgttcctcacgatctacactgttgtcatcattggaatcgtggtttcctccttcttcgtcttctctgctatatactcaaccaaccctccttctgctcaatcttctgcatggctctcttccatttcgagtatgtgtttccgttaaaaatcatgccttttcttgttccttgttagttttagcttcatttttaaatacccatttctatttttttttcttatcattccttaaataacgatactagcttttttatgttattgggttgcgggaatgtttgaaggtgcttgagttttggagcattatctaaatccctaagttttgtcttgtttttctgctgggcttattgaattgttgtcggaaaaggaaagttgagatatatgttttcttttgtatgtgtgtgagatgttaactctattgacaatttaatggtggtggtgcccatgtaggacaatttttatgtatttaaagccttggccttcttacaatatgcatgaattgaattttaaaccttagttgaacatggctttgcaggtgatgaaactcgtgttacagatcagacactaaaggtttctcggtcagcagcggtgcttattgngcccactccttccccaggatcacaaaatgaatggccaacgtctatatgggatgat

SEQ ID NO: 5527 - DNA, 352 bp, Glycine max
cttctcctcccccttatcatctcatcagattatggccccagctacaagtgcttcctcttctgtgtcacaacaggacttccttggagaacttcgtcgccaaatgcacagtgctaatcctagtttcaccacatgatggttggcttggattgtttaataaagtttttggatgatcgtggatttgctgaatgctttaagaacactttgatgctcagctacttattgtttgtgtttttgtgacttgttttgtcaaactcattactaatatatgtatcttgaaaatcagattcagaatatcaacctcgcctgtgtatgtgtaaattggggtgtcgctcattcaggaattgtataaaaa

SEQ ID NO: 5528 - DNA, 398 bp, Glycine max
cgcggcagcacggggagcacgtcgtttactctaaacggcaccttcagagcgtgtccccgttcgcacccaaacgacaacaacaacaacgccgttattgttgttattaccacgatccatgatgatgatgccaccagagcgtggaattgaatgcgaggaggcatcaaattcaaaggggagggattggattctaggattgattggaattatttttcttcgaaggatgatttcatgctagggctttgtttggttccgaatcgggaaaagggagaggatagaattttggggattattgtggtttcgaggtgggacccagaggggcacgtggcgatgcagggcgtcgtggttgtgaattcttcgttgacttcaaacctgaattctatttctgccgtgtcatgact

SEQ ID NO: 5529 - DNA, 356 bp, Glycine max
ttaatgtctctaagaagagaaacatgggataccaatccatgttcacaagaaaaccagcttttctctaatggctggagttttgattgttttgaggatcaaaactatcatcaagcttttcctccaaactctttctcttgccaacaagttcctcaaagttacaataacaaaggctacaactacaatgaaatttatagttccttactacatgaattctctgcaccccaagttatagattcatcatcctataacacccttgatacctctccttttctggctcaagaagattatccattgtccatgatggaagaagaagatccgggctttcttggggaagagcttcattgtttggaccttca

SEQ ID NO: 5530 - DNA, 799 bp, Glycine max
tgtcttatattagttcttattctgatagtttcaatttaaggcaattaattcttatgaagatgtattacaaagtttcaaattaccttataaacaggaccaaaaccaccctctcctaacttatttgcagctgagaaattgtttgtggcaacaacgatggtatcaaaagcaaatagttcaacttcattgttagtctttcccttgttattactttttatggttttgccgtacaccattgcaagcattgcattacctccaatgtcatgtaataacttcttctgcatcttttttctctccactagtggcgtgacatgaaaatataagttatttgaaaaagagtcttaaaatgcttaaaatgatcataaaaccatatccatattttactggggtaattattaccttttgctttgtattttctcaggaaggcacgcgataaatagaatatcacaggtattacaaaagctgctcccaccccaacgatgagccaaatccaccagctgtttactgcagaagataacgtgtgtagaaattaaaatgatatgcataaggaataaaaaagattaaaagtgataaatgtaaagactaaaatatggtgtttataaatattctgtttgattcataggaattgaaaataaagttggaattttacaataatttatatattttgttcaattaactaaactagattctttgatgaatgtttataaatatacgaactaaaagagaaaaatttataaccataggagccaaaaagtaagcattttttgttccataaccagttcctttaggggaccaaaaaaaa

SEQ ID NO: 5531 - DNA, 377 bp, Glycine max
atttataatgagaacacccaacaaaatttacttggtggattttgcatgcttcaagccaagccttgaatgcctgtgctccaaggaaacgttgctcgaccgggcgaaacgcgtcggtttcctctccgacgagaactacaagcttgtgaacaagattcttgaccggtccgggttgggaccgtggacgtatgtcccggagggtctcctggagatccctcccagactaacgttggaggaggcaaggaaggagacggacacggtgctcttcggggccgtcgacgagctcttggagaaaaccggtgttgaagccaaagacattgggattcttgtggtgaattgttgcttgttcaatcccacaccatctctctctgactccataa

SEQ ID NO: 5532 - DNA, 723 bp, Glycine max
cctcctcctccgccgcctccgattgcgacagcagtccttccccccacggcagtccccactccgccatcttcaccaccggtataatatttacttagataacctcttaacataattagagtttcagatcaataacttaaacagtaatctaatcatcattggaatttcacctcgacaatctaaatagttagttatcggaattagagtttgagttcgataacctttatcaggtttgcagtaaaattattatacatattatcgagataaaacacaaattctaacgagataacacttaaatttcgttcttcaatttatttcagaattgtttaatttgtattaattatgagtaaattggatttagatctcattggattgatttgtttggtgtgaatcattatgaaggtgataaccctcagacggtgaagacgaggctgaggcagtgggctcaggtagttgcttgtgcggtgcgtcaaagttcagatgtgtgattgggaagcaaatgaagaagcagggttgtcaaacgtaaaccataaaatagaagcaatgtgtgattggtattattataaatgacaacgattccccatcgaaccggaccaaaccgagagcggaccctagttaaccacccaattgtgacggaaccaaactagttagttaattagctatattacattacatgcggggctgtcggcagcgccttgttttgtactgtacttgtccaatgtgatg

SEQ ID NO: 5533 - DNA, 762 bp, Glycine max
  misc_feature (356)..(363): n is a, c, g, or t
  misc_feature (365)..(367): n is a, c, g, or t
  misc_feature (369)..(370): n is a, c, g, or t
  misc_feature (376)..(378): n is a, c, g, or t
  misc_feature (382)..(384): n is a, c, g, or t
  misc_feature (386)..(387): n is a, c, g, or t
  misc_feature (593)..(596): n is a, c, g, or t
  misc_feature (623)..(624): n is a, c, g, or t
  misc_feature (626)..(627): n is a, c, g, or t
  misc_feature (653)..(658): n is a, c, g, or t
  misc_feature (668)..(672): n is a, c, g, or t
  misc_feature (679)..(681): n is a, c, g, or t
  misc_feature (683)..(683): n is a, c, g, or t
  misc_feature (690)..(694): n is a, c, g, or t
  misc_feature (699)..(704): n is a, c, g, or t
  misc_feature (710)..(719): n is a, c, g, or t
  misc_feature (723)..(729): n is a, c, g, or t
  misc_feature (731)..(733): n is a, c, g, or t
  misc_feature (738)..(738): n is a, c, g, or t
  misc_feature (752)..(759): n is a, c, g, or t
cgcgtgcggatccagcattcctggacacatcgcgaattggcgacgcgcacgccggcggaggaggcgaggctctgggcgacgtagcccgaaaaggaaaaagttacacgaatagccataactaggaagttgattaatcggaggaagaaaaggtacagggttctttcggagacggagatttgggagaaggaaaaccctagcaagcgatcggaagcattttcgaagagggaatcagtgaagcgaagacgagagggttgaattgaagggtgaagagagaagcagagtggggaatcgccggcgatgcgacccccagaacgccggaagagagagtgccgtacagagaagaaaagacagagttnnnnnnnngnnntnnatcttnnnggtnnngnnttgttgggtttaagatttagttgaacaataatgatgacaataaggtttaaagttaagattttgtgcaaatcatcaatatcttaaaattagcttatcaaaaagtattttttatgatttctttgttataaagaattttttaggggaaaaagtgatacaacctttctctcttttttttttttcaaaaaaaaaaaaaaaaagaatgggannnnttaattttaaaaggggggaaaaaaaanntnnttggggggggggtttttcaaagggannnnnnggattaaagnnnnnttttttnnnancccgggnnnnntaccnnnnnntaaaannnnnnnnnnattnnnnnnntnnngaaanttcatttttttttnnnnnnnnaaa

SEQ ID NO: 5534 - DNA, 446 bp, Glycine max
  misc_feature (363)..(363): n is a, c, g, or t
atcaaggttcccttacccgcggtatgtattttattcttaccctcctgtcatattgaatccgtcaaagtcaaacattaatctccacgcctttcaaccttggaaccgtcgcacacaaatcttaatattttaacattcatcggaaattaattattttttttttgttatttgcagagggtattacaagtgcagtagcgtgagagggtgtccggcgaggaagcacgttgagcgagcccaggatgaccccaacatgctcatcgttacctacgagggagagcaccgtcatccgcaaccgcgtctgccggaaactgctgccggtgccggcgccggcgggacttttgccgctcatcctgtttaagcgacggnggagatcgggaaagtatggcaccgacagagatgagtgataaccgccgtttgcaattaacggggggaagttgtaaccgtatatt

SEQ ID NO: 5535 - DNA, 457 bp, Glycine max
agaagccaaggtggttttgttgggtgcacggttcagtatgtttgagatgagagttaagatagctttggcagagaaaggaatcaaatatgagtacatggaacaagatctcaccaacaagagtactttgcttcaagaaatgaacccaattcacaagaagattccagttctcatacatcatggaagacctatctgtgagtccctcataattgttgagtatattgatatggtttgggacaacaattgtcctttgcttccctctgatccctaccacaaagctcaagccaggttctgggctgattttgtagatcagaaggtagatttcataatttgagcatacgaattattatatataacatgtatgttctagaaagttattagtaacaaactaacaacttatgtgctaagaaatgcaggtgtatcatgcttctaagagagtttggatttcaaagggagaacc

SEQ ID NO: 5536 - DNA, 413 bp, Glycine max
aattggttggtcaaatttctccgcttccaaccagatgcaatgtaggagtattgacttgtaaataacaattataaacatatattcactttctcttccactttatttttaatccattttcttcatatctctttttttcccaatctcgtcacatatattacttactctcctgtctttacctttccttgtttctctctttcttccacctcaatccactcgaaaatggagagatgtttatatcattccaattgctagtggcaagaaaactactcttccaaggagtcttggatttggcgtcaatgtcaagttacgtgtaatttgattggaaaaagtacggtccccaatccccacatgcctcacttgcagaaaattaattaatcttctgccttttgaaagtcgactgagctacagtacca

SEQ ID NO: 5537 - DNA, 352 bp, Glycine max
  misc_feature (146)..(146): n is a, c, g, or t
gacacacacggcgaaatagtgcccagattctcgaacagcttctggaaacagaacgcgaagcacatgcacaggcaaataaccgggcggaggctctctctctacagttacaatctgcacaagccaaaattgattctctccatcaaganctgactaaatttcgactgaatgaaactgcattggacagtaaactaaacactgcttcccatggtaaacgaatgagggtagatgacaacattggtgatgacatggatgtaagtcccagaattgtaaagggaaccaagagaacaaggagtacatactcacaaccagaagatggtggttccatctttgagggtgctgaagaaaatcttag

SEQ ID NO: 5538 - DNA, 415 bp, Glycine max
attcctctattttttacctcactccttgactaactaactaatatcctaactgtcttaactaacttccccttccacctctcctaactcctagtagtgttgtgtctgtatggtactttgagattcatcagcagccaacagctttgtccccaactctttccttggtttaggcgaaagtcctttggctaacatctcctcatcatacttcctagccatatctatgagggccttgtccacaagagcatctatcaaggcattgtaagccgcagcatcgggactacacccaagttgcttcatcttattccacaccataaaaaccgggcgaagaaacccccacctcccaaacttgttgaggagcatgacataggtgtccatggtgggcctaaccccactctccaccatctcatcaaacatagca

SEQ ID NO: 5539 - DNA, 362 bp, Glycine max
gtagtttaatgttgggaatgagattacacaaaattggccgtaacaaatgagtatttgtcagtatgtagttcactagtaattatttgcatttggcacacacgaatttccttttaaaccacttctcagtataacttacttgtcacctaaacggccaaacctacgcaggcaatcagcaaaaccggtaacaagactggcacacttcaaggggtccttgatatgttccttgtaacatgataaggtcgcaagtctctcggccatgcaaggctcaggctttgggttaggaagcttatactctttatcatgaagatcctttgccttttgggttacttcctgcaacatattctcctcttgcttctgcaatc

SEQ ID NO: 5540 - DNA, 555 bp, Glycine max
tcattaatcaatatggcttcatgttttccaaatgcatctccatttttggtcatgctcgcaatgtgcctcttaatttccacctctgaagctgaaaaatatgtggttggaggcagtgaaaaatcctggaagtttcctctctcaaaaccagattcactcagccattgggccaactctcaccgatttaaaatcggcgacactctcagtaattactctccatattatactcctttctttatttcctatacatatatgtctcatgtttggtgtttacttagtgttggaaataaatctatgtcctacgtcgtacgtcaaccaaaaatagtgatataaaagagcttataaaactaagatacattttcatatgattacttaaaatatattttgtaatcttgactattaaaatatgacggtgtatatttactgtcattttcatttttcacgttaactacgtattttcacgagttactcctcatacaatagaataatcttaatcatccattccattttgaggtaagctgggatggagggaggaagagagggattgagagaaaaagt

SEQ ID NO: 5541 - DNA, 743 bp, Glycine max
cgaaggcatccatggtggatgatctgcagaacaaaaatcaagagctaattaaacagattgagatttgccaggtattgcaatcttgtatgattattctctctcctggtgtgtgagaatcataatatgtaacttctatctctgactttgccatcaacttcctcaggaagaaaataaaattttggacaaaatgcatagacagaaggtggcagaggttgaaaagctcacccaaactgttagagagctagaagaggctgtccttgcaggtggtgcagccgcaaatgcagtgagggattatcagcggaaagttcaagaaatgaatgtaatgtgtgaaaagtcttcagcatgttcaaactcacatttgctttattcttgattgtactgcctctagttaagatcatatttatttttgcacggtttatttgacattctttaggaggaaagaaagactctagacagggagttggctcgtgccaaggtaacagcaaacagagtagctgttgtggttgcaaatgaatggaaagatgctaatgataaagtgatgcctgtcaaacagtggcttgaagaacgtcgattcttgcaggtaatatttttttgctttactctgccaattcatctgaatttagtggttgagttcttgacttccatgactctttttgcttatatttcttcttttatattaatttcccacatttggcttcgctttccgcttattattaaattgcattcttatagggagaaatgca

SEQ ID NO: 5542 - DNA, 365 bp, Glycine max
aatttactcgggatcttgatcttccaaaggtccttaaaacagtcgtgaaggttgtcaacagctacctcctcccaaaacgaagaataagcactacgagtagagaagatacccgatgcttctgctgtccatacccaagtgtcagaaccttgagaattaatggatataccttcaacttcagagaggaaggatatggctgattctatttctctgtcaaacagctgacatctccaactaaagttccagttccacccaaggttgctatgctgccccaaggaaccaaccagctggtattgatggttggaattcacatagagccgcgggtacttttcagctaaagattggtcgtgactaatccacctatcctc

SEQ ID NO: 5543 - DNA, 404 bp, Glycine max
tatcggacactagttggagcaatacaatagcagagaaaaagttaagaggacgaatgagtgttactgagacaggtgaagcataatattgatccattacaattacggcagcatggttcatggcatccgtaagaatgaatatctgaaagcacacatttgatagaaccaagtatagacttactatttacaatagcgatcagccttcttcttgacgcgatcatcgagggcatcctcaactgacttgaagttggttttgggttgataaccgaacttcttggcttcgacagggaacagttgttcgtacttcatacgcttggccgcatcgatggtgtattcagatccctcgccctcgtcctcgaggaggggggtttcttcctgctcctgtttctgttcctgttccagttcct

SEQ ID NO: 5544 - DNA, 375 bp, Glycine max
cggcgtttcgtcgctggagcagtttccgcggctgaggaatttgcagaagctgaacctctccgacaaccggatcgccggcgggctggagtttctcgtgcaggcggggctggattcgctgcgcgacctcgatttgtcgaacaatcggattcagtacattgaggatctcgcgcccctcgcgcaggtgaagctggtctcgctggatctgtacgagtgccccgtgacgcgcgtgaaggactatcgatctagggttttcgggttgatcaagtcgttgaagtacttggacaagatggatgcggaggagaacgagaggcccgagagtgacgacgaggacgaggatgaggacgaggaggaggaggaggagttagcagaggatga

SEQ ID NO: 5545 - DNA, 383 bp, Glycine max
gcatcattcggcaaggaacgtgtgggtccagcaacgatgatgcggtgcgttttgatgctactgaaaatcttaataatcataatcatgatgacgacgaaaatgcggtaggtgagtgtgaaccagaacaacccaaaggtgacaatggagaaagtttgaaactgtttggggtttggttgaagggtcaaaatgggaaagagaattcaattggtagctgccgcaagagagggcgccaagaccctattgctgccactgccaaggaattgaagacccttgtctaggacatatcctaaggttgttaattaattaccttataatatttcaagaaacaactattatagtcagatctagaacacaaaaaagaactctctcttggtcatcatgga

SEQ ID NO: 5546 - DNA, 1151 bp, Glycine max
tttccgattttaccctccgccattccctttccaagcccaccgtctcccttcctcccactcactcactctccgtcgtcgtgttccggcggcggagatcaccctgcggcgggcggtggtgggctccgcgagcatgcgcggtggaggtgtcggagtcggagggagggaagatggtgatggagctggtgggagccttcaacgagttgacggagagaatgaacgtgctgtcgacgagctcttcgcgtcttctgtttaagtgcctcaaactctccatccccatcctgcagagctctcctctcgctcccgatggccgttcccctctctccaaagccttatccgtcgccttgctcctcgctgatctccaagttagttcatactactacttttgaaattctttctatcttcattctaaatattattactactttagcttataggatagatcatagatgtttaatttttatattattaaaattcttaattgttgacactttcttttaaaaaagaacaaactgaaattcaattcagatacagtgataaaagaaggtgtaaagattaaaaaaaaaagtttgaacttttttggctagttatggtgttgtgtgtaaaatgcatttctaaataaaggaaaagaaagaatattgaaaattgagagtaggagtggaaacccattttcaaatcatgtattctaatttataacatgattatatttaatttaagtatttccctaattttgagcatctctgatacaaaaactcaacttgcattcttaactctcttttagtatgtcccttgttgtcgagcatagaatttaagaatactcattaatttttactttaatggtagaattcaactttagtttttattttatctctccacttacacaagaattctcatttttactttaaaaattgtttttaatggttaagcaaccttgcttgtaattgattatataaacaacttctttaagaactctaaaggaatttatttgctccaatgatattctcaaattgtttaattttaagaaccaacataagcaattattaaatccgagttgctcttataattctgtccttccttttttgttgtcttgtatgggacatattattgttattttcgttgctgtttattgtttgtttatagtaaatgtgaatgca

SEQ ID NO: 5547 - DNA, 820 bp, Glycine max
tgctaaatactaaagccccgggtccatgggggaacagaattaccttcttgcatgttccaataccgaaattaaatgaaacaagaactacaaaccctcttgaatttatttgggacacacataacataatcaagaggaagaaacaatctctaggagttgtactcaccgggacacttttgaagatagagggcaaattgaggggacaagaggtaaatttgtatatttggttaaattgaatttgatcataatgttgttaattatatgttttttcctaccaataatttgcgagtgcttcttaaagtaacgaagaatataattaagcacttaatttgttgctacaattgttaagttagttgttttaatttgttgcaggcagtagctaaacgcattcgtggcacattgacaaaatcaagtgcagtgatttcaaacttggctggaccaatacaacaaatggctttagctaaccatcctgtgaaaggcttgtatttcacattggccggtggacctgaagtatgtattctgaatccctttcatttttcaattaatcatcaattcaacatgtgagaatctgaattgaggtgggtggggtgaaataaggcaaaaaaaaaattataatcaatttataatagcgaaaattggaatggtcattttaagaaggctttaatttctaatttattttgcttaaggaaaaaagtttttaacccaacagatctctctttgttcctttacttaactagttgcagtgatacataagaaatatttaaacatcatttgattgtatttgcagagtctagtcatttcagttatgagctatatgggagtc

SEQ ID NO: 5548 - DNA, 1110 bp, Glycine max
ctgcggcggcgccaccacccccatccacggccactctccgcctcgttctccgcccagagcgcggcggcggagacccaggaccgagtcgagaactcgaagaaccgagtcaccgaacgagtcatcacgccaaggtcacaggacttcaacgcgtggtacctcgatatcatagccaatgccgagttggccgattacggtccggttcgcggcaccatggtcattcgtccctacggttacgccatttgggaagccattcaggttccttctcaatttctcgccacgtgtcccttttcttttcaatttatgtcatttttattttatttgtttctgtgtgtgcaggagtatttgaatgtgaagttcaaggagactggacatagtaacatgtattttccgcaggtaaaagttaactaccatagtcaattaattattatttaccgtgattagggtgtgtttggttacagttaaacagtttaattaaggacgggacaattttgccaaaagttttcaataaatatttataagaagaaaataagaaggtaaaattaagctctttccgtgagttaaaattaacttgtgcataatttaaaaccagcttttggagaacctaaaatgagagagtttctatcatagttgggctatataagttgatttaaacttatataaggttggttgttttactttcatattttcttcatctataagtgcttactgaataatttatccaaagactgcctaaattaagttgtttaccccaatgtgtcctatgcccctttcgcgagttcaaataaactctgttgaagctcttttaaatgattccttagtgatatatttgtctaaaatttatgcaagtatttctatggtagcattaatagttgagagaatgattgcgaaggggttggagttggaatgtttattaccattgcatgccgatgttatatttagtgtcaaaaagtgatggttgtgcaaagtcaaatcttgataatgatggggtatataagattatgtccacaacatgaaattattgttctatcatatgtttgatgcctttttttaatctgttctgcagtttatcccatactcatttatagagaaagaagcaagtcatgtgagggt

SEQ ID NO: 5549 - DNA, 364 bp, Glycine max
ctttcagagtgctattaatccaccaggtggcattaggccagcaagtgaaactggagaaatcacatgtccagatacaagcaaaaacattacggttccatgccctggagaagctgtcctatctgttcttaaagcagacacctacaacagcttcctttattgtaacacaatatgttttgcttcatctttagctgtttgtctcttgcttgtgagtggactccctcttaataaccgattcttcatctggttcttctcaatatgcatgtgcatcaccctcactgccctcacccttacctacttatatggtttgcaaatggtcaccccaaacgacgtttgggataattcattattcagcatggttggagtc

SEQ ID NO: 5550 - DNA, 389 bp, Glycine max
tttaaaattgagcttaacagacaaaataattgaaaaacagacctcggttttcttttcattggatcaaatatttaccattttcatagacaaaattttgtattatgaatcaaatagatacataaggtaaaggccaaagggatgcatgccatgacaaaaaggctacaaaggtagtattgaatcttcataaaccttgcagcacaatgatgaatgcaattagaatagtccacacactaaaaccttgaagtattgggaccccaacagctcaagtccatgactttcctcatggactcctccttggtcctcttgaccttattggagacagcagcagaagtagcagaagacaaggttttggcctgagtgtaggatctaatgttgctcttggcatgcta

SEQ ID NO: 5551 - DNA, 1243 bp, Glycine max
  misc_feature (400)..(444): n is a, c, g, or t
  misc_feature (450)..(458): n is a, c, g, or t
  misc_feature (463)..(477): n is a, c, g, or t
  misc_feature (484)..(486): n is a, c, g, or t
  misc_feature (488)..(490): n is a, c, g, or t
  misc_feature (493)..(496): n is a, c, g, or t
  misc_feature (499)..(508): n is a, c, g, or t
  misc_feature (512)..(513): n is a, c, g, or t
  misc_feature (516)..(516): n is a, c, g, or t
  misc_feature (519)..(525): n is a, c, g, or t
  misc_feature (527)..(531): n is a, c, g, or t
  misc_feature (533)..(541): n is a, c, g, or t
  misc_feature (544)..(546): n is a, c, g, or t
  misc_feature (549)..(554): n is a, c, g, or t
  misc_feature (556)..(557): n is a, c, g, or t
  misc_feature (562)..(563): n is a, c, g, or t
  misc_feature (566)..(566): n is a, c, g, or t
  misc_feature (571)..(571): n is a, c, g, or t
  misc_feature (574)..(580): n is a, c, g, or t
  misc_feature (583)..(585): n is a, c, g, or t
  misc_feature (590)..(594): n is a, c, g, or t
  misc_feature (598)..(608): n is a, c, g, or t
  misc_feature (613)..(621): n is a, c, g, or t
  misc_feature (623)..(632): n is a, c, g, or t
  misc_feature (641)..(646): n is a, c, g, or t
  misc_feature (650)..(652): n is a, c, g, or t
  misc_feature (656)..(656): n is a, c, g, or t
  misc_feature (658)..(659): n is a, c, g, or t
  misc_feature (661)..(669): n is a, c, g, or t
  misc_feature (674)..(677): n is a, c, g, or t
  misc_feature (679)..(695): n is a, c, g, or t
  misc_feature (697)..(700): n is a, c, g, or t
  misc_feature (703)..(708): n is a, c, g, or t
  misc_feature (710)..(711): n is a, c, g, or t
  misc_feature (715)..(720): n is a, c, g, or t
  misc_feature (728)..(734): n is a, c, g, or t
  misc_feature (736)..(752): n is a, c, g, or t
  misc_feature (754)..(758): n is a, c, g, or t
  misc_feature (762)..(768): n is a, c, g, or t
  misc_feature (772)..(774): n is a, c, g, or t
  misc_feature (776)..(781): n is a, c, g, or t
  misc_feature (786)..(789): n is a, c, g, or t
  misc_feature (793)..(793): n is a, c, g, or t
  misc_feature (795)..(798): n is a, c, g, or t
  misc_feature (800)..(803): n is a, c, g, or t
  misc_feature (806)..(816): n is a, c, g, or t
  misc_feature (820)..(825): n is a, c, g, or t
  misc_feature (827)..(835): n is a, c, g, or t
  misc_feature (837)..(837): n is a, c, g, or t
  misc_feature (843)..(847): n is a, c, g, or t
  misc_feature (849)..(853): n is a, c, g, or t
  misc_feature (855)..(859): n is a, c, g, or t
  misc_feature (862)..(874): n is a, c, g, or t
  misc_feature (876)..(880): n is a, c, g, or t
  misc_feature (882)..(892): n is a, c, g, or t
  misc_feature (894)..(903): n is a, c, g, or t
  misc_feature (906)..(913): n is a, c, g, or t
  misc_feature (915)..(920): n is a, c, g, or t
  misc_feature (924)..(924): n is a, c, g, or t
  misc_feature (929)..(929): n is a, c, g, or t
  misc_feature (932)..(940): n is a, c, g, or t
  misc_feature (943)..(950): n is a, c, g, or t
  misc_feature (952)..(955): n is a, c, g, or t
  misc_feature (959)..(960): n is a, c, g, or t
  misc_feature (962)..(965): n is a, c, g, or t
  misc_feature (969)..(970): n is a, c, g, or t
  misc_feature (972)..(972): n is a, c, g, or t
  misc_feature (974)..(977): n is a, c, g, or t
  misc_feature (979)..(979): n is a, c, g, or t
  misc_feature (981)..(991): n is a, c, g, or t
  misc_feature (993)..(1002): n is a, c, g, or t
  misc_feature (1006)..(1017): n is a, c, g, or t
  misc_feature (1019)..(1019): n is a, c, g, or t
  misc_feature (1021)..(1023): n is a, c, g, or t
  misc_feature (1025)..(1031): n is a, c, g, or t
  misc_feature (1039)..(1042): n is a, c, g, or t
  misc_feature (1044)..(1047): n is a, c, g, or t
  misc_feature (1055)..(1064): n is a, c, g, or t
  misc_feature (1068)..(1078): n is a, c, g, or t
  misc_feature (1080)..(1080): n is a, c, g, or t
  misc_feature (1087)..(1091): n is a, c, g, or t
  misc_feature (1094)..(1099): n is a, c, g, or t
  misc_feature (1103)..(1106): n is a, c, g, or t
  misc_feature (1108)..(1113): n is a, c, g, or t
  misc_feature (1118)..(1121): n is a, c, g, or t
  misc_feature (1123)..(1125): n is a, c, g, or t
  misc_feature (1127)..(1127): n is a, c, g, or t
  misc_feature (1134)..(1137): n is a, c, g, or t
  misc_feature (1139)..(1140): n is a, c, g, or t
  misc_feature (1144)..(1151): n is a, c, g, or t
  misc_feature (1156)..(1159): n is a, c, g, or t
  misc_feature (1161)..(1164): n is a, c, g, or t
  misc_feature (1168)..(1168): n is a, c, g, or t
  misc_feature (1171)..(1171): n is a, c, g, or t
  misc_feature (1175)..(1178): n is a, c, g, or t
  misc_feature (1180)..(1185): n is a, c, g, or t
  misc_feature (1187)..(1188): n is a, c, g, or t
  misc_feature (1191)..(1191): n is a, c, g, or t
  misc_feature (1196)..(1203): n is a, c, g, or t
  misc_feature (1206)..(1218): n is a, c, g, or t
  misc_feature (1220)..(1220): n is a, c, g, or t
  misc_feature (1225)..(1228): n is a, c, g, or t
  misc_feature (1230)..(1236): n is a, c, g, or t
cgttccgatatgcttgaagttgataaggaagttgtcaagagcaacgagaaactagagaacattgacctctctctattgcttagacctgcagctgaactgcggccagaagcttctcaatactgtgtgcaaaaacaggatcatggtttggatatggccttggataataagctcataagtctgtctagtgctgctttggaaaaaggtcttccagtatacattgaaactccaatatataatgtaaaccgtgctgtgggaactatgcttagccatgaggtgactaaactgtaccacctagctggtcttccaaatgacaccatccatattagatttactggcagtgcaggccagagctttggtgcattcctctgtcctggtatcactttggaacttgaaaaaaaannnnnnnnnnnnnnnnnnnnnnnnnnnnnnnnnnnnnnnnnnnnngggggnnnnnnnnnccccnnnnnnnnnnnnnnntgacccnnnannngcnnnnccnnnnnnnnnnactnncancannnnnnncnnnnnannnnnnnnncannnccnnnnnnannacatnncantacanctnnnnnnnccnnnctcannnnncctnnnnnnnnnnntctannnnnnnnncnnnnnnnnnncctcccctnnnnnncccnnncacncnntnnnnnnnnnttccnnnnannnnnnnnnnnnnnnnnannnnacnnnnnncnnatannnnnnctattccnnnnnnncnnnnnnnnnnnnnnnnncnnnnntacnnnnnnntacnnntnnnnnntcacnnnncttntnnnncnnnnaannnnnnnnnnncctnnnnnncnnnnnnnnncncacccnnnnncnnnnncnnnnnccnnnnnnnnnnnnnannnnncnnnnnnnnnnntnnnnnnnnnntcnnnnnnnntnnnnnncccntctcncgnnnnnnnnnatnnnnnnnncnnnncccnncnnnnctgnncncnnnncnannnnnnnnnnncnnnnnnnnnnatcnnnnnnnnnnnntntnnncnnnnnnncacatccnnnncnnnntttactcnnnnnnnnnncatnnnnnnnnnnnanaaacaannnnnttnnnnnnaccnnnnannnnnntttcnnnnannntnactcacnnnncnnactnnnnnnnnctttnnnntnnnnctanatntcannnntnnnnnncnnccntctannnnnnnnacnnnnnnnnnnnnncntatcnnnntnnnnnnntcttcac

SEQ ID NO: 5552 - DNA, 1254 bp, Glycine max
  misc_feature (1160)..(1161): n is a, c, g, or t
  misc_feature (1213)..(1215): n is a, c, g, or t
  misc_feature (1241)..(1241): n is a, c, g, or t
tgagcttcccaattaccggtttgatttcctttattcactctttaaaattgacaataactgagaaatgggaccaaggagataaagctgaatcttcaaaaataatatgcacagtgtgcaataaagaaataaaaaccaataaccgataaggaacagcaacaaaaatgaaaaacaaaatgagatgtgttgttagagaaagccaaaaggtgctactggtccacctggctaattgcaagtgacatgcagcacaacataattttatttggagaaaacaaaagagaagctatcgaagattatttgctaaatctttttgtgcgtattatgcatcaaccaaggagcaatgaagtgcatgaatcactaagaaagggcattataaagttatcgcatggttacataattaaatataacaatttgcaaactgtttgaactccttataacctaaacttgtgtccaggttgcaaaacataattgtttatgtttaatcaagatctgatgaaatgtgaaattagtaatcttttttatctgaagaaagtagaattgataataatgttcttgtgtcccatgtactttcagtttcctccagcatttgtgttttgacttttgaacagtttgcatactttatatatcagccctgttgtttagcttgtgttacttttttggtaggggtggcattgttttctgggcagacttggttggggccaatcatatatataccagcctaaaaaaatgggcacaattatatggtaacttctataaaccctcaaggtatttggaagaaagagcactcaaaggcattcccttggtaagttgcatgttctttattttttaatcaaataaatttcatgaaattcagatttaattatgtgtatgatttaatcatattgattattcaaacacgtttaggggtacatgggaaagtttcaacaatttaaattaagcactagcttgcaagtggggtacttttgtagggatcaaaatactagttattatgtactgtctttcttatcatataaacaagatcaagtgcttgacgttgttgtatattttgtattggttgcagagtgcacctgcttcatctactccaaagtcaatggcacgtctatgagaaagccaagtgttgagcatatatgttggatgttctacaatagaaaatgtaacaaccnnatgtttgcttccttcctagattaaagaataaattattaaatttggtttcacnnnagagaaaaatcgaaggaaaataatgnttcttggggtgac

SEQ ID NO: 5553 - DNA, 433 bp, Glycine max
  misc_feature (425)..(428): n is a, c, g, or t
aaccaacattagctctgacgacatctatgcaaaaaaaatctcaatagtaacaaactgctagctaattgcacatctgtttgctttcttgtgatctacaagataaacttacaacattttgcctataatttccccaatggcaacactaaatcagaagtctgatatttgcaagccataggccacaaaatagatcaaatacaattcaatcacattatatttacacatttgttatagtctactctacaccataccgtcaatcatcactttcactgatagaaaatatcaaacccttccttcatttgagatttgtcctgcagtagttttctatccttaaatctgcagaaagaaagtgcaggatcatgcttagtgaacccttctcagttctcatcacaaattactacaataaaacaagtacaagtccaaatatnnnnccctg

SEQ ID NO: 5554 - DNA, 494 bp, Glycine max
cggacaccggcagatattgaaaaaccaaatactgcagctccagaagtttcctctacaggcactggagaaaagccttcaatctcaagatcattgtctcttactaagatatttactcctaggattaagagagcgtcgtcattaccactagatgaaattagacaatcaaacaatgaatcttctcaaggtggaagtgttggtggtcccttaaatgtgagatttagcaatgcttttaaattccctttttctagagttgcatcatttgctgctgaatcttacatcataaaataaaaaataaaaataaaaacctctgttttaattcattttgcagaaaagagaagcacagcggaagatagctcgctctctttcagtacctgccaatgacaaagataaaagcctaaggaggatggattcatttttccgtgttgttccttccactcctcaagtaaaggaaggaaatgaattgttggccacacccacaacaaatgacactgaat

SEQ ID NO: 5555 - DNA, 374 bp, Glycine max
gccgtgatacatcatgtattttctagcacgcagatgcaggtttgcaactccaatgtaagttgacagaccgactaaaagtgatatacaaatttatcatcaagttgctaccttacaatatgaaaaataaaaaatgaatttgagcattacaccatgatctgtggtatgtgctgactgactcaccagcatactctaatcgctggaaaccttacctacatgtgtctacgtctagcgaatcatacaagtggatagctagtagaggaaaccatccattttactctcagttagcagtatatgtacacgaacagatatcaagccatacataagtatggcttgcaactcttgcctgaattagcaatcaatgagagcatgaactc

SEQ ID NO: 5556 - DNA, 396 bp, Glycine max
tgtgcaagcaatttggagaccatggcttccaagagagtacaacaattggggtatattattttattttattgttttttttatatatatatatttttatcttggtgagaaatcaaagtagttcgtgcagcagcatggcccttaaggtatgtatggttagttgtaaagagtggccatagttaataaatcaatgttgctagtattcagaggaaattcaaaatccaacctatatgatatttctgttaaggcaatcaatttcgcttgtatcattgtgtgcagaatatttatgctgtgttgcagaacatctgtttcgttgttttatatgatgtttggctgagaaagtgtgcaacaactgcatacatattcttttagatctaagcaagagtttccctcgtgagg

SEQ ID NO: 5557 - DNA, 1055 bp, Glycine max
  misc_feature (1048)..(1050): n is a, c, g, or t
ggttcatatacatcagctgctgtagctctaaggctcctgcaacttgatgcatgtatcttttacacctcacagcagaagctggagtctgagaaggataagaaaattggaattgtgatggtgagtattcttccttttcctactttgattgtgaactattgtgaaaatgttaaaagggtttgaggaaaataaacaaatataacgttgttgtgctcatacatcatttaaaatgaaaaaaatttgaaaggccttccaaaagcccttaggtgaggggggtgaggataaagaaaatgacttaagaaggttgcactcctctcagaagggtacagtggtacactactactaatgtactaggtttgggaatatgtttttgtgcagtccaatcattttgactttgacccaacacaatctgatctttacccaaataataggccagtttaagactttggaccatcctcctatttaaaattatggcaaggggaacatggttggtgaatggaggaaaaataactgaatgtagtattaaaaaactgattcaaaagaaaaagacaactttaaacttattatctgttcacttgatggaacttttgtaatattctgtgaaattatggtaggacaatgttcagtttagcaaaataaagagtgtagggtgtgttatatcattctttttttagagcaaggagaggaatctgaatttcagtaggtttgccttgcaaatggatttctctagcatgacaacacttgtaatctttgtatgcttctataagaaatttaagaaaagaagacaataatttggctgcaattttgtgggaatcagcctatcataatttgcatatgtatttttagtttgaagtttgaatttccctgactttttgtttctcacttcagaagcttccatcaaaacatgcttctgccagaaaatcttacaatgctggtgcaattgaaacttcacatcaggctgaacgtgctgtagagaactgggttgatcttggagctggtcatacgagctgcagcagaggacaaaggacccaacagggccggccgttctcannngaaga

SEQ ID NO: 5558 - DNA, 761 bp, Glycine max
  misc_feature (413)..(413): n is a, c, g, or t
  misc_feature (415)..(416): n is a, c, g, or t
  misc_feature (418)..(419): n is a, c, g, or t
  misc_feature (654)..(669): n is a, c, g, or t
  misc_feature (673)..(676): n is a, c, g, or t
  misc_feature (678)..(679): n is a, c, g, or t
  misc_feature (690)..(694): n is a, c, g, or t
  misc_feature (696)..(698): n is a, c, g, or t
  misc_feature (700)..(705): n is a, c, g, or t
  misc_feature (709)..(714): n is a, c, g, or t
  misc_feature (716)..(718): n is a, c, g, or t
  misc_feature (720)..(720): n is a, c, g, or t
  misc_feature (722)..(739): n is a, c, g, or t
  misc_feature (746)..(754): n is a, c, g, or t
tggggttgggcttttgcgagtcccatgagggctttcagcggtaaaccttcttctaaagagagtaaccgaagggatattattagaggtgccagtgataagaatgccacgccaaatttatctgctataccttccttgcttgctgtcagaggctgagaactgagaagaacacaaggagcaaagaagaaaaagaaaaaccattcgagggctttaacttggtctattatacacattagtactatgatgttaattactgtttattactattattactactttgtttatcatgtggatgggttttaatttaattttcttcattagtaatctaatactttcaagttcattccttttattctctataccgctttgtgaattatgatcagctatgggcaattctctgggaaatcagaatccananngnnggggtatagagaataaaaggaatgaacttgaaagtattagattactaatgaagaaaattaaattaaaacccatccacatgataaacaaagtagtaataatagtaataaacagtaattaacatcatagtactaatgtgtataatagaccaagttaaagccctcgaatggtttttctttttcttctttgctccttgtgttcttctcagttctcagcctctgacagcaagcaaggaannnnnnnnnnnnnnnnttgnnnngnnattcttatcannnnngnnncnnnnnnaatnnnnnncnnnantnnnnnnnnnnnnnnnnnntacctcnnnnnnnnntcccccc

SEQ ID NO: 5559 - DNA, 1469 bp, Glycine max
  misc_feature (727)..(728): n is a, c, g, or t
  misc_feature (742)..(746): n is a, c, g, or t
  misc_feature (750)..(754): n is a, c, g, or t
  misc_feature (757)..(763): n is a, c, g, or t
  misc_feature (765)..(774): n is a, c, g, or t
  misc_feature (778)..(795): n is a, c, g, or t
  misc_feature (797)..(797): n is a, c, g, or t
  misc_feature (799)..(802): n is a, c, g, or t
  misc_feature (807)..(813): n is a, c, g, or t
  misc_feature (816)..(816): n is a, c, g, or t
  misc_feature (818)..(820): n is a, c, g, or t
  misc_feature (823)..(824): n is a, c, g, or t
  misc_feature (833)..(838): n is a, c, g, or t
  misc_feature (840)..(840): n is a, c, g, or t
  misc_feature (842)..(844): n is a, c, g, or t
  misc_feature (846)..(849): n is a, c, g, or t
  misc_feature (852)..(858): n is a, c, g, or t
  misc_feature (864)..(873): n is a, c, g, or t
  misc_feature (877)..(890): n is a, c, g, or t
  misc_feature (894)..(894): n is a, c, g, or t
  misc_feature (896)..(896): n is a, c, g, or t
  misc_feature (900)..(903): n is a, c, g, or t
  misc_feature (907)..(926): n is a, c, g, or t
  misc_feature (934)..(937): n is a, c, g, or t
  misc_feature (939)..(943): n is a, c, g, or t
  misc_feature (947)..(948): n is a, c, g, or t
  misc_feature (950)..(958): n is a, c, g, or t
  misc_feature (965)..(973): n is a, c, g, or t
  misc_feature (977)..(977): n is a, c, g, or t
  misc_feature (979)..(979): n is a, c, g, or t
  misc_feature (983)..(991): n is a, c, g, or t
  misc_feature (998)..(1012): n is a, c, g, or t
  misc_feature (1017)..(1022): n is a, c, g, or t
  misc_feature (1024)..(1024): n is a, c, g, or t
  misc_feature (1028)..(1036): n is a, c, g, or t
  misc_feature (1042)..(1050): n is a, c, g, or t
  misc_feature (1052)..(1056): n is a, c, g, or t
  misc_feature (1061)..(1065): n is a, c, g, or t
  misc_feature (1067)..(1068): n is a, c, g, or t
  misc_feature (1071)..(1075): n is a, c, g, or t
  misc_feature (1078)..(1091): n is a, c, g, or t
  misc_feature (1094)..(1095): n is a, c, g, or t
  misc_feature (1099)..(1100): n is a, c, g, or t
  misc_feature (1102)..(1110): n is a, c, g, or t
  misc_feature (1115)..(1122): n is a, c, g, or t
  misc_feature (1130)..(1134): n is a, c, g, or t
  misc_feature (1136)..(1142): n is a, c, g, or t
  misc_feature (1144)..(1144): n is a, c, g, or t
  misc_feature (1150)..(1151): n is a, c, g, or t
  misc_feature (1153)..(1153): n is a, c, g, or t
  misc_feature (1157)..(1157): n is a, c, g, or t
  misc_feature (1159)..(1159): n is a, c, g, or t
  misc_feature (1162)..(1167): n is a, c, g, or t
  misc_feature (1176)..(1183): n is a, c, g, or t
  misc_feature (1185)..(1185): n is a, c, g, or t
  misc_feature (1187)..(1192): n is a, c, g, or t
  misc_feature (1194)..(1199): n is a, c, g, or t
  misc_feature (1201)..(1206): n is a, c, g, or t
  misc_feature (1209)..(1216): n is a, c, g, or t
  misc_feature (1218)..(1234): n is a, c, g, or t
  misc_feature (1238)..(1238): n is a, c, g, or t
  misc_feature (1243)..(1250): n is a, c, g, or t
  misc_feature (1252)..(1252): n is a, c, g, or t
  misc_feature (1254)..(1254): n is a, c, g, or t
  misc_feature (1257)..(1260): n is a, c, g, or t
  misc_feature (1262)..(1263): n is a, c, g, or t
  misc_feature (1265)..(1265): n is a, c, g, or t
  misc_feature (1267)..(1272): n is a, c, g, or t
  misc_feature (1274)..(1283): n is a, c, g, or t
  misc_feature (1285)..(1286): n is a, c, g, or t
  misc_feature (1289)..(1291): n is a, c, g, or t
  misc_feature (1293)..(1308): n is a, c, g, or t
  misc_feature (1310)..(1310): n is a, c, g, or t
  misc_feature (1312)..(1312): n is a, c, g, or t
  misc_feature (1314)..(1331): n is a, c, g, or t
  misc_feature (1334)..(1347): n is a, c, g, or t
  misc_feature (1350)..(1357): n is a, c, g, or t
  misc_feature (1359)..(1365): n is a, c, g, or t
  misc_feature (1368)..(1369): n is a, c, g, or t
  misc_feature (1371)..(1372): n is a, c, g, or t
  misc_feature (1376)..(1394): n is a, c, g, or t
  misc_feature (1397)..(1406): n is a, c, g, or t
  misc_feature (1408)..(1419): n is a, c, g, or t
  misc_feature (1424)..(1427): n is a, c, g, or t
  misc_feature (1432)..(1440): n is a, c, g, or t
  misc_feature (1442)..(1465): n is a, c, g, or t
gcaagtctttcgaatcgttaagtgatgtcaagaaatatttcaagcccctagcattgagcttcaaaaaaatcatgaatttgcagatgcacctaccaccagaatcttaccttattatcactgtgagcaccttttaagactgaacaactctgcctctagttaaggaaacaaatgaaattgtctaacatgctgtcctttaccagaaacatggcaatgtctgcttggggattctagatggcactgaagtaggactagaaaatctgaacataataggaggtaaggcatgccaatttaaaagagtataaaaaattcctttctcttatttgattattgttggaaatcaggaataaatgtcatttattaaatgtcatttattataaatgacatttattcctgattctcaacaatttttttgatggtaatatgccttttattgctctcagacatcactttacaagataaaatggtgatttatgacaacgagaaacagcagattggatgggtttcttcaaattgtgataggcttcccaagtaatatatttctcttatcatttcttatataactgtgaacgccaattagtcttacaagggaatattttcatgttcattcaaacagtgtggatcgtgatttggaaggtgattttccacacccatatgcaacaaatttgggtatctttggggacccgttgccctgcatcatatgaagaaacaggctgtgaatgaattgctnnggaaggagactctnnnnncatnnnnnctnnnnnnncnnnnnnnnnncccnnnnnnnnnnnnnnnnnnancnnnncaccnnnnnnnccncnnnccnnccccttcannnnnncncnnncnnnntcnnnnnnncccccnnnnnnnnnntccnnnnnnnnnnnnnncctncncctnnnncacnnnnnnnnnnnnnnnnnnnncccccctnnnnannnnntctnncnnnnnnnnncccctcnnnnnnnnntccngncccnnnnnnnnntcccctnnnnnnnnnnnnnnnctacnnnnnncncccnnnnnnnnntcaccnnnnnnnnncnnnnnctcannnnncnnccnnnnnacnnnnnnnnnnnnnnccnncctnncnnnnnnnnnccccnnnnnnnntctccccnnnnncnnnnnnncncacccnnantctncnatnnnnnnccccccccnnnnnnnncncnnnnnncnnnnnncnnnnnnccnnnnnnnncnnnnnnnnnnnnnnnnncccnactcnnnnnnnncncnccnnnncnncncnnnnnncnnnnnnnnnntnnccnnntnnnnnnnnnnnnnnnnancntnnnnnnnnnnnnnnnnnnctnnnnnnnnnnnnnntannnnnnnncnnnnnnnctnncnnattnnnnnnnnnnnnnnnnnnnttnnnnnnnnnncnnnnnnnnnnnnacaannnntttcnnnnnnnnncnnnnnnnnnnnnnnnnnnnnnnnncata

SEQ ID NO: 5560 - DNA, 278 bp, Glycine max
ttttcaaattccaccttatataggtagtttattaacaatttaacttattgttctgtacattactttgtgttttccaaactctaccttcctctacttttgcacttttgatacctactatactgtaaatttataacgtaaattttttaaaatgctattttttaaatcacagttatggacaatacaaaagattgcgttatgaaattgacaagcatgaaggcggtctggatacattttcacgtggttatgaaaaatttggcttccaacgcaggtattatttc

SEQ ID NO: 5561 - DNA, 1136 bp, Glycine max
ggagcattttccccgtacggaagggacttttccaaccaagttcctacagggagatttaccaatgggaggcttgccactgattacattggtaattaattatcaacttataagcttgctttctttgatatgtatataaacttataacttacattgagtaaatttgtgatgtgtttaaaatgcactgcagcttcatacgtaggtctcaagaaagatgttcttccaccttatttggacccaaacctcagaattgaggagctgatgacaggagtcagttttgcctccgctggttctggctttgacccacttacaccaagcatgacagtaatatctcacttactttctttcttaacttctttgtgttgtagacttgtagtgctggtccaaaaacagtctctttcaccattagttttctcctactttatgcatctagtcatatttactgggacatatatttgggcacccattatcttattgtacacctagtgatcatcaagaaagagaaaaacttatagataggatatatgtgatatcatgaagtgataggaaaaaaaataaagaaaaatgataggtgttaattaagtgttcaaatatcataattctatttactatgacaaagaaggttgtaatatttaataaattttaattaataataaaaaatatatccaaaaaaagtgtagcacaaaagatttatgacacctcaatattattttacatcacgaggaataaagagagaagataaaaaaaaattaggtaataagttttttttgcacagtaaaaaatattatattaacaaaaacagtttgccacaagggatgacaaattatagcaagttacagagcaaatgcctgcaataggtgttaatgatatataggtgtcaaactatagcaagttacagagcaaatgaaaaaagcctgcaataggtgttaatgatatatatgtgtaatgtatatatcattcctcaagtgtattaccttttcctatgatttaccaaagtggagatcaaactgatgcatacaatttaatgagaaattctctatttatttcagaacgtaattccaatagaaaagcagttggagtatcttagagaatgcagaaagaggttggaggatgcattgggtaagcgaagaatgaaaatc

SEQ ID NO: 5562 - DNA, 396 bp, Glycine max
acattaagtggatggaaaatcaactgttgagaaaggagtgataagttaatgtgtcttgcaggtttgggatttgtatgagagtggagaggtagaaaaactggtggatgcttttctagaaggagacttcaatattgaggaggcaatcagattttgtaagattggtctcctttgcacgcaggattctcctcagctccggccttcaatgtccagtgtgcttgagatgcttttaggtgaaaaagatgtgaatgaggagaatgtgacaaaaccaggcatgatatttgaatttgtggaagccaaaagtgcagggaaacaaaaaggcaaggcagaagtggatagtaaatcttcgttggctgaagggaagcaagacgagtcatcttcatcaggaaccatgagctc

SEQ ID NO: 5563 - DNA, 669 bp, Glycine max
  misc_feature (474)..(475): n is a, c, g, or t
  misc_feature (483)..(485): n is a, c, g, or t
  misc_feature (494)..(496): n is a, c, g, or t
  misc_feature (513)..(513): n is a, c, g, or t
  misc_feature (517)..(519): n is a, c, g, or t
  misc_feature (521)..(521): n is a, c, g, or t
  misc_feature (525)..(525): n is a, c, g, or t
  misc_feature (528)..(530): n is a, c, g, or t
  misc_feature (540)..(542): n is a, c, g, or t
  misc_feature (546)..(550): n is a, c, g, or t
  misc_feature (552)..(553): n is a, c, g, or t
  misc_feature (558)..(561): n is a, c, g, or t
  misc_feature (569)..(570): n is a, c, g, or t
  misc_feature (572)..(579): n is a, c, g, or t
  misc_feature (588)..(596): n is a, c, g, or t
  misc_feature (600)..(606): n is a, c, g, or t
  misc_feature (610)..(613): n is a, c, g, or t
  misc_feature (618)..(638): n is a, c, g, or t
  misc_feature (640)..(640): n is a, c, g, or t
  misc_feature (645)..(652): n is a, c, g, or t
  misc_feature (654)..(654): n is a, c, g, or t
  misc_feature (663)..(666): n is a, c, g, or t
acaccagcagcggtggcggcggcaccggcacccaaacattcaagccgtaccgtcacctgaaaaccctaaaagaccacgagaacgcggtatcgtgcgtgaagttctcgaacgacggaaccctcctagcctcggcctccctggacaaaaccctaatcatatggtcctccgccaccctcaccctctgccaccgcctcgtgggccactccgagggcatctccgacctggcctggtcctccgactcccactacatctgctccgcctccgacgaccacaccctccgcatctgggacgccaccggcggcgactgcgtcaagatcctccgcggccacgacgacgtcgttttctgcgtaaacttcaacccccagtccagctacattgtctcgaacacaacaataaagcaatatcagtttctaatttagttagattttcatttttatgtgatattaatccttcttgcttgtgcagctattgtgnngggtggcnnnggcactgcnnnagacaaaattaaaaccnctcnnngnaagntgnnntcacagtttnnngagnnnnntnnccaannnnggagctgnnannnnnnnntgtttttcnnnnnnnnnggcnnnnnnnaatnnnntgggnnnnnnnnnnnnnnnnnnnnntngggtnnnnnnnntntacatgccnnnnaat

SEQ ID NO: 5564 - DNA, 716 bp, Glycine max
cttttccttcgctgattgaagattctcccagagcaatctacagagtaatataaaccatagttaattaaaacaaccatttgtaggactaaaagtagccaacaaagactcaaaataaaccagcaaagtgatattttgtgttttacatcagcacaaccaattttcctaaagtctgtttggataatcttctcagtaaacacttaaaggaaaagaaaataacaaagtaaaataaattaaatgtatcccataaaattaaaattatctcattcataagttcaaattagcttttgaagaagctaaatgagagaatttctataaattggtttctacataagctaattttccttgtataagatcacaagtatcctgcattgaagataatcctactcaagccaagtagaaccactaaggacagaaaaactctccatatatttaacacaactacttacgaaggacttgaacatgagaccactactagttaggccaaacaacccatgtcagttgttccatgcctcactggtgtataagctaactttaacttacaagtgaaacttatttaattttacattttttcttcttcttgtaagtgtttatacagaagttcatctaaacagggcttaactaacaaacaccaaggagatataaggttgggtgggtggttaagaaagaagggaaatcccatcaacaaaaaactaacgattaacatttcccgataaaaa

SEQ ID NO: 5565 - DNA, 313 bp, Glycine max
tcaacttctgttgtacaaaatactggtgctgaggtatctgctaccgaaacaaatgtaattggaaaatcaatcgtccatgaatctacaagaagagtagacagtggatctcttaataaagcttcaactgtttcaagtttggattctgaggatgagtcccagtctgcaaatctgaaacatagttcaaaggaagtccaagtggaggatgaagtgaataatgagatatctttgagcaaaggagctcacagtgcttatgttatgcaatcatctcttcagtctgggcaagaggaatcccaacttactttccgcagcattt

SEQ ID NO: 5566 - DNA, 904 bp, Glycine max
tggttcttgcataccaaacatagagaacaggggtagtttaacaaaagcatgcataagcaaaatggttcttctgagacacatagggagaaatgtaatcagaggctgaagctgatggacttgatatttcagcaggaacaagtatctggtttttccctgatacaattctcatcccagcaacattagcatagaagaggccaggaatagagggcacaaagacctcactttgagaacatatgtagaaatcaatgaccttctcaaattcagagctttgtgagctgagagactttcccttcttgtcttctgccattacagtttcctgttgaaggaaaaagatatacaaacattcagcagtgaaaaagtgaactttgaagggagaaaattaagtgtgtttgtaaaattaattttaaaatgaaattgattttgaaataatgatttatgccgatgtgttttattctaaaaacaactaagtagtgaaactcaatatgaaattttttatctaatgcaaatgttgcttaaaattgtcttaactcaattaattttgaacttagaatcaatttctcaacctagaactaaacaagtaatagtattagtttgtttggatacctcctagaatcaattttgactcccaaaatcatggtgaagaattgaaaatgttgaagtaattatttgttgctttgcccttcaacgtgattttggaattgatttcagtagaattgaaagctaatccaaaaacacactaaacatttacttgaaatcactttacctgatatttcaatgtgattttgaatcatgtaatatgaatttaaaaactctataacgaaccaagaagctcgactacagtaaaattagaattcaggtcatagtaaaactaccttggtataggtttttgggaagatatctttta

SEQ ID NO: 5567 - DNA, 603 bp, Glycine max
cttattttgatagccattcctcccacaaaggtaaaggacaatgaatgaaactgactaggatatatgtgtgtgtgtgtgtgtggctagaaattaaaaataaaatggaaagaatggatcaagaagaacttattagctatgtagaattcaagtatatattaactaactttaatgactaaagaataaaagtattaacaatgggaaatttgaagaacaagatataaaatttgacaagcaggtcaagcaggggtgttccaagagaatcatgcctccacatgatgagcagcaagtgctggagctgcagcattgccaatgaaatgtacaacttgcaccactatggtcatcaagctctcaagcccattaagtagaaagctttgtgggaaggagcatgtaaaatgtacactatccatgtattcttttcatccttgtattccatgcatgttgtacactatctatagggaaacttagagttttgtaccataccatgcgactacctagctccttgattaggcggcgatcgaggagatgttttgatgatgttttctttgtcacaaaaataaagatcaaccatgtatttttggtgtgccttgtaccatttggaaacca

SEQ ID NO: 5568 - DNA, 385 bp, Glycine max
aaaaaaattcgtacgaaaaattaaattgtagtaaaaaatttgtgttgagttttgggttgatggagtaaaaagtaatttcgtacgaaaaactaaaatagatttctagtccacactttctttattgtccgtgaactgaaggaaggacaattgttttaaaaagcaaatctctttaacagatgttctcactgatgtggaataaagatgaatatccttaagaaccaaatttggttcatgccggagtcattatcaacttaaaaaaagtagttgaggattgagaatgaatattgaatgtagtagattagatgtagtttttctaaaattaatggcattaaaaatcgacaaattgaattgaaaagttggatagtaggatttgtagtctaaaaag

SEQ ID NO: 5569 - DNA, 380 bp, Glycine max
accagggtgatgccaacggctccaaccccttcgcttcgtggggtcaattcgtggattttcctctccctccttccatctccggcttcttccccggcttggaattcggattcggattcggatcatccgtgaacacacgtgtggactggagggagactcccagagcgcacgtgtggaagctggtgcttcccggcttctccaacgaggacgtgctggttgagctccaagacgagagggtgctccaagtcagcgtggagagcggcaacttcgtcacgaggtttaaggtccccgacaacggtaacctagaacaactcaaagccaacatgcgtcacggggttctcgttgtcactgttcccaagtttcatcaacccactactactgcc

SEQ ID NO: 5570 - DNA, 662 bp, Glycine max
tgacggcgctgccaacacgacgtcgtttcacctgtcagagatctggcagttcccgcctcccaactcgccagatgcactggggctcaggaggccccacttcgcccacggcagctttgcggactttgccccgggtccgacccgagacgctgacccggccagcattgcccacaagaagccccgccacgctgccggggaggaggaggaatccgctaagggcgcctccaccaccaatgccgtggtacctcactcaattaacaaatagagaatggatctgcttgtttttttagatattaaataaaagtatttgcttatgattgaagttaaatatgaatttagtcctcctacgtttttttcaattttaatcttataagtttaaatgatcgaaattaaaaaagcgcaaacttagggggattaaattcgtattcaagtcatttgtttatgctggaattgaaagttttggtgttgtgatttttttttaacgacgaatcttagttattaagacaaatgttaattgttattttttttgtgttggaatttgtgtggtgtgtgcaggatgagggtggtggtggtgatggaaaacggattaaggcgagtgagagtggggaaggtggaagagaaaacagttcaggaaagcctgcggagcaaagtggtaagccaccttc

SEQ ID NO: 5571 - DNA, 481 bp, Glycine max
tgtgccaccgcctgtgaatacattcgcggaaatagatttgggtgaggcgttgaatcagaatatacagaggtgcaagtatgtgaaaccaaccccggttcaaaggtatgccattccaatttctcttgcggggcgagacttgatggcctgtgctcagactgggtcaggaaagacagctgcattttgcttccctattataagtggaatcatgagggagcaatatgctcaaaggccacgtgtggctcgaactgcttatccgctggcacttatcctctcccctacaagggagctttcatgtcaggtgcaattctgattttagatcctggtttgcattgccttcatatgtttagatgtctatctatatatactcaaaaactaaaatgttgttgtctcgcagatacatgatgaggccaaaaagttttcttatcaaactggtgtcaaagttgtggttgcttatggaggagcaccaatcaaccaacagata

SEQ ID NO: 5572 - DNA, 589 bp, Glycine max
tttgaatgtaacccttgcagggtccgatggacgtgttttgggtggcggagttgctggaacgctaattgcagcatcaactgtacaggtattgctttcaaatagtataaatttatgtcgattgatgattttgatagtgtatataatatcttgagcatactattgggggcttttatgcataataggaataggattgtcgaaactttgatgctttatttatgtgactatttttcaatcattgataggtcattgtgggcagctttattgcggatgcgaaaaagtcgagctccaatgccctgaaatctgggtcttcttctgcaccaccaccccaaatgctaacctttggttcatccatgaccccaaatagtcctacctctcaagggccttcaactgagtcctctgaggaacaggatcatagtcctttttgtagggggccagggcctgggtctggacatggactctacaataatgctagccagcccgttcataatatgcccatgtaccatcatccactatgggctggccaatctcatcagtaaagaagatgtgacttcggattaacagtgcagaaactgcgtcgtattttagcatg

SEQ ID NO: 5573 - DNA, 378 bp, Glycine max
ctgattactcggcgtcgacgccggcgctgacggcgcgttttgcgtggctgattctcgtcctcctttgcaagctcgacggcaaagcgaagcattgcaaggacgtttcgctttcttatctgtttctcgcgaacaatctctggtacgtggtggccagagtccgaagctcgaacctgcagtacgtgcttggcgacgattggatccttaagcacgaagctaaagcgaaacggttcgtttcgaactacgagaaggtggcgtggggagaagtggtttcgtcattggcggaaaatccagccgcggcggaggcgagggcggtgttcgagaacttcaaccgcaaattcgaggaagcgtatcggaaacagaactcattcgtcgtagctg

SEQ ID NO: 5574 - DNA, 642 bp, Glycine max
ctccttttgctgtcgatatcaacggtataaaagataagctcacttatcagttccgcccttggcaacgctccttccaattctgggttcgagccattgacatttacaccggttacaaggtctctcactctctctctttctctcaacactattgttgtattcatttatttcatacatgttttctcttcaattactttattcattattgttcaggtgtttcaagtgagagtgaatttcgtcaaagatgcgcagaagcaggaagcaatgtgggagaagcagcacgagcttgccgccgataagattttcgccatgtgctacgaccttggaggtttcttcctcaaggtcttccaacatttttgtttttccattcctcgttttttcaattttatttatttctctccttaattgttttctttcctcgattaggagccattgaccatcaataccctggaattttgtttttttgcatttccttatgattgtttgttttgctcatcctatggaattgatatgatactaaatgtggtacagattgctcaaattattgggaagcccgatttggccccggctgcctgggtgaaaaggcttgttacgctatgtgatagggctcctccaaccccttttgatgtggtgaaactagtgctg

SEQ ID NO: 5575 - DNA, 926 bp, Glycine max
  misc_feature (429)..(432): n is a, c, g, or t
  misc_feature (435)..(437): n is a, c, g, or t
  misc_feature (442)..(442): n is a, c, g, or t
  misc_feature (444)..(449): n is a, c, g, or t
  misc_feature (452)..(456): n is a, c, g, or t
  misc_feature (464)..(467): n is a, c, g, or t
  misc_feature (470)..(488): n is a, c, g, or t
  misc_feature (498)..(519): n is a, c, g, or t
  misc_feature (521)..(532): n is a, c, g, or t
  misc_feature (536)..(542): n is a, c, g, or t
  misc_feature (545)..(553): n is a, c, g, or t
  misc_feature (556)..(561): n is a, c, g, or t
  misc_feature (570)..(581): n is a, c, g, or t
  misc_feature (583)..(583): n is a, c, g, or t
  misc_feature (585)..(585): n is a, c, g, or t
  misc_feature (592)..(597): n is a, c, g, or t
  misc_feature (602)..(626): n is a, c, g, or t
  misc_feature (628)..(632): n is a, c, g, or t
  misc_feature (636)..(641): n is a, c, g, or t
  misc_feature (646)..(659): n is a, c, g, or t
  misc_feature (661)..(661): n is a, c, g, or t
  misc_feature (664)..(664): n is a, c, g, or t
  misc_feature (668)..(678): n is a, c, g, or t
  misc_feature (683)..(683): n is a, c, g, or t
  misc_feature (686)..(687): n is a, c, g, or t
  misc_feature (691)..(697): n is a, c, g, or t
  misc_feature (699)..(700): n is a, c, g, or t
  misc_feature (703)..(706): n is a, c, g, or t
  misc_feature (709)..(723): n is a, c, g, or t
  misc_feature (725)..(726): n is a, c, g, or t
  misc_feature (731)..(734): n is a, c, g, or t
  misc_feature (753)..(756): n is a, c, g, or t
  misc_feature (764)..(771): n is a, c, g, or t
  misc_feature (774)..(786): n is a, c, g, or t
  misc_feature (791)..(792): n is a, c, g, or t
  misc_feature (800)..(806): n is a, c, g, or t
  misc_feature (808)..(815): n is a, c, g, or t
  misc_feature (818)..(821): n is a, c, g, or t
  misc_feature (825)..(841): n is a, c, g, or t
  misc_feature (849)..(854): n is a, c, g, or t
  misc_feature (860)..(860): n is a, c, g, or t
  misc_feature (862)..(866): n is a, c, g, or t
  misc_feature (871)..(871): n is a, c, g, or t
  misc_feature (876)..(879): n is a, c, g, or t
  misc_feature (886)..(893): n is a, c, g, or t
  misc_feature (898)..(899): n is a, c, g, or t
  misc_feature (902)..(904): n is a, c, g, or t
  misc_feature (908)..(912): n is a, c, g, or t
  misc_feature (914)..(916): n is a, c, g, or t
  misc_feature (919)..(921): n is a, c, g, or t
tgtctggggaatcaagcatggaacaacagggacttgtccagaaataattggtattttttgttttaccttaaacatttcatagttggtaattggtttgagtttttatatatacattataatcttaggtgggtggcgttgcttgcatttggtgagggttggcacaataaccaccatgcttttgagtactcagctagacatggacttgagtggtggcaactagacatgacttggtacgttgtgagatttctccaagctattgggtcggccactgatgtcaatttacccagagaggcccaagcagaaaatggcattcaataaagattcaattgccacatgaaacacagtaaatgataaaaaaaagtgaaaatacaaaggattttagaggtactcgttgatggcacaattttagaggaactcgtggatggcaannnnttnnncttcnannnnnntcnnnnntcccctannnnacnnnnnnnnnnnnnnnnnnnccctccctcnnnnnnnnnnnnnnnnnnnnnncnnnnnnnnnnnnattnnnnnnncannnnnnnnnttnnnnnnttctagcannnnnnnnnnnncncnccttccnnnnnnttcannnnnnnnnnnnnnnnnnnnnnnnnannnnncttnnnnnnttttnnnnnnnnnnnnnntnccnctcnnnnnnnnnnnctcanatnnttannnnnnntnncannnnttnnnnnnnnnnnnnnnannattgnnnntacatccgaatcctcaagnnnnctcccctnnnnnnnntannnnnnnnnnnnnacctnntgatctannnnnnnannnnnnnnaannnntctnnnnnnnnnnnnnnnnnctcacccnnnnnnctcccntnnnnnttcanactcnnnntccctcnnnnnnnnactcnnctnnnactnnnnncnnntannntccac

SEQ ID NO: 5576 - DNA, 410 bp, Glycine max
aactgaaatcactacctctcctttgctctcttcactccccttcccgccaaaaccctaattcaacactctcaaaccatcacttttctcgtcgcttcttcgcaccttccattcctcccaccctgtgcctatccggcgcagcctcagcgtccacctttcatcgccatcgcttcttcgtaaccgctcgaagccaagacgaagaccaaatcactgaggctcttgaacaagaagaagagaaagacaacgaagaaatatcgaggcagggtgagaaaaaggaactcgcgaagcaaggcatatgggatcagataaaggaaattgtgatgttcacaggaccagcaactggactttggatatgtggaccacttatgagtctcatcgatactgcagttattggtcagagaagttcaattgag

SEQ ID NO: 5577 - DNA, 386 bp, Glycine max
tatgagcctccttcagattggatggattgggagaagcgctattataacaagtatgactccatcatatgtgaagcagtgggagttttgcagtcccaattgatgaacaccaggccaagtttggctcttggggccatggctttggttgcaatcagtgttccaacttcttctgctgtgcttttgtttcatttggttgaattggccaaggttgttttggctggggctcatcttggctagctagactagaatattgttcattagatgctttgaatttggtttggtatttggaaaaaccattcaattcttttgaattatacatagagcatatagaattttaattgattggaatttggaaccactatctgatctgttagatttgaggatggatg

SEQ ID NO: 5578 - DNA, 657 bp, Glycine max
  misc_feature (605)..(605): n is a, c, g, or t
  misc_feature (620)..(620): n is a, c, g, or t
  misc_feature (623)..(624): n is a, c, g, or t
  misc_feature (628)..(628): n is a, c, g, or t
  misc_feature (633)..(636): n is a, c, g, or t
  misc_feature (639)..(641): n is a, c, g, or t
  misc_feature (650)..(651): n is a, c, g, or t
  misc_feature (654)..(654): n is a, c, g, or t
gcatccacattttcaagcaagtactgtcttggtagcctaccgaccacattgccctcctcatttccttctttatccaggaatgcaaagtgtggaataccctccacgccaaactcgtcaagctcttgctcccactttgtgttatcaacattcaacatcacaaaattaactcgatccctatattgagaattaaatggtgccaagactagaattagtactaacgaaaattaatgttttacgaaatactatgggtgatcataaatggtgataacaaatctttaaggcatcaaaatccaaaagagataaatgtagaaaaaggaaacatgtgtgcataaagatgactacttgaattgctgctctactttgtagacgtcaggagctaattcccggcatacctcacaccaatctgcataaaactccaccacagtgggcttcccattggagagagcctggaccatccaacaccaaagcacaaaaactatgagaaaaatatggagcagatatcatgtaacaagtaacaaccacgaatgaaactagaaaacctagtcagaaccaacagatatcttaaaatgatggtgaattaatcatttgtgtgacgttgattcttngttttatttcctatncgnnacanttctnnnnttnnntcctatatnnggnggg

SEQ ID NO: 5579 - DNA, 561 bp, Glycine max
tatgagctattctacttggttgctgatagccaaccgaatcagcatatgggtgtgacacagatggtttggcaattgaaaccagatgctggacttttaacattccacctctcccaatgcttaacttacttcctctattttctttaataacactgctaggcatattagaagttgttgctctgaggaacttatatttgtacctgttaacaacaagcatagtaatgacaaataaattgctggcaaggaaatgacaactaacacaaaaataatagtttttaaaaaagaaaaatagaatacttgaaagaagcttgatgatcacactgaaatgccaccaggagttcggaattcacataatacatgaagtctatctgaaaaacaaatgtgtagataatcagtttaaatttcaaagcaaccagcatctgatcatttgagttaaaaacaatacaaacctgcaagtctccatgtccttcagctcttaatgaaacagaaggaggatctggctctagagtaatcttgatgcttgatccaggccattcaagatcctcaatagcttccttcagagct

SEQ ID NO: 5580 - DNA, 1352 bp, Glycine max
  misc_feature (97)..(97): n is a, c, g, or t
  misc_feature (742)..(744): n is a, c, g, or t
  misc_feature (814)..(818): n is a, c, g, or t
  misc_feature (828)..(828): n is a, c, g, or t
  misc_feature (831)..(831): n is a, c, g, or t
  misc_feature (833)..(833): n is a, c, g, or t
  misc_feature (846)..(850): n is a, c, g, or t
  misc_feature (869)..(875): n is a, c, g, or t
  misc_feature (877)..(889): n is a, c, g, or t
  misc_feature (892)..(893): n is a, c, g, or t
  misc_feature (895)..(918): n is a, c, g, or t
  misc_feature (926)..(926): n is a, c, g, or t
  misc_feature (928)..(934): n is a, c, g, or t
  misc_feature (936)..(941): n is a, c, g, or t
  misc_feature (943)..(952): n is a, c, g, or t
  misc_feature (956)..(958): n is a, c, g, or t
  misc_feature (964)..(968): n is a, c, g, or t
  misc_feature (973)..(973): n is a, c, g, or t
  misc_feature (976)..(986): n is a, c, g, or t
  misc_feature (988)..(988): n is a, c, g, or t
  misc_feature (995)..(996): n is a, c, g, or t
  misc_feature (998)..(1002): n is a, c, g, or t
  misc_feature (1005)..(1014): n is a, c, g, or t
  misc_feature (1018)..(1018): n is a, c, g, or t
  misc_feature (1020)..(1031): n is a, c, g, or t
  misc_feature (1034)..(1042): n is a, c, g, or t
  misc_feature (1047)..(1053): n is a, c, g, or t
  misc_feature (1055)..(1062): n is a, c, g, or t
  misc_feature (1064)..(1067): n is a, c, g, or t
  misc_feature (1071)..(1072): n is a, c, g, or t
  misc_feature (1080)..(1080): n is a, c, g, or t
  misc_feature (1082)..(1088): n is a, c, g, or t
  misc_feature (1093)..(1098): n is a, c, g, or t
  misc_feature (1108)..(1108): n is a, c, g, or t
  misc_feature (1115)..(1118): n is a, c, g, or t
  misc_feature (1121)..(1124): n is a, c, g, or t
  misc_feature (1134)..(1137): n is a, c, g, or t
  misc_feature (1139)..(1151): n is a, c, g, or t
  misc_feature (1157)..(1167): n is a, c, g, or t
  misc_feature (1169)..(1174): n is a, c, g, or t
  misc_feature (1179)..(1194): n is a, c, g, or t
  misc_feature (1202)..(1203): n is a, c, g, or t
  misc_feature (1208)..(1219): n is a, c, g, or t
  misc_feature (1223)..(1227): n is a, c, g, or t
  misc_feature (1229)..(1234): n is a, c, g, or t
  misc_feature (1236)..(1244): n is a, c, g, or t
  misc_feature (1246)..(1260): n is a, c, g, or t
  misc_feature (1284)..(1291): n is a, c, g, or t
  misc_feature (1293)..(1293): n is a, c, g, or t
  misc_feature (1297)..(1305): n is a, c, g, or t
  misc_feature (1308)..(1311): n is a, c, g, or t
  misc_feature (1316)..(1321): n is a, c, g, or t
  misc_feature (1324)..(1326): n is a, c, g, or t
  misc_feature (1328)..(1330): n is a, c, g, or t
  misc_feature (1332)..(1348): n is a, c, g, or t
acacgcttcagcatcaccatccaaattctcacttaggttcgtgttgattatgttatggcaattcatgtttttaattttgctgaaaaaaattatctgnggttcaatcaaaatctgatttttttgagttttgatcatctggggtgtttcatatcggttgggaatcgatgattttgatgtggaagaagaggtgagacctgattttccttgcccgtattgttatgaagactttgacatcgcgtctttgtcttctcatcttgaagatgaacattcttgtgaatcaagagtcacggtaggagcctgttctttctgatatctgattttcgtttcctttccatgttggcatgttgcaatataaatctatgttatgttcttttatgagtttgttagatacggtggtttttttcttaattttaaaaaagagaaaaatctaaagctagatcttgtcttaacgaaattgatagccttgatagcagagttgtcggaagattaatttttgattggaagcatgttaacaaactcataaaactcagaagaatttaaaccaatgagcacataaaataaacttcacatcacactttaattcaaaaatcttaaaaggagatttatagatcttatcctcacttatacgttgttgaacctttcaatttttatatgatgagaaacttcagctatttgtcctccaacaaatttttccttgagtaaaaatcatttttaatccacgagtattcattgatgactattnnngcttaatcgtgaccatttgagctcgtctagtcattgcggccaacatgcaaacccaagagatttaatgagnnnnncaagtgtgcntangntgtcctcgggatnnnnngactgttttttttattttnnnnnnnannnnnnnnnnnnnggnntnnnnnnnnnnnnnnnnnnnnnnnntcttaatncnnnnnnntnnnnnntnnnnnnnnnnaaannntaattnnnnngaatnttnnnnnnnnnnntnctttttnnannnnnccnnnnnnnnnntaangnnnnnnnnnnnnaannnnnnnnnaaaannnnnnntnnnnnnnngnnnngggnntttaaaanannnnnnnttttnnnnnnggggaaaagnggttttnnnnccnnnnaaaaaaaaannnnannnnnnnnnnnnnggggannnnnnnnnnncnnnnnnacccnnnnnnnnnnnnnnnntttttatnnaaaannnnnnnnnnnnctcnnnnngnnnnnnannnnnnnnncnnnnnnnnnnnnnnnatttcttataattctttttttccnnnnnnnngngtcnnnnnnnnngcnnnntcctnnnnnnttnnnannntnnnnnnnnnnnnnnnnnactt

SEQ ID NO: 5581 - DNA, 668 bp, Glycine max
ttaacctgaatatccacctcaaggtggtttcctctcctcatttgtgaattgcttcttgtcaatatgcagtctgtgtttaaattgcaggtggtcttatatgttggatatacttaaatttgaagttctttgagatgattatactaggataggaggaacaaattcccttacagacaatgaaaattaataattgtgtcaaattatttgcatttcatttgattatttgaggatgtttgcttattatataatccatcctgatgtctgtaacattaatttagaaatggagcctggtgttgttgtccttgaggaagatgggagacctgaagatcgagttgagtctgccctgaagtgtcttccacattatgatgttgctgaattatgggaaaattcatctgcatcttttcggtactggaaaatacgtgactatgctcatgcttatcgatctagaaaagtaaccccatccatggtatgcagcatttagttgttagcaactctctgtacagatttgtcttctcttaattcaaattaaattgtaaaatgaatcaattacactttgaatatataggttgctgagcgcatcatctcaattatagaggacaatggaagaaataaacctcctacaccactattgatatcgtttgatgctgcagaagtccgggagcaggcggcag

SEQ ID NO: 5582 - DNA, 418 bp, Glycine max
aacttttctttattatcatgccaaagcatcggcgaaaaatgatcaactcctagaagagatgaatttgcagctgaaattttatcaatggcgaaaatgaacataggatataatttttttcccttggtttactatttacaccattaacccttaattgccaccccccttatgttttgcccatttagtattgtaaaacaaatcatagcaaaatattattttcaacactttttattggacagattttttttatgtaggtcatagtaaataaccttgacttacattatttattgagacttacgtgcaattcagtgataataaatattgtatcaaagagagtgttccagtcacaatgtaactccagaagttgatcttgaagctaaagtaaggctggaccaaggattgtgtgccttcttcagatgtc

SEQ ID NO: 5583 - DNA, 413 bp, Glycine max
tgaatctggtgacctttctggagatgctgggaagcgacatgcgcgaggtcgtcccagaaagtgaggtttatgggcgatgattgtgtggcgcttttcttgacgtagaggcgggtccaggcgacgaccttgccggaggggaggtatttgatttcgacgggggcggcgacgttgccgatgaggttgacggagttgcagagttccttctgccacggaatctccgagggcttagggtatgatgatggcgttgttgttgttgtcatggagcacttcaagtttatccccagccacccttcccagcgcggctgctgtggtttccatgaaggggaagcggcgacttggaattggggttttgaaattagggttttgggattggtgaaaacgttcctcaaggtgcttgatgatgatactgctta

SEQ ID NO: 5584 - DNA, 806 bp, Glycine max
  misc_feature (787)..(788): n is a, c, g, or t
gggacagaactcttactgtgaatggattttccaaggttagtctgtaatgttctatttctgttaagagttgccggatgtattgttgattcctcattcttatttatactcaattgcccacatggaagcctccaaatttgattatgacacttttgagctgtttttctataggcctttgcaatgactggttggcggcttggatatattgctggtccaaaacattttgttgcagcatgtggaaagatccaaagtcaggtatgctacattttttattggccactttcgtaagccttaccctatacaagtatacatcatacatttttttatttccttttgctacatcctccatgacatcttacagattcttaggtttaacagattcagcatttgagaggaaactcaaagaaattttctagccttcatttggaattagttggactattgctgctagttaatattatatgcagtatatactggctgatgcatcttattgaatttagttcacttcaggggccagtagtatagctcagaaagctgcagttgctgcattaggactaggccatgctggtggggaggcagtttctaccatggtgaaagcatttagggagcgaagggatttcttggtaaaaagttttagagaaatagatggtgtcaagatatctgaaccccaggtgctaattcttttcttttattccttaaacaattctcctctttttgttttgtctcttacttttcctgtctccttttctactcaaacataatttttctcttttcacccgcagggagcatnnatctatcctgatttcagc

SEQ ID NO: 5585 - DNA, 680 bp, Glycine max
aagtccgatctgaggttgcttcttggcgtgttgggtgctccactcgctcccgtgcacgtgtgcaccacggatcccttccctcacctcagcatcaaagacatccccattgttagtccctctcttcttgttatcgaggtttttaacatcggtcgtggtatcgatgcggtttcgtcgcgtttgttgattttttaaaacttgcttgttatatttacagatcatatagacctaggttcagaaattgtttcatttctcttaatttttctcaaacctaagctctgttgtctaagatcagtaaatattatatcattttaggcgttttggtaggtcacatttggaagattgaatggagaatgtgtgtgaatgagtgtgacttttgatcttgcaggagacttcttctgctcagtacatattgcagcagtacattgctgcctctggagggcagaagcttcagaattcgattaacaatgcgtatgccatggggaaggtgaggatgatagcctccgagttcgagaccgcaaacaaggtcacgcggagccggaactcgtccaaggccgcggagtccggtgggtttgtcttgtggcagatgaacccagacatgtggtatgtcgagcttgctcttggtggcagcaaggttcacgccggttgcaatgggagattagtgtggcggcacacgccctggc

SEQ ID NO: 5586 - DNA, 491 bp, Glycine max
tggttagcactgtctggttggcttttccggatcctgataatcgcaacatgggtacttccatttgcaggacctcttctaattggaactttggccaacaccttagttattaaggtatggatggtgctgtatctatctctattaattatgctactggacttgccttataattttcacattcacaacaggggacttgtccggcttgcaagatgcaatttggtggttacaagaatcaaataatccgatgtacaggctgtggcaacattgtgtggcaacccaaaggtagaaccaactccaaatctaataagtcagaccccgacattattgatgtcgactttgaggagaggtgacactctcccagcccattcattctttacttctacactttgtaaagttaccaacattttttccatgcccaccctctccatctattctgttggacttcatatttctctcatgttttcaatttctttgtttctttcccaggcataaca

SEQ ID NO: 5587 - DNA, 358 bp, Glycine max
gctattcacttgcaaaatgagttctaattctaaaaatcagatccaaactaaacaagctacacctatacatgtccccctaccgcctcaaagaatagcatgtaatttcttaacatactatttgtaactagtaagaataagaatgcaatgactattgaattgaatgaggcagttacattttcagcaagcgtagtttttcacactgaatattgttgtcatttgaatcataatcaaaataacagactaatatgtagtgtagtcaattttcaataatcccttctcattataatcacacaattcataacaaaggttgcattctctagacctaatttaacaagatcgagcatctaaactagcacaa

SEQ ID NO: 5588 - DNA, 709 bp, Glycine max
tcacattaaggtgactaaacaagtgacaaattattctatagagtaccataagcattgggattggtgatgtagtcattgtgcatgagtgctgtatttgcagcaatgaaaacgtcgctgccaagtttcttgttgagttcaagtagcatttgctctaattgagggttgtacaatgctgcagcacgttgtagatcagcagaacattctccatttttgcctcgcatagccaattctgcaggggcacaacccaatggccctgtccctgtcacaagaactcgccgagctcccagatcatatagcctctgcatttttattattacaaatgaaacaaaggtaagaacacaaaaatactactatttgttttttatgtgctttttgttaggttatgtttagataaacttttttgtaagtatttacaagtgataaaaataagaaaggaaaataaattaaattttttctatatattaaaattaatttatgcactttagtttttaaaaacttattaatggtggacttctataaaagttaaatgcatgtatatgtttattttattagtttccaaaacaaattacaagaaaaattcaatatattttatctttttattttcttcttgtataaatatttaaggagaagtttattgaaagagaacttaattaatttactttaatatacctgcaagtgcttgctatagcgagtgatgagaaacttgaca

SEQ ID NO: 5589 - DNA, 413 bp, Glycine max
atagcctcctcctcctcacttcactaatttgacaattacactcacatccccctcaggcttaacaacattgtatatactttctgttaacacatatgtcacttaatggagagatgtagtcatgtaaaaagaaaaggaatatccacattcctttaataacattgtatatactttctttcttcctttctccttttagctggaggtcattttcttctctgtatatctggtacatgtggacttctgtaaattcaagtctctagattatatcatgtagtgtattatccagtgggttgcttgaaacaggaaaattgaaagattaagtacttgtttgttatgaacgcttgttctgtttattatcaaattttattgtgaattcaacgttgatcttcttgtgcataaagatcaagtcaatgctg

SEQ ID NO: 5590 - DNA, 396 bp, Glycine max
actccatgatcaatgtctttggaaaagccaagctcttccgcgaggctcgccttcttcttcaagagatgagagacaatgccgttcaacccgacaccgtcagctattccacccttcttgccatctacgttgacaaccaaaagtttgttgaagcactttctttattcttcgaaatgaatgaagccaaatgccctcttgatctcaccacttgtaacatcatgattgatgtttatggccagcttcacatgcccaaggaagccgaccgcctcttctggagtatgaggaaaatggggattcaacccaacgtcgttagctataatacgctcttgagggtttatggagaggctgacctatttggggaagccatccatctgttccgtttgatgcaaagtaagaaaa

SEQ ID NO: 5591 - DNA, 1202 bp, Glycine max
  misc_feature (366)..(366): n is a, c, g, or t
  misc_feature (368)..(394): n is a, c, g, or t
  misc_feature (398)..(459): n is a, c, g, or t
  misc_feature (461)..(468): n is a, c, g, or t
  misc_feature (470)..(470): n is a, c, g, or t
  misc_feature (473)..(475): n is a, c, g, or t
  misc_feature (479)..(486): n is a, c, g, or t
  misc_feature (491)..(498): n is a, c, g, or t
  misc_feature (500)..(512): n is a, c, g, or t
  misc_feature (517)..(540): n is a, c, g, or t
  misc_feature (546)..(547): n is a, c, g, or t
  misc_feature (560)..(560): n is a, c, g, or t
  misc_feature (567)..(567): n is a, c, g, or t
  misc_feature (569)..(569): n is a, c, g, or t
  misc_feature (571)..(572): n is a, c, g, or t
  misc_feature (577)..(578): n is a, c, g, or t
  misc_feature (581)..(581): n is a, c, g, or t
  misc_feature (583)..(583): n is a, c, g, or t
  misc_feature (585)..(585): n is a, c, g, or t
  misc_feature (588)..(588): n is a, c, g, or t
  misc_feature (590)..(592): n is a, c, g, or t
  misc_feature (598)..(602): n is a, c, g, or t
  misc_feature (608)..(619): n is a, c, g, or t
  misc_feature (622)..(624): n is a, c, g, or t
  misc_feature (626)..(640): n is a, c, g, or t
  misc_feature (643)..(651): n is a, c, g, or t
  misc_feature (655)..(661): n is a, c, g, or t
  misc_feature (667)..(677): n is a, c, g, or t
  misc_feature (681)..(683): n is a, c, g, or t
  misc_feature (685)..(685): n is a, c, g, or t
  misc_feature (689)..(690): n is a, c, g, or t
  misc_feature (694)..(694): n is a, c, g, or t
  misc_feature (696)..(699): n is a, c, g, or t
  misc_feature (703)..(712): n is a, c, g, or t
  misc_feature (715)..(716): n is a, c, g, or t
  misc_feature (718)..(740): n is a, c, g, or t
  misc_feature (742)..(743): n is a, c, g, or t
  misc_feature (750)..(752): n is a, c, g, or t
  misc_feature (754)..(755): n is a, c, g, or t
  misc_feature (759)..(760): n is a, c, g, or t
  misc_feature (763)..(769): n is a, c, g, or t
  misc_feature (774)..(782): n is a, c, g, or t
  misc_feature (788)..(803): n is a, c, g, or t
  misc_feature (807)..(809): n is a, c, g, or t
  misc_feature (811)..(815): n is a, c, g, or t
  misc_feature (819)..(824): n is a, c, g, or t
  misc_feature (828)..(831): n is a, c, g, or t
  misc_feature (838)..(852): n is a, c, g, or t
  misc_feature (855)..(860): n is a, c, g, or t
  misc_feature (862)..(864): n is a, c, g, or t
  misc_feature (869)..(873): n is a, c, g, or t
  misc_feature (876)..(885): n is a, c, g, or t
  misc_feature (888)..(893): n is a, c, g, or t
  misc_feature (895)..(896): n is a, c, g, or t
  misc_feature (899)..(900): n is a, c, g, or t
  misc_feature (908)..(908): n is a, c, g, or t
  misc_feature (910)..(915): n is a, c, g, or t
  misc_feature (918)..(920): n is a, c, g, or t
  misc_feature (924)..(926): n is a, c, g, or t
  misc_feature (931)..(940): n is a, c, g, or t
  misc_feature (943)..(946): n is a, c, g, or t
  misc_feature (955)..(967): n is a, c, g, or t
  misc_feature (969)..(972): n is a, c, g, or t
  misc_feature (978)..(989): n is a, c, g, or t
  misc_feature (992)..(1004): n is a, c, g, or t
  misc_feature (1008)..(1008): n is a, c, g, or t
  misc_feature (1010)..(1015): n is a, c, g, or t
  misc_feature (1017)..(1023): n is a, c, g, or t
  misc_feature (1031)..(1034): n is a, c, g, or t
  misc_feature (1036)..(1039): n is a, c, g, or t
  misc_feature (1041)..(1041): n is a, c, g, or t
  misc_feature (1043)..(1043): n is a, c, g, or t
  misc_feature (1045)..(1046): n is a, c, g, or t
  misc_feature (1048)..(1050): n is a, c, g, or t
  misc_feature (1052)..(1052): n is a, c, g, or t
  misc_feature (1060)..(1080): n is a, c, g, or t
  misc_feature (1086)..(1094): n is a, c, g, or t
  misc_feature (1096)..(1105): n is a, c, g, or t
  misc_feature (1107)..(1107): n is a, c, g, or t
  misc_feature (1111)..(1113): n is a, c, g, or t
  misc_feature (1115)..(1131): n is a, c, g, or t
  misc_feature (1134)..(1151): n is a, c, g, or t
  misc_feature (1154)..(1160): n is a, c, g, or t
  misc_feature (1162)..(1162): n is a, c, g, or t
  misc_feature (1164)..(1167): n is a, c, g, or t
  misc_feature (1169)..(1171): n is a, c, g, or t
  misc_feature (1181)..(1188): n is a, c, g, or t
  misc_feature (1190)..(1198): n is a, c, g, or t
acccaagaaacaccccctccctcccctcctttcctccaaaccctaaccttgttcatctccgctattgccttcttcttcatgcacttccaccacaacccccacccctttcttcaccaacctactcattcccctcaccgccgagtccgacactgccttcactgaggaggaagtcgagagacttctcaaagagcgtctcaataccaacccgcacaacattgatgcgctccacgtcctgatagaggtcaaaatcagagtgcataaaatggacgaagtgtttggggttttagaccatttgattgagcttgacccggaggagctagaatgaccgctcctaaaggcaaacatgcacatctacaacatacgacngnnnnnnnnnnnnnnnnnnnnnnnnnnnctannnnnnnnnnnnnnnnnnnnnnnnnnnnnnnnnnnnnnnnnnnnnnnnnnnnnnnnnnnnnncnnnnnnnncnccnnncccnnnnnnnngctcnnnnnnnncnnnnnnnnnnnnntcttnnnnnnnnnnnnnnnnnnnnnnnncctctnncccctcttcctcncccgccncncnnttccnnccncntnccncnnnctttcnnnnncccccnnnnnnnnnnnnctnnntnnnnnnnnnnnnnnnttnnnnnnnnncccnnnnnnnctttcnnnnnnnnnnntctnnntntctnntttntnnnntttnnnnnnnnnnctnntnnnnnnnnnnnnnnnnnnnnnnntnnttttctnnntnntgtnntcnnnnnnncttcnnnnnnnnnctcctnnnnnnnnnnnnnnnntccnnntnnnnnctcnnnnnntccnnnnccctttnnnnnnnnnnnnnnnccnnnnnncnnnccccnnnnnctnnnnnnnnnnctnnnnnntnnttnnctttcctntnnnnnnccnnncccnnnccctnnnnnnnnnnccnnnngtctcttgnnnnnnnnnnnnncnnnntcctcnnnnnnnnnnnncgnnnnnnnnnnnnncccncnnnnnncnnnnnnnctcccctnnnntnnnntntntnncnnncntcctcccnnnnnnnnnnnnnnnnnnnnncttttnnnnnnnnncnnnnnnnnnntncctnnntnnnnnnnnnnnnnnnnnctnnnnnnnnnnnnnnnnnntcnnnnnnntncnnnncnnnttcttcttcnnnnnnnntnnnnnnnnncttt

SEQ ID NO: 5592 - DNA, 1426 bp, Glycine max
atttaacatatgacacacagaaattataagtatcagcaaggacagaaaaaagctgatgataactgaatgtacaactgttagtccaagtagtttcagttaatacagatccaacctagtaagaaaaataagggtggctttactcatcaaactctgattcatcatcagtttcgtcaaactcgccattttcctgccaagaagcagaaaataaattgtatattccataactgggaaaataagagtcagctcattagccaggaaaatgacagattgcataccattttcttgttaaattctgccattgcgctatcaaattcttcacgtttttttgttgctatatcatagtattgtaccttctcctgttagatacaagtgtcattaatatagaactcggccaaaatgattttttgtttttgctcagacctaaacgaataaactatatgcaaactaaattctcctttttgccaagtcaccaaacaggaaacaaacttcaaagactagttctatattgatttagaatgaagatcagcaaatgagcatggggactgagaaaaactttaggagaaacacaccaaaaaaagtagttgtagttggggagccctaggttctataaaacctcacactatctcaaccttccaacaacaacaaaaacaaagctttatcccaccagatgaggtcagctaaatggattacatgatgtcattcagattggttaaagaccaaagtttcatcgattttatctaccataaaatatgcagtgccattctgctgtggcacgaccatttaacaatgcaagaaactaaagaattacatatattttttttggtgataaattctcagtataccatttctaaaactgaagaacagagctaaatttcatgtacccaatatcttaatctaattctgcattaaatctgagttcaccccagaattttaatcagaggaaacagttctaatacttctgcgctatagctatatgctaaaaggaagaaaatgttctacttcctcacatgcttaattctctctgttttcagccatcaaacaccacaatcataataagttaataacgaaattcaagtcaataaaaaaaggagaggctacgaaagaaaactaacctcataagtcattgttttccacttctctccacatgccttgccaatctgaatgaacaaagggtagaataaaacaaaaaagaattatattaatttgcaaatgataatgatagagctggctagtttcacaaaaaaagagaagtataaagacttctcactaattcttaaaacaacagtcaaattttaaagattgatgcttaacttttatgttgtatgggctttcgagaaatttaaaatttgtaaatgatcaattgtgcaacaatcttgcttcttgagcaattaaaaatataaaataaattagaagaaatactaataga

SEQ ID NO: 5593 - DNA, 388 bp, Glycine max
tctcaaaaatctctccaccttattgcttcttcaatcaacaaactattcacagtttcactctctcctttgttgttgtttgatggaaaactgcatcttccactaccatcaccacacactcctcactctcccttcaatttctcacaaaccccacttcagattcttcacaagacctgatcttggtggtggtggtggtggtgttcgtgttgcttcttcttcttcttcttgtttgttattccataggcgaagaccctttatcagagcaagtgctggagcaagcccatgtgagtttagtagcctaaactctcctttggagccacgttccatggtggggaagttcctcattggtgttcttcagaaccaccctcagatgttccatcttgctgttgtg

SEQ ID NO: 5594 - DNA, 734 bp, Glycine max
tcagtggctagtatagaagaaccataagcactgagggaaaaagtgattagtactttacccaacaaattaaaaatggctgtcaccaaggtctacattgtgtaagtatattttccactgctacttgttgcattttctttatcgtgctgaatgcagatattccaactcaactactcaagcattcatcaaccataaatttgaatttgatggtgttatgacccttttgatcacatcaatttttgcaggtattactccttatatggacatgtagacaccatggctagagaagtacacagaggggctgctacagttgaaggtgttgaagcaacactttggagggtaattaattttttcaatcagttagggtgtggaagtgtgcagcaaatatttggatgatggggtccagtgattttaaattgcggttgtggttgcactgtaattggcaaaattgcagacaaatgtagcagcaattgcatgccctatgtgttatagagaccccaaaaaccacaataattaggctgcaattgcagttgtgaataccaatcttttcaattgggtctcttctcagttaggacccttacaatcttggttaatagtttatttttggttttctgaaaacaggtacctgagatgctttcggaactaatattggataagttgaaggcccctcctaaaccaaatgatgtaccagacataatgccagaacaacttgtggaggctgatggtttgatatttgg

SEQ ID NO: 5595 - DNA, 403 bp, Glycine max
cggcaagcatttggggcgcccatctggctcaaagaccgcggtagcctttagccgagtcacagctgatgcttccaagatatgataatatgttctaccataaaaataaaaataaaaattggatgcttcaagcagtgagaggacaccctattcgtttcatcaccctattgtttcatcttattaaccccgtaattatagaaaaagaataaaatgcccactcacgttgatgagttggaaaggaagaagtaatgcatgtaatctgccaatagcaagtacaagtacaagcttctcatttgagtgtaagcttgcaatttttatccctccaattttttgttttttagtttaaatcatgcactcattgtgcatgatgtttagtttataccacgcctcttgtataattctgaaa

SEQ ID NO: 5596 - DNA, 361 bp, Glycine max
cataggagaacatcttacactttcaaacccaaagaattgacgagacaatacaatgtaaaaccaacaactatttacattacatttacgatctaggcattaaacatcacaaccaattccgtaagttacttcctagtatctcattgagcacatacttaacaaaaggaaaaaaaagaactacaaagatctaaatgccaaattcaaatcattgtacataataagattgccctctaacaataccagattttcatagttagaggatatcatcgtaagcaacaatttctctccccttgaaaggcacttctaaaaccgagctacctgagctatcctcactacgtttggtgttccctatggctgaagaaag

SEQ ID NO: 5597 - DNA, 607 bp, Glycine max
  misc_feature (536)..(537): n is a, c, g, or t
  misc_feature (539)..(541): n is a, c, g, or t
  misc_feature (596)..(596): n is a, c, g, or t
  misc_feature (599)..(600): n is a, c, g, or t
tttccaggtctccaaggatatcaccattttccccacaaagtccaaggtccttgagcctcctttcttgataatattctaactggtccaattccaattctttctccttgaaggtctcatcaatttgctgcaggagctgcttctccccttctcgaattccaactgctattgcatgccttgaatctagctttgcttctttcaacttttgatcctgccattcacttgctttgttcagttatttgttgagctcaatcagcttcaaaattttcacagtttaggccccatttgattgggaggaaagaaagtgtggggtgaaaaaaaattgaaatttgaattgaagaccaaatggaaaggaagaaaaatttgggacaagtttactatgaggaaacattttctgttttcacttataattgcaaaaatgttaccttgttttcaaaagtgtatataggaaataatgaaaacataaaacaataaaaaaaattgtttttaatgattcttgtacaaatttttgaaaataagaaataatgtgaaacaaggtnntnnntttgtaattaaaagtgaaaacaaaaaaaataaaaaaattaaatattctcttaaantanncaggccc

SEQ ID NO: 5598 - DNA, 1047 bp, Glycine max
gtgttattgtggactctggtctaggcaaaaggtcgcttctagttaaggtataatctttgtctgtcaccttttgtcctagttggacagttcatttagattctttcagtttttattactatgacctttttctgtaataacataattaattaatattagctgagtggcaatactggttaatttggaagtgtataggattttttcacatggtgtatttatttgattaaggtctttttattcttcccctaaaataagattatctatactgagactaaagctcaaaattattcacggtgtgaccatttactaatagattgaaaaaataaataaaattatagtgtttaagtgaataagtaatatctcaacttcctaaaatgcaaacttgttttagaagtctagtctaaagtacaggaactacacctgttgaatagtattagtgccaattctgtacaaccgagtgctgttgaatgaacgaatgatgttttacaaattaaattccatgacatgggtgtttatattcttctcattaaccttcttgttttgcctctaatcatatttgttggagttaggatggtgtctattgcttaatccacacatgagcctagcctatgcatgcttttgtttttctaattctggtttcgtttttctcaccactgggaatatttttaactggcatttgtacctaatgtttggcagggtgctgtagaaaatgtattggacagaagctctaaaattcagttgcgcgatggttctatagtgaatctagatgataatgctaggaaccttgtattgcaagctcttcatgaaatgtcaactagcgcactgcgctgtttgggatttgcatacaaggatgaactccccaaatttgaaaactacagtggtaatgatgatcatccagctcaccagcttatgcttaacccttccaactattcatcaattgaaagtgaacttatttttgttggcttggttggattgagggtaagttttgaactttttattttataattcatgctttctcgcttttatcatatctatttaatgtttttgtga

SEQ ID NO: 5599 - DNA, 409 bp, Glycine max
ctggtgttttccggtaaattcaaggtttctggctcaactttgatagaagcacctttgaatggtgagaccacaacatggtatttggaatcaggagggccaacattggtgacagttctgtgaacaatcacaggactggggaatgaagtgggtgttttctgggtaaacactgatgatatggctgggtagttcaagtcccctggacttgctagagagtgtctacaagatctgtttgaatatttggcaaaaacttttagttgtgttggagtcagattctgagtgcatagaaattcaaagtagtcctgtggcacaatgtcatagaccaaaccagggtcaagagctctaatagggtcaatgtgtccagcaccatgatcataaggacttgatggtttagcagttgaggcatctctga

SEQ ID NO: 5600 - DNA, 402 bp, Glycine max
gtttgacgtgaagagtagcgagacgaaagtgaggcttcagggacaggagcgtgggaggaaggggaagctagcgattgcggcggatatctacgccgtgacgccgtcgtttatggtggtggaggtcaagaaggacaatggggatacgttggagtataaccagttctgcagcaaacaacttcgtcctgcgcttaaggatatcttctggaattctgcacctgccagtgcttgaatggtatattatatatatgatgtctgattattgttttacaacaccatttgtcgaccttgttattttattttatttttgtttaggaactttgagttttgttgataagatctgtttgtgttttgttgtttaaattgttagtttggtacttggggactggttagtgggtacttact

SEQ ID NO: 5601 - DNA, 402 bp, Glycine max
agcggatcaaagaggttccaaatccgacgtagaattgcaggtgtcaggagaagttttggtttgagagggtgccaaaaatggttaccttctttgcccactattcaagaggtgcataactattaaatggtgggaaggatgctatttaagcattcctatcatcagtcgtgcaatgaattttatttgtagtttttgtggattttcagaaagatgctaggttgtatttgctcagaaaattaaggatgtttacctgctcaattttttaattatagcagcagggagaagaaaagaaaaaagaaaaagtttctccatgtacatccttttttgctttctactggtttaagagttttcattcatactgtaggagtagtgaatgctgactgttcatgttcttggatgaaatga

SEQ ID NO: 5602 - DNA, 653 bp, Glycine max
  misc_feature (62)..(63): n is a, c, g, or t
  misc_feature (627)..(632): n is a, c, g, or t
  misc_feature (638)..(645): n is a, c, g, or t
tgtagatgcattaaaagaaagtgttaattctaatgttccttcagtggctagaactgagaagnncctttttgatcagcttccaaaagaattaaatgaaatgaagattggagacgacaaaggcaaaaacaacaataagaaggtatttatagtgattcattttcttgttttcttttgatgtttgtattagttgtcactatgtaaaatcatttatgtatattattatgtattcattgcaaggtagcatactagttagtttttgtaaagctggttttttatgcaatcactgagtatggtaaatgatttgctttgtgcaggatatggaagcaactattgtgaatggtaatggaacagaaacaggtcaaataactacaactgttattggtggtcgagacggacaaccaaagcgggtattgttcccacgagttcctttgttgctcttttacttccccattcgtaaatcttatttcatggaattagattctgaaaatcccttttttcttaaatccagtatttatatattacactacttggtatatatatgttatcaaaggggtatagggtgaaggaatatcacttgtattaatggcttaatatgaatttttttttttttttaaaaaaaaaaacctnnnnnnaagggnnnnnnnnggaaattt

SEQ ID NO: 5603 - DNA, 400 bp, Glycine max
  misc_feature (44)..(44): n is a, c, g, or t
acattttctgaattgccgctctaagctcttccttcttcgtcacncgcgctgccggtatcccacaagcatcagcaaacttgagcatgtttgggaatatgtcattctcgctagacgggtctccaagataggtgtgagctctattggacttgtagaaccgatcctcccactgaaccaccatacccaaatgctgattattcaacaacaatatcttaacagggagattctccactcttatagtggccaattcttgaacattcatgatgaaactaccatctccatcaatgtcaaccacaacagcgccggggttagcaacagcagcgccaatagccgcaggcaatccaaaacccatggctccaagaccccccgaggtcaaccactgcctcggtctcttgtacttgta

SEQ ID NO: 5604 - DNA, 752 bp, Glycine max
cgacaggaaagaacgagacagagcctggcgggctgggcgccagggcccagtcagcagccacgcggaatactcgtactgtgtcccactctcacaagacaaccttgtctgatgtcttaacggtaacttttatttttaataaaactaataaataatgttttattcttatataaggtgggagaggagtgaaggagagtaacaaaactaataaataatgtcttattcttatataaggttgattcaatgcatgaaaagagtgaaaacttggtaattatatttttaacaaaattaacatttattttgtgtactactattctcttttcttttctgtttatatgatattggtcaatttttacgtaacacgtatcattgcgaatgtaggatgcgaaggagaagctaccagcggataaggcggtgacgcgagaagatgcggagggagtgattggagctgagcttaggaacaaattggacatgagaaccacccctggtggggtcgctgcatccatggctgcagcagccacacttaatcaaaacagctacgatttcttcctttcatctcttttgattatttcaacgaaaacaatgcaaatcctgctgacgttttaatcattgtgtacataaacttaagtggtagtaggttttcatgtaatagctaattaaagtttatggttttgtgcaacacgtgcaggacaagtgactgatgcgtgaagatctcaagtttccatgcatccagtggagttaagtgccataccctg

SEQ ID NO: 5605 - DNA, 466 bp, Glycine max
gttgggtcatcagagtaattcttcagcctctcactctccggcaaaccaaagaactcttttgacacattcaccatcttgctcaccacctcctccggaatcccatggttcacaatcttgaaaaattaaatcacacccacaagcaaacaattaattaatcttgaaaaagtaataacaataataacaataatgtatgtgtgtatagtttgatatgtacttgaaagaagccataattttggcaagcatgtgcaatgttttggatgatttgggaatgattggagccaccaaggccttgaaggtcgatgatgggaatagaagcaatggaggagtgaagttgctgaaggtttggacggtcaccaatgggcctgatgaagttagagggaacacgatcaacggtggaggctaagtcggttaacaatggctttgtggtggccattgctggctatgatgtggtggctatggaggatgg

SEQ ID NO: 5606 - DNA, 390 bp, Glycine max
tttatggtgtggggcaattctgagtctcgagtgttttagttgtgaactctgttgcgtgattaaaacaagtctgagaagaaaaacaaattagtccaaccttttgtttgtttctggaagttagttatatcaagttgtgtttttgcattaaggggtttttgtcaatgatatgttaattttaatagatgtagatttatgtcaatgatattgtatgttaattttattcagtctcgtatctagctgaataattaagaattatactacgtcatgcctataacacttgaggtgcttaaaaataaacatctttttaataatattccgatctgctaacatggttattttatttacatatgtcctgatcggggttccctgcgatgactatactgaggcaat

SEQ ID NO: 5607 - DNA, 1194 bp, Glycine max
  misc_feature (1128)..(1132): n is a, c, g, or t
  misc_feature (1134)..(1134): n is a, c, g, or t
aatgttttgctccttgtatatatatactgctgcttttttgtagttgttaactgtacttaaaatgagggggttggtttggaggggggacttagtcaagtctcattgtggaaaacttgggtgtaaatcaggtgacttttgtcttttgtttgaatattacttggctgcaggttggtcatgagatatatgttggctatgggtagacagtagacacattgtttctcttgtgaagcgattatttctataatgctggaaaagatgttggaaaaatggtttttattcaatgcaattttggctgtaggatgtctagactgaaatatattttctttatgtaaaattgattgtggcacagtcttggtaaattattggccaaaactgtccaagataattgaatttgattttgccgtagatttaaattctgaaggttgaaatacaaaggctggaattagaatattgaaaattagcatagccgaagttgctagaaagtgaggctgttgacctcaagcactttaactggctgtagttgaaatgaatcaataagtggaaagtagtatggtagtttcaacacatcatccactgatttcttaattatatagggaggagggaaagcccatacttagtgccaatttttgtgacagctgtataggatgttaaatttagggatattgaggtcacattcttatgtatgatgatgtaacttgtaggatatgaatcactgcttacttttcttttgttcatccttatttgtgtcagcctttgtatagcataggcagagcagagtatctgttggtctggttaatagcttactgacaagtgattcttgagagactgttcaatacaagaatctgaactaaataaattactcaattttctgcttttttgttttaaatgttatgtaccttccattcctgattgattgctttgatactgacagactgaggacgaactgggtttacctgctgtccctcgggcatccatacgcggttaaagaatgtttttttatatcttggcatagctagtgaagtcacgagcaagcccttgtaaagatgtgcagatcttgagaatattgattgatacagtgatttaattggtctggtgtttccattatagacttagtgccttttattttcnnnnngnataaaccatgtggaagcatctttgttatttgtatgaagctttggctcggaaaaaaaggaa

SEQ ID NO: 5608 - DNA, 382 bp, Glycine max
gcaacacatgatggacatgtcagaggacggtgcaggagacaacaagacacacaatgctccaacatggtcatacgttcgagacgcgaaagcaatggctgcaacacctgcggatgtgaaggagtatccgaattcttacgtgttcgagatcgacatgccgggtttgaaatctggggacataaaggttcaagttgaagatgacaacgtgcttctgatatgtggggaacgaaagagggacgaagagaaagaaggggcgaagtatttgagaatggagagaagggttgggaagttaatgcgcaagtttgtgctgcctgagaatgccaacactgatgcaatctctactgtgtgccaagatggtgtgcttagtgtaaccgtgcagaaataa

SEQ ID NO: 5609 - DNA, 1037 bp, Glycine max
  misc_feature (1018)..(1022): n is a, c, g, or t
atgcgtgcatgtgttcatatatacagtatgatgtcaatgcatgaagaagcagttgctcttgccttacaggtgagactaatatgatgattgttgtgttccaactttaccactgctttaatacaaaaaatggtgcatcttaattagaaatacttgctttacaaatgtttttcattggtgatatttttcacttgtagtcatatcttatggggatgctgcaagagcaaccaattgtaacacttgttttattctttatgcattagaagtcttaaggaatacttcataaatgaggcccaaaagtgccttccagtgggaatttttcttctcttctcatccctttctccactgtggctagaataagttagtggtcttgtataatatacagttctctgagagccaggtttttgaaaaagtagtacaacatatccagttagaagttttttaaatcttaaataatttgacatcctaacaatgaaataagaataacactttaaatattttaaaggatttttttttttcattttttaagattgatcctttcatgctaactaacttttctgtattagattgattcagagcttgctatggccgaagctgataaggttgaagatgatgaggatttgagaaagaagctctggctcatgattgctaagcatgttgttgaacaagaaaaaggaactaagagggaaaacataaggaaggcaattgcatttcttaaagaaactgatggcctgctaaagattgaggatatattaccattctttccagattttgccctgattgacgacttcaaggtacagttatttttgctttgtttttgccatgttgattgacaattttcaactctgataatcttatgtagtgatactcacaagctaaattgtttttatttatttattattatctgttgaaatttacatataatatagtggcttctttttggaatattaactaaagaatcttttatgtgaagtcatttctctacatgttttgggtagttgcaattgtttttcttaaactnnnnnttggtgaatatctaa

SEQ ID NO: 5610 - DNA, 497 bp, Glycine max
tattcctcttcttaccttcacatatgcaggcagacttggccctgcatcttcctctatcacttcaatcaaaactcaacatggggtgagttaattcgcttaattaattcatatcatatcatatcatatgatctgcataaccatggcaatttcatcatatgcatgtcttttgtattgttcaattatgaataatcttctcatgtgcttgaaggttttggaagaggagaagttggacgtggaggaaacttgtgatggtattggtgaagaagaatgcttgatgagaagaacacttgtggctcacacggattatatctacacgcagaagcacaaaccatgagatattcatatatagctggttctcatatcaaattcaggctatatgcctcactcgtttacatttgtaatttatgtctaagcaatagttttcatacatatgccacttaagaaattctaagagatagttcagtcacttatttttcatttcttgctgttgccgatag

SEQ ID NO: 5611 - DNA, 352 bp, Glycine max
agacgtcgaaaccgccgtcaacgctgccgtctcgcgacacggcaagctcgacatcctcttcagcaacgccggcatcacgggccgttccgactgttctaactccatcacggccatcgacagcggtgacctgaagagggtcttcgaggtgaacgtcttcggtgccttctacgccgccaaacacgccgctaaggtcatgattcccagaaagaaagggagcattgttttcactgctagcatcgcttctgtgtcgaatgcgggttgggcgcacccgtacgcggcgtcgaagaacgcagtggtgggtttgatgaagaacctgtgcgtggaattggggaaacatggaatcagagttaac

SEQ ID NO: 5612 - DNA, 375 bp, Glycine max
agatgatgaggcaagtccaatgctaacttgcatttctgtggtttatatacatgatgcagcatacttagagttaccttattggaattgagaattgattcagcgtttttctaactcatgtaatggtacaatgatttagtacaggttttcttttcttttttatgcatggaagtcggttttcactaacccaaccggcttatagttttttattgaactaattctgtcaccatttgcccctctgaagactctgttatttgcagagtcttgaggttggtgaatttgcatagtattgtaactcactgatgatgtaatacactcctcaattgttattatctgtgaattttgtttccatatcttatgttgagagttgtggtgcaa

SEQ ID NO: 5613 - DNA, 398 bp, Glycine max
atgaaattatgacgagcatataaataatttttttggctaaattagcctgtttgtttccactttacttttggtctacatgacttagtttagacggcatacacgaaaattgcattcaaaatcaagtgaagaataccaagctaaccagataatccacaaaacttgaagcacgggccgagaagaaaacaaaaggaaccaaaaagaaaaaaaagttacaataggaaactttcttcaacaacattcaagtagattgacgatgatcgtaaccagaagcagcttattgcttgaaaatttagcacggggggcgtctacaaagcaccattcgatggcagtgtgctctgaatatttgaaggcataaggacgttgaatccatcttcagcggtagatacaatcattccaga

SEQ ID NO: 5614 - DNA, 550 bp, Glycine max
acatcagtaaaacaaagttcatgtccacatgttatgtaattacaactttgtacattggatggttctaagtttcaaaaagtaagctacccattttttacgtaatgttgtgatcgcctccgggtctagtgccgagccatcaccgaaccactacacattgtcaaacacaaacaattaatgaaaatgagtttaaatgagtctacatatggcgatttgccgtcaatgttttcggactacaatatttaccacactccaatcactcttcaactctgcgccaattatgttccacatccaatgcatcacataatacccacactcatagcctccgcgttgaatgtgagtctacatgaagaataaattaactattgaatgtagggctgaacatgattaataacatttgaagttgcaaacattgtatgtagttcgactaaccttcagttcaagccactggggtccagttttaggaactttcccatcagcagtcgtgtttaatttcttatatgcattgcattggaagattaatatgatgttaatataatgttcagaattgtag

SEQ ID NO: 5615 - DNA, 401 bp, Glycine max
caaatccaattgaagaggccttagaaaattgtctcgtgtttaaggaaactgaagaagacgcagaaacggaggtcacaactcctagtttaggttcaaatgtgaatgagttagacactccttcagatggaggaatggagttttatgttactgatgaaaagggaactataaaaaattccaagatattaatgaatgagcctctagcaataaatggagagttaaggctgctgcacgtgcttgtgtgttggtcagaagaacagcttaagatatatgacacgcaactttgtagttcattgcctgaggttttcaagtctggctttttagcaaagagacctcaagaatcagtttctctttacaagtgccttgaagcattcttacaagaagaacctcttggaccagaagac

SEQ ID NO: 5616 - DNA, 388 bp, Glycine max
atgaaaacaataaaaaaatatttataaaattaactaaattattaatatttctacactcgtcagcaattcaatgcagacgtgtacaacataaatataaacatataaacaaggcatctattgtgaacgtatagacaaaattcctatgtatcaaccaacaacaactgttcaatccaaaaattggaaacatgctccgtttggcaatcttcctccaaaaagaatcaatgaatcaaatggtttcaacagtttaactctcacatccaaaggggtagtattatcaatttcaatatccccaccagtaaagaatctaacttgttgtatgtatggtgtgccttttgattatacacaaccttctattctttccctttttgtgtgcctaaactgaaactca

SEQ ID NO: 5617 - DNA, 906 bp, Glycine max
  misc_feature (880)..(891): n is a, c, g, or t
cttaggggcctgtgtatctagcatcattctcacccctccaaattgttttttctattgccatgggtgtcatcttccttggtgactctcttcatgttggaaggtatatataactaattcaatttctgcatttcaaatatattagagcatctctggtgtaatagttgaatttgagttcttcatttcttttaatagggacatatttggataattttttttttataagttaaaattaatttatgcctagactaatttgtataagttctaaaagatgattgataagttatgtataaattaatttaaattaataaaaaaattattttaattaatttatttattttttcctcctaaaaatactcctgaacaaatttacccaaatagaccataagtttcttatcattacataaaatttaagaatagtataatatattttagtagagttcaattcaagttcttaactattaaaaacaatgttgtcattgtttttaaaaccttagatgataaaatttaaagcttttataagctcgaaacagtcagacatatatgcaatatattcaattttgtacataaaaggttcattggagcacattgtttctgcatttttgcagtatagttggagcggcaatagtatcatttggcttttatgctgtgttgtggggcaaagcaacagaggagatagaggaagaagttgattacccggaatcaccagctactgagaatgttcctttattgcaaagctatggaaccgaaaacttgtgaaaagaaaacagatggaaatgtctaaaaactagtgaaaactcaacagccattaatttatcttttagcatcttaagaacatgttcttttgtacctcataacaaagtttgtttatcttttattttcnnnnnnnnnnnncccccattaaggggg

SEQ ID NO: 5618 - DNA, 1055 bp, Glycine max
  misc_feature (346)..(351): n is a, c, g, or t
  misc_feature (355)..(357): n is a, c, g, or t
  misc_feature (371)..(371): n is a, c, g, or t
  misc_feature (552)..(552): n is a, c, g, or t
  misc_feature (554)..(555): n is a, c, g, or t
  misc_feature (563)..(566): n is a, c, g, or t
  misc_feature (641)..(645): n is a, c, g, or t
  misc_feature (669)..(674): n is a, c, g, or t
  misc_feature (676)..(683): n is a, c, g, or t
  misc_feature (691)..(692): n is a, c, g, or t
  misc_feature (709)..(710): n is a, c, g, or t
  misc_feature (712)..(713): n is a, c, g, or t
  misc_feature (760)..(761): n is a, c, g, or t
  misc_feature (763)..(774): n is a, c, g, or t
  misc_feature (786)..(792): n is a, c, g, or t
  misc_feature (794)..(798): n is a, c, g, or t
  misc_feature (800)..(804): n is a, c, g, or t
  misc_feature (807)..(809): n is a, c, g, or t
  misc_feature (813)..(814): n is a, c, g, or t
  misc_feature (818)..(818): n is a, c, g, or t
  misc_feature (820)..(828): n is a, c, g, or t
  misc_feature (831)..(832): n is a, c, g, or t
  misc_feature (835)..(839): n is a, c, g, or t
  misc_feature (841)..(845): n is a, c, g, or t
  misc_feature (847)..(856): n is a, c, g, or t
  misc_feature (859)..(860): n is a, c, g, or t
  misc_feature (862)..(867): n is a, c, g, or t
  misc_feature (871)..(893): n is a, c, g, or t
  misc_feature (895)..(900): n is a, c, g, or t
  misc_feature (902)..(911): n is a, c, g, or t
  misc_feature (913)..(931): n is a, c, g, or t
  misc_feature (933)..(940): n is a, c, g, or t
  misc_feature (943)..(944): n is a, c, g, or t
  misc_feature (946)..(950): n is a, c, g, or t
  misc_feature (953)..(966): n is a, c, g, or t
  misc_feature (970)..(984): n is a, c, g, or t
  misc_feature (987)..(1010): n is a, c, g, or t
  misc_feature (1012)..(1027): n is a, c, g, or t
  misc_feature (1029)..(1039): n is a, c, g, or t
  misc_feature (1042)..(1046): n is a, c, g, or t
  misc_feature (1048)..(1051): n is a, c, g, or t
agacaaggccttcctgagttccagactgagataacagttctgtccaaaattcgccatcgccacctcgtttcactagttggtttctgtgaagagaattcagaaatgatacttgtctatgagtatgttgaaaagggtccactgaagaagcatttatatggttcatcactacaaacacctctctcttggaagcagcgtcttgaaatatgcattggtgcggctagaggccttcactatcttcacaccggttttgctcaaggaatcatccaccgtgacattaagtcaaccaacatattgcttgatgaaaactatgtggccaaggttgctgactttggtctttcaaggtagnnnnnntgtnnncacatgctcacganattatgcgaagaatgtttacaatgaaaaaagtgcaaatgggccccaaaattggggtgatctaaaagaacaatgggcagcctgaaaaataggaaaaatccaatcccctattgatttgtccactaatggagtgaaagtgatccccaagttaggggggataaagtattggaactataagcctananntgttattnnnnccatcaggagtcatgatgttgcggcaaatactaacgttttctaaaacgctcagatttaccccttctatttcatcnnnnntggttgggcttaatgaaaaataannnnnncnnnnnnnnaccgtcanncaattacaaattattanntnncggataagtttcccttaaataataatgatggttgcaggtcttttgcnnannnnnnnnnnnncaataaaaaaannnnnnntnnnnntnnnnnaannncttnnctgnannnnnnnnntcnntannnnntnnnnnannnnnnnnnnccnncnnnnnnctcnnnnnnnnnnnnnnnnnnnnnnncnnnnnncnnnnnnnnnncnnnnnnnnnnnnnnnnnnncnnnnnnnnccnncnnnnnttnnnnnnnnnnnnnnatcnnnnnnnnnnnnnnncannnnnnnnnnnnnnnnnnnnnnnncnnnnnnnnnnnnnnnntnnnnnnnnnnnccnnnnncnnnntccc

SEQ ID NO: 5619 - DNA, 403 bp, Glycine max
gtattatgatagaattaaaggcaaggcacatcaagcaacagcaccattggctttggctcggccagtgacccttacatggtagacccccatagctaaaagcacaaaaaaagcaacaccaaagataatgccagctacgccaccagctaccaattgtttcttacttccttgaggtgttgaggctttgctttcatgaatttcagtagcttccacttgtgctgctaaaggcattggtgagcatttggatgcagcacaagggtctttggtctcgggctttcgttcattcgggtgaaagaagttatatgctgatggtgaaaaggcttcagggttctcgtaaacaagcccatgaggggctctttcttgggctgtgacaattgagacaagtgctagagaaaccagggagaga

SEQ ID NO: 5620 - DNA, 833 bp, Glycine max
  misc_feature (774)..(774): n is a, c, g, or t
  misc_feature (776)..(778): n is a, c, g, or t
  misc_feature (817)..(818): n is a, c, g, or t
  misc_feature (825)..(827): n is a, c, g, or t
ctttttttatgctaaattagagagaagtgtaggttcaatctccccaattccagcatgaatagtatcaatgaacttgcatgagtcagcacattggaaattcttacaaaccacaaattgctgcaactatggaagtatggaaccaaactatcctcagtgtctacttcaaggcacacaagcaatcaaagtgaagaccatcagcaaacctgaaataaaggccaatcaaggaagagaaaacagcttaataataatgaaactaaaatcattctttttgcattacattctacatattcaacgtgtgggtaactttagttagatttttttcttcctagtacaaaaccacgagtattctccataggagacaatcctgctcgagttgaatagaactacagtaggtgacaacagtcttcctctgggtatttaatgcagttgcatactcaagactttaacttgagaccactgattaaactgaaacaacctcattacaattgattcacggacatattcacgttttagaatatgcactttaactagattagagtattgttttagaaccattttacttgatcttaagtcagaatatgcactttttataacgatcaaacttaaagcaacatttcatccatggagacttaaaccagagtatggttttatgggtttcaagccaatacccaaaatttttgggaagaaaaaaggatgaagagtgagaagacaacctctttgcattgaaaaccaaaagctcgcatcgtggcttaatgtgagtgattcctgtcatcngnnnccttgattgtatatgttccatcacgcagtaaagtgcttnngggtagnnnctctga

SEQ ID NO: 5621 - DNA, 340 bp, Glycine max
tatatgatatggaagcaagaaggcaaatggaagctttggggcaaaagacaagtccaggggaggagctgaactgcaatggtgatgagtgctacaagttggcattcattacaatgactgcagtttgcttgtttggggcatgtttgtcactcattctggtctttaggaccatacaactttatagaagagacctatacaagaaattcaatggtgctacaactgatgtaactgaaacaactgatgtaactgaaacggctgtgtcttagaaatgtattggaccatcagctgcaaatgaaggctaggtgactttggcatggaaatggcaacagaaaattcagaacca

SEQ ID NO: 5622 - DNA, 983 bp, Glycine max
  misc_feature (536)..(536): n is a, c, g, or t
  misc_feature (659)..(659): n is a, c, g, or t
  misc_feature (930)..(936): n is a, c, g, or t
  misc_feature (976)..(979): n is a, c, g, or t
ggatactcacatattgttatgatcttcgcaatctcagaagtccctggtgtgtactggctggccatcgtaaagctgtgagctatgtcaaattcttggactctgaaacacttgtttctgcttctactgataatacattgaagatctgggatctcaataaaacctctcctgtgggtgcatccattaatgcttgcagcctaactctgtcaggacatactaatgagaaggtttggttttaaattttatagcactggatggaatttatgtttgtaaagtatgtaaggttttctttgtcaccgtctttcaaatatcctttggagaattttacttatttggtgttaaatggagcatcagattatggttgatgatctgaatagaaaaatcaattttacgaaatccagattgtttttgacctaaatgatttgttcacagctgtgataaacaaactactatgccttcatgtcagaaatttgatctgtttttgttattaaactgacaaatgtttatgattacttaaattggtaatctgaaatcctccncctgtttcttgacagaattttgtgggtctatcggtggctgatggatatattgcatgcggttcagaaacaaatgaggtatatattagtttcagtagaacaattatttacttggttttaactttntaaaatcaaactcgttcattcaattagttatttcatttaattgcactaaagtgaaattatgactagtcacaaccctcaaaaatgtcagtatgataattctattaagcaacttgtatatgcttccaatttgtcttgatatccgtgactagcacccttacaatttgcaacattcaaaatttatttaaggataatatccaagatggagaaacgaataggtgggagttttgaatatagagcagaaagttacgtgagtgtgtgctggcttgaatcnnnnnnnattttctcttgcagatttacacctactatagatcgcttcnnnntgcc

SEQ ID NO: 5623 - DNA, 395 bp, Glycine max
aggtagttatcctccaagggagtgagagttaagaggaagagacagggcaaaggctgggaacaggcagagcacgaatggagctatcaacagaaaatggagaagtgagaaatgagaggagagaaagagagagatctgttagggctacgctcatgcactgcctcttccctggctctgtctctttcctattccaactccacttccctcatccatttctgtaatctgttattcaaatgaacattttatctgctaagcaattagatttgctctaggtgttactgctttatttgatgcaatagccctattagattggctctgattgcttcagaggctctatttgacgcaatgtttttttaaatcttacaacagccctattagattggctctgattgcttcag

SEQ ID NO: 5624 - DNA, 387 bp, Glycine max
gctttgagacacaatcaacaatagttgtcttagaaactgaaagaagtacccatcattgttcttggtgcatgatggtgctactcgttgtaatacaatcaataagcctattgcaaagtgttaatttcttggtctgtatttcaaggtgcatattcttaaacaatatgtttgttttgtatgagtctgacagagtcgtttggaattgccactccctatggcttcagaagttgaaaatctaagggcccgtttggagtggttgagtttttgatttttgggttttagagtttaattgttgacttgaattgtttttctagcttgggtgaccatctctaattgtcatcataaaaagaagacttggaacctacaaaattgcatgagcagtttcacaat

SEQ ID NO: 5625 - DNA, 699 bp, Glycine max
accaatgcccttagaaaggctagtaagctttgccattcaaatctgatggagttttgccattcaaatctgatggagttttgccatcatctcttcaagttccaactttgagaatttccaaatttatattttgttagttaatgtaccataaaacatttcaccaattgtgtgctttggactctgtgtttccagacctacattgtgtacatgggaggacattctcatggtccagaccctttgcctagtgatcttgaaacagccacaaattcccatcatgatttactcgcttcttacttaggaaggtaaaacaattatggaattagttgtgttaaatattcttattgggacgtatgagttaatcaaagtttgtttaacgtacagtcacgagaaggccaaggaagcaattatatactcgtacaataagtacatcaatggctttgctgccctacttgaagaggaagaagcatcacagattgcaagtgagcaaacttcattaccatatattgccatgattttcttgtcatcttgaagccacacaaattgatataataattatgcattacgtgtttctattggtacagaaaatccaaatgtagtttctattttcttgagcaaagagcgcaaattgttcactaccaggtcatgggattttcttggactggaaaaaaatggaaaagtcactgcaaactccgcttggaggaa

SEQ ID NO: 5626 - DNA, 380 bp, Glycine max
tcatatggggtttaactgctgggatcttgattagggctgcatcagttgtgtaccaacggcagccagcttttgtggagcagaaccctaaattcaagcttccacaggatgtatccaaggacactacaataccttgagttcattgtttattgtattttgtccttgatacttgtccttaatcgtgcaaaaaaactcgtagcagccagagttctagaattcatagcaagtgtttatatttactgagaaaggaagagggtactatcccatcacttggaattcatattcctacctattgaatgccatcccaaagtttagagagttgcagacattgaatcactcaaaatagaagtatttgctgacaagcaagtagtaacttgaatacc

SEQ ID NO: 5627 - DNA, 322 bp, Glycine max
atggacgatttgtttacttggatatcgaattgttcttccaacatacacttaatggcacaaaggtatcttcagttattgtagccttgtgatggagttggcgtgttaatttgttcaggaatagaggttcacttttgtattgtaaaaccacgagcttaaaatagatgattgtcacgtacccctttaaaggggaagaatgtaatctttatagatagatctatttttttgtgaagatgtatccgactcttcagagtgaaagcaatgaatcgcctcgcgattcatagcattaggcagctgcaattcagtgagtttcaattgatcatca

SEQ ID NO: 5628 - DNA, 333 bp, Glycine max
cctttccctcctcccaccacatcatcaaccactaccttcaaggacagtgttatggtgaaaccaaccccaattaagcagcaacttccaaacaaccaagacggatccatgcttcttatgatgactccgtgcttgaaaatgtcgcctcctagatcctgccttttgctcgaacccatatccgaaatctcacggttgggagatcgcaatgctcgcaagggcactccctatcctgttgggattcattgcagtgattcagaatcttccagtagtgacgattcttcgcgtgatctgtcgttgatgtatccggagcttcttgggatacacaagtcaggaaaa

SEQ ID NO: 5629 - DNA, 392 bp, Glycine max
gtttgattgaagaagggataaagatgtttcatgtcatggtgaatgaataccaattgatgcccaatatagagcattacgggataatggttgatcttcttggtcgaatgggagagttggataaggccttggatatgattaataacatgcccatgcaagctgggcctcatgtatggggagccttacttggtgcttgtcgcatacatcaaaatattaagataggggagcttgccgctctgaatcttttcctgttagaccctaatcacgcagggtattatacgcttttatcaaatatatattgtgtggacaagaattggcatgatgctgcaaaactcaggacattgataaaggagaataggttgaagaagattgttggtcaaagcatggttgagata

SEQ ID NO: 5630 - DNA, 407 bp, Glycine max
tcgcagaattacagttactttgataggttcacttgctactcacgcaatgttgctgcgactaatggcaggattgttgcggacaattcaacttttgtctgtgaattgtgaaaattctttgtagtttctttttttttcgtacatctattttattatgtagtttcctgcatagggttttggttttatttttttctagggggaagaatgtgtagtaaattatgtagtatgatagtatcttttgaatctgcatagtgtatgtattgtttccattcgtgccactgtgcctggatctagacaccgaaggaaaacacaagttactgaacctacctacggttagtaaacaaggatcatatcacaattaattgtataactcctagcagagtagggcttgcagacgagcaatttaagct

SEQ ID NO: 5631 - DNA, 730 bp, Glycine max
  misc_feature (34)..(34): n is a, c, g, or t
tcgctggttgtgactataaaggagaggctttggncaacgaaatatgtcttgctctgccaattttgcccccagtttctggtcattggttgccacccagttgatgacccttttattgacactgccttcacatctcctaaccctcccacgttgtacaccaacaccaagttgaagtatgggttgccgtttatggtgaaccttatgcctcccctcttcagacacaccaccctacaacaaaaaggtcattgaccatgttagaacaaaaagatttatttcatgtatgtgcattgacttcattgtggaaactcattagagaaaacaacaaaaaaatgtgcaagttataactattagcttttagtttcacgtggtgctaaacagtctaatggataattcttaaaaaaagtaaatgagatataaagaagaaagagagtgaaaatcataaatgtattaaatgatcatgtgacgtaagacatagatagagatagagataagatatgtgtgtaaaataattataaaaataaaaacataaaattttttaattagaatgttctattgatattataaattattttagttagactattgtttaattatagatttttatgtatcataagattattaatttttgtaataattcttttaaaaatcatattaaagagatttttatttgatttaccatgtagaaaattaaattcatataaaaaatcaaaattactacattttttccaaaaca

SEQ ID NO: 5632 - DNA, 388 bp, Glycine max
aggctttaggttggtctcaatgctaagaccaaaattctgtgggcatctgaagagaagaatgccaacatcaacccccaaagaacggaagtacttagctgtgggtcggagattgtcctctacactgtaactaacaatattggggcagcgagttaaaatcttacctataccctcttctgagaggcctaattcaaggagaaaatctatgctttccatcacttttggcctgctataagttagcagggctgggaagcgatagatcacctttggccattggtttttgtcaactcccaaagattcgaaaaacttcatggtgggtttaagattttcagatagactgattccacataattgaggtcttttagtgaggatagtgggaatgttctcttta

SEQ ID NO: 5633 - DNA, 448 bp, Glycine max
cgatcgctgaaagggagcttggaatgattaaggttgacgtgcaagcgatcaaggagagagagtgaagtgtctccagagttttctgcagacaacaacagcttcttcctccttctcctcctcctcacactccatgtgattgattattctccttttttttttaattttgcaactgtttattaataaataatttcacatggttgcttccttttttttttaaaaaaaaaaaaaagatttaaaaacccaatggggaaagtgggaaaaaaaaaaattttttgggggttttaaattttttgggggggttcaaaaaaaaaaaaggggccaggggaaaaaaaccggaaccatttttttttttttttttgaaaaaaaaaaaaagggaaaaaaaaagggaaacaaaaagggaaaaaaaaaaaaaattttttttaaaaaccaatgtttttttttttttttt

SEQ ID NO: 5634 - DNA, 504 bp, Glycine max
gtagccctgacacatttactaagatgagtaaactacaatttttgtattttcctcatcaaggttgcgttgataattttcctcatcaaagtagcgttgatcattttcctcacaggcttcaatctttttcagttgagctaaggtattttgtttggaggcatttcccactaaaatccttgccagagaacttttctgccaaaaaccttgttctcttggacttgtcatatagccgggtggaaaaactttgggatggaatacaggtaaacaaatcttcctgttataattgtctcctaattcaaatactacaaaattaacagcataagttcatgcgtgatgtctgcattttgttatagaatttgaagaatttaaaagaagttaaagtctctggttctaaaaacttgaaggagcttccaaacctttcagaagccacaaatcttgaagtattggatatcagtgcttgtcctcagttggctagtgtgattccttctattttctctctcaccaagc

SEQ ID NO: 5635 - DNA, 359 bp, Glycine max
attgttgcacgagatatcctatataatggctgcaaaatgctattcgttggtggtggtgatgctggtgacctatacacactcagacgattaatgagtttctagttacaataattacttacgtaagagtaatccgacatgtgatttctgcagaatgataatgattcttttgtacttggaggcaatggcaatttttagacgtgggaagcatgtattgtaccaacctttcttcaggttttctgtgacaaaagttacttgttattgccagaatgagtcccaattttgcttgaggtaaatatattcggattgtaatgtcagtcaagtgaggcggttctttatgactatagctcggtattcaactg

SEQ ID NO: 5636 - DNA, 360 bp, Glycine max
gtttacgttcgattttaaaccagttgttctgggtcccgatgttaccatcaagtcactcgccaaggcttcttccttctgatcctcctcatcacctactctacctcaaacttaaaatcaatcttctttttaatgtgtattagttaattaataattaaataaaacaaagtaaatatatatattaaaagtaggatgtgcactggacagcacagcagtactcatgaattgccgcttgttgcattttgtgagagaggtgtgtacattatttgctacctgtaacttttgcagagtgctatatatatatatatatataatgttaaagttttacttgttttggttggctttggcaatcaacttgtcttt

SEQ ID NO: 5637 - DNA, 360 bp, Glycine max
tgttgtattcatataaaaggtcatgatgacaaacttcagtgaaagttagtggccccaaatagttacacaatcacataagcaaatgactaataagacccaatatgctcaaaaacagagaatgatcatgttaatgaagtaattaacagatcccaacccagaaaagatcaagaaaacacacctattcatataccactcgctactatttgttacagacaaatataaactgcaaaaagttaaacatgcaatcccttcaccacattaaaaaatctgcaaccaagatgccttttgaacctttagatcaaatcagacatccttcttctgtgacgacccaatgaaactctaaagttttggtctgatgat

SEQ ID NO: 5638 - DNA, 552 bp, Glycine max
  misc_feature (543)..(543): n is a, c, g, or t
ttcttccttcttttcctctgccatctcttctttcttctcctcaggcttggcttcagccaccggttgtacttgttcctacacaatacaaaagaagaaacacacctaataagtgctagaaccaatgcagaccaagttataacactctcagcaagaaaaacaaaaaatatcactaggaaatcacaatgccaacagaaatgttacatcacctgttttgcttcctcacccatttgtcctatgaatggagactgatgaaatgccaaattgttattctgaatttggaaaaaagttctaggacatgcaaaagatggagagggatttagcaagtgctgagaaatcagtgatgttataaggagggaaggagaaggggtatatgatagatgaccgaggggtgatatgcatatataaagttaaactgagtgattccttatcacatgcagtgccactaactgcaaaaagggaacctcttagtttaatatttcttttcagaattcttttcaatcttcaaggttgtgaaggtagaacacgtcttcaaggttgggaagntaaaacccg

SEQ ID NO: 5639 - DNA, 765 bp, Glycine max
gtttgagtgtttgacggtgacatccctgttaaatttctctcgcggactcgccgtcactgtctcacggaggctactggagctgtttggaacagcgtccaatggcgtccctttctcaatctcaccgtatcgcactccctttctaaacgcacgcggcgaggtaatctactttctgtttctgtttgagcttatcttaattgctttacttgggattgtctattcaaataaggttttcttctttccaattgaggaattttcttggattgcttgttcactcttatttatatacaaataagtgttggattgacttaattagtcttaatgcactagaaaacaccattcttgcttgcttgcttgtaatctaaatagtcaccggctcggttttcacaacattgctaattaccactaatgccaattctcgcgaaggtttgtctttactttcccacgacatacattctggtattctttaacttagatttcatgactttgaggttgcttttttaaacagtgatgatggcgagactcgctccccctttcagtatcttcacacaatcccattactggcgcccacttctctcttctcacaacgccaaacacgccctaactgccgctactaacttctccatcacctcattagctcgaacgcccaaatcacgagatgaaggaacaaccaccaccattaagctttcgagcaaatccagaagaaaagccttctatgagtccccagaaggagtcttgttgcgcaagctaaacgagtgctcaaaggac

SEQ ID NO: 5640 - DNA, 360 bp, Glycine max
catttgcaccaagattttgttcttccctctccaaaagaaatttctgtgtgcatgacaggaaacagtacaagtagttctagaactttgaagttgagccgaagtagaagttgtaaagcaagtatcatgaggaatttatcttcagattggtttgaagatgtagacgtaattcagaacactcctccaatagggattgaaaaagccttccctggaagaccggagggctttccgaagaacatttatgcactaaactataatgccaatgcagaaaggctttcatgtaatggccatgggaattctgtacaaaattcttctgttgatgatgtacagaatgtgaaatcctccactaacaaggaaagagag

SEQ ID NO: 5641 - DNA, 403 bp, Glycine max
aattctcgagtgaaattttctctatccttaccattaattggtagttttttaagtagagacgttcatgtgtctctcccgtgttggctagacttttagcacttattattttaccaccaaaaaaaatctcctttagaatattgtataattgagatattttcatgcttgaatggcggtatccggatttctacatttttatgtgttatgtatgttttgaacttgtttggatggattaatttggtattctctaactaggaagtgaaacctccaaattgccatgtactgtagacttccgacttgagtgtgtgtgtgcaatggttaggaaaagtatcaaactagtgtttgttcaaaaggtaaattacaacgaccctcacgattgccatgtattgtagacttcagacatgag

SEQ ID NO: 5642 - DNA, 352 bp, Glycine max
ctgagaagcaaatttcggataatcaacagcaatacatgattaatatacataaaattgtcaaataattgaagcattacacaccaccagaacatttcagacaattaactgttaaaaacgaattttcataagaacacctacactactctacctttatttttcctcaactttttattcatgaaaaaccacaagattgtaccaagagggactcaagatcgaaggccattggcaaagagataagcaaaggtctccattgctcttttgttggacacaaaacttacctcaaccccatcaccatttttgctatctgataaacaaaatgccccagttctgtctatagaagccatctccactt

SEQ ID NO: 5643 - DNA, 662 bp, Glycine max
cctttccttctgacctagataaataataaataataattttattttttcttgctttgtggaaatatgcttattaatactacattataatttggtttcctaatctcttctacagtcatacaaatggcgagaagaaaggtggtgcttataatgtaggtgaaaaggagcagtggtgtatcaccactttgggctatgtgaaggccttctctaggcagtatgctgctgaggtattgttcaattcattcattgcttgtatttgaatattatcctagttttttaaggaaatgccatgtaaacaacactttgcatatacaaaaacttacacatgttcctccacagttagattgatctaagtttgcaaaaaaccaaatcttatgtgaaggttttgcacattttgataattttgttgctggcagatatggccccatgttgagaagttggatgcagaggtattgacagaagatgcacctcttctttttcggtcagctgtttattctggtcttcgaagaccaattcacgaggcttgatcaatttgatatttcacttctaagttgtgtttttttagaattaactaaaattcattctttagtctgtcagttaagcattttcttagtcaaccaaaagcgtaaagctgtatgcaattgtaatgtaagtgacaaggttgg

SEQ ID NO: 5644 - DNA, 700 bp, Glycine max
tgtggactcagatacagagacctttttggacacaatgcagaggagttggtccatgttgccatggaatagaagcttcgagggatggactttcaaaagaacctcctcaagtaaacgagagcctttgacctcacattcaactcattccatggtatgtaacaatgccattaacatccttcaatattctttgtcgtccacattaatcctttgatttatataattgtttgaatttaattgtcatgcatcataagtataacactgctaactaataaaaaatcattgttagaatgacttttaatgtagtagttattacaaaagtgatttataattagatgacattatgctattgtggtttcagtaaattttaattaaacgtttgttttttaatcatatttatcctggtacttaacagcttctgtgaatcatctcatttgtttaacattttttcaatgagcttaaaaaatggttacttttgtagactaattaccaatggatattgtcaacttcttgcagggaccatactttgatcacaataaatgcactgcaagtggctgggaaaatagggaactttggagtagagatgggaaaacaaagctcaaaaccaatgtgttctttgcttcctttgatcaaagaagcaaaaaagcatgtggtgagagtgcatgtacagcactagcagtgtgcatagctcactggcttcattcca

SEQ ID NO: 5645 - DNA, 531 bp, Glycine max
ctactaatgtggccttgtgtgccccttctactcgtattttatcaaagactcctaaagaaactgggtcagttggggaatcaaagtctgtaatttcacgtggaagactaggtagatcattgggttctgattatgtggcagcaacctctggtccgggtctatcaccaagttcttcagttggttcgctgtcttcggaaaaatcaactctgaatcccaatgccaaggtgtgaaagtacaagattgacttttaaaataggaaatagcacctacaaatgatggccttttattttaaggtagacacaaattttgttttttatattaccagcatttctcagagcttcccctttttttgtttttcctttgttgttgtcaggagttcaggctcaaccctaatgcaaagagttttattccgtctcaatcacatgctaggccccgctcccccatgtctgatggttccttctatttcccagctactgtatccaccataccaaatatgccagccatgtccatgggtattggagttgggactactta

SEQ ID NO: 5646 - DNA, 409 bp, Glycine max
gtatctaacccattcccttaccctaaccccagccctaccgcaaagagctgccccagggacgcgcttaagctgggtgtgtgcgcaaacgtgcttaatggaccaattggtgcgattgtggggtcaccaccggaccacccatgttgctcagtgctagaagggcttcttgaccttgaagttgcggtttgcctctgcactgccatcaaagctaacattcttggcattaaccttaacatccccatttcacttagcttgatccttaacgcctgcgagaagtctccaccctctgacttcctatgcaactagacattattaagcatgccattctcaattatccatgcactacttaatctcattgatgtgtttgtttatttgtgattttggttgccctttatgttgtggtgatgatcgt

SEQ ID NO: 5647 - DNA, 361 bp, Glycine max
aaaagttgtaattttgatgatgccaatattccaatcatcgaccttgggggactatttggtgctgaccaacatgtctcagcctcaattcttaagcaaatctcagatgcttgcaaagaatggggcttcttccaagtcactaatcatggtgtcaaccctgatttgatggacaaggtcagggaaacttggcgtgaattctttcacatgcccatggaggtgaagcagcaatatgcaaactcgccaaaaacctatgaagggtacggaagcagacttggaattgagaaaggtgctattcttgattggagtgattactactttcttcactatcttcccttttcactcaaggactataacaaatggccca

SEQ ID NO: 5648 - DNA, 373 bp, Glycine max
tcatcctctttcaaaagtaatccaaacattcaaccaaacacagatcagtgttgtagagtctaaacttgcttctgcaaatgatgctatttttcacacatttgtaattaagtcccaaggatctgaacagctcacaaaggacaagttgattgctgttttttctccaacggaatccaactcattgcagccattgtcatcagttggatggtaaggagaaagttgcagttagcatagtgcatagggatgtcatacatagaggaataccaatttctaaaagcttcctcagaaattttttgttacaccctggaggatcttaaaagaaaagcattgggaactagaatagtagaataataggttcccattaacgatgtaggca

SEQ ID NO: 5649 - DNA, 676 bp, Glycine max
  misc_feature (588)..(591): n is a, c, g, or t
  misc_feature (603)..(604): n is a, c, g, or t
  misc_feature (626)..(635): n is a, c, g, or t
  misc_feature (637)..(638): n is a, c, g, or t
  misc_feature (640)..(648): n is a, c, g, or t
  misc_feature (650)..(652): n is a, c, g, or t
gattcataggcgccaattgtgagtgagagagaagtttctgttttttctacttttccatttttttgggagagatagagagagagagatctgattcttcaccataactgtcattgctttgcttctctcactcagcacaagttgacaagaagggcattgccatttcaatcccatacaaaaagcacacaccccaattcaccaccattttcctaaagcttcactcttttctctgctaagagaagaaagcaagaaagaaaaagccaaaatggttgaatctcagcccaagttcttcatcccggactcaatcaacggcgtgaatttcgacgtagcggcgcagattaagatggtgtgggaagtgatgaatttaaatggggctgcgcagataaaaatggggggggaagagacgtgctttcttctcttaacagagaaaagagtgaagctttaggaaaatggaggagaattggggtgtgtgctttttgtatgggattgaaatggcaatgcccttcttgtcaacttgtgctgagtgagagaagcaaagcaatgacagttatggtgaagaatcagatctctctctctctatctctccccaannnnttttttttgggnnaaaaaaaaaaaaaaaaaaaatnnnnnnnnnncnnannnnnnnnntnnnggcccccccccccccccccccccc

SEQ ID NO: 5650 - DNA, 482 bp, Glycine max
attttctattgttttacactttcaatttgccatagttagtccattaatttgtttctaaaagatgtgtggaactttggcaggtccattcaccttctgttctattggatcctctttgagaatgtgatgtctttgcaccgtaccaaggcaacatttataggtctcttagagtatgggagggctaatgaatgggttgtgactgaaaaacttggtgactctgtcaataataataagaataaatcaggagatgctgccaagaagaataatgccatcaaggccacccccaaaaagactcgatccaaatttgttgaaaggtcagttcttaatttatttattttatttttatttgtatttttcgaaagcaaataattgtgtttgcatttggcattaattatagtttcttctctacatctcgattgtgaatttgtgattgtcaatcatgcacaaactggtattatggagatgggttctagactgtgtgggca

SEQ ID NO: 5651 - DNA, 979 bp, Glycine max
  misc_feature (807)..(807): n is a, c, g, or t
  misc_feature (895)..(899): n is a, c, g, or t
  misc_feature (905)..(906): n is a, c, g, or t
  misc_feature (939)..(940): n is a, c, g, or t
  misc_feature (950)..(950): n is a, c, g, or t
  misc_feature (955)..(955): n is a, c, g, or t
  misc_feature (958)..(958): n is a, c, g, or t
  misc_feature (963)..(963): n is a, c, g, or t
  misc_feature (965)..(968): n is a, c, g, or t
gactgctttctgtatactctcttttttcttaacagatactgcttcatagtcaaatcgtgagacattgtgattttacttgagcttatggatagaaccaaacttaaatgtggttcttttaagtaattttagtattgttctacagtcagaattaaagtcttacttcaataatttgggtaaggtttgctttaaaggtctcgaagtgaaacttcaattttgattaaagaacattaaaacacccaagttttattgcataatgaaggatctaactattgcacaaagtaattaattacatttcgtactacatgcagtattatttgaaggcacgttttcaattcaacaagaaccagtttgctgatttgttgatgattactgggattggagccactcttgcacaagtaagccttgagtcctagcatagctaactgtctgttattttacaataatttgttctttaatcaattgaatattcggtttcccaaaattccattggaaaagctacttgttctaattgccatgtgattggttttgtgttcttgtagctatttttcatgcccattttagtgcctgtgataggagaggagaagctgctctccacagggctcttaattagctgcataaatgtaaattcaagtctctcttcccaagatttctataataatatttatccctaacagtgtattacaaatgagcactgaaactaataatgaggcttcacaatatgatgctatgcaggtctttgtctacagcatagcatggacagcatgggtaattttcttctaacactctatttttcttatcacttttagnaattaacaagcctctaaaaattttgaaaactatgcaggttccttatgctctagcaggttgctctgtgtttgcagtttttgtgcgcccnnnnntaagtnncttactttgtatctgttacacccctctaccganntatttttggnttatnacntttgnannnntactctgataa

SEQ ID NO: 5652 - DNA, 389 bp, Glycine max
atgaaggaaagaaagcttatacaaagagtttacgtggttcgagtataaaaatttaacctatgcttcaagattggctgataataggcttggacattttgagagaattgttgcttcataatatgctaaaggattacgggggcatttgtcaatacaaaatggggggttacaatatatagtctatatactatatatgtttttttttcaactttaaggttatttatcaattagaatgcttcatagacgatagaatatataccccttttgcttttgcttcaacactagtggatgacgtctgatgtagtcaacaatggagatttgttaatgattaaaagcttgattcaaattgcaataaaacattataagaataaagtatatattccatgcacaat

SEQ ID NO: 5653 - DNA, 399 bp, Glycine max
gaagggatcgcaggaagatgatctcctggaaagacatgaaacttaattccagctgtccctaatagtggtaggttcctgtctgaatctttcagagggggaaggatcacaattgatctcatgtgaagacaaaattgtcttaagtagtaatgttcagctctggagggttggcaaatggatgctatggtatatggtatggcaaggataatgacattgtacctctgtagtatgcgttgagccaaccatgtgacatcattgttcttgactctacaaccaaaaaactggctgggatactatgatagattttgaagggatcatttcagctgttgagtgtttgttattgtgatttaatttcttatttctgccaaatgcagctagttcggttccagatagggaagtagg

SEQ ID NO: 5654 - DNA, 339 bp, Glycine max
  misc_feature (14)..(15): n is a, c, g, or t
catgccgaattacnnctgggtcagtttcaggggcattccctggattgttgggaatgattccgggggttgttgctggagcttctggcggtgctattttgcctggaattggggcctcacttggggaagtttgtcgtgattaccttaatgggcgttgtgcgaaagttgattgtaagttgaatcacccacctcataatttgttaatgactgccttggctgcgacaacctcaatgggaacacttagccaagctcctatggcaccttctgctgctgcaatggctgccgctcaggcaatagttgctgctcaagcccttcaagcacatgcagctcaggtgcaagctc

SEQ ID NO: 5655 - DNA, 1009 bp, Glycine max
  misc_feature (998)..(1003): n is a, c, g, or t
ctttgctacttcttgcagattgagcttttgggaaggatacaaagacaagaaatggatggtttattatacatttggtatgttctatctctccatttggttggtatttgtcaaactggtttagcagatcattaagtcttgagtattggcctgaagtgtttacgataatgctgtttgaatgaatttgcacaagtttcctctttcttttaaagttgacaaatgagagtaagggcctgtttacttctgtttatgtttttgttttcactttttgttacaaaattgccaccttgtttttactttgttttctattttcaaatatatgtataggaaacatagaaaaccaaaaaagttaaaaagctgttttcacagtttcctgtacaaatatttgaaaccaagaaacaaattgaaaacagggaatgataacagagaacgttttctcaaagtaaatgcgccctaaacttctaggtcccttggggttttatatgtattggctttggggatataatcaagtccggtttgtaacaggattgcctcacttagacttgctcttgcattgggtggttttttgtttctgactttcttttaatatgctggacacgattgctattttacccttcctctgttccatttagtatgagcttatacaaagacatggttgttatgctgccactttcatttggaaaagtatccctaaatattgcataggtctattgctgatggttgtgctaagttcctaactagaaattgtgattgcagtgtttctcatgttcaagttctgggaggttcattgtcacctccattcaatgtggatattctgcagccctctggaatgtttgtgttgaagagggaccagctggctgaccatcaacctgtagtgacatctggaaatgaatctcaagaaatttcggccgagcaaagagaagtgagagatttccagcatattgtgactatattgagtggacaagcattaggaatagtagaagatgagtgggatgaggaannnnnncagaat

SEQ ID NO: 5656 - DNA, 712 bp, Glycine max
tttctcaaatccattatgtgacaatcttgccatgtttaacactgcttccttcagttccctaactccatttgtcttttgagctatcaacatgagatcttggccatactccttaagtttctcctgcaatttccttaccaatgttattatatctattcgagtgaaatgagatttatgtgctcaattttcagttaaaattggtcttagtctaataaaattcgtataatagtgaacgtaatgttagtatttctatttgatagttgatgaatttcgccttcctttatagaatttaatatattagaatgatggccgaaattcatcaataagatgaattttgagcaaatttttttaccatatctattttaatcatcaacaagtaaatagcaggggctttgttacatactaaccaattttgggtgtttcttgttgaaggctatcacatcggccaagcttctcactggggaagcaactaagtctctgaggtatgcgttcaaggataatttgaattcatatgccatagcaatgtcttcactttggtcattaaagatttcctgaatgttgtttatctccaaattgtcaaccaaaactgctcctttttgcctgagtttgaaaaatatacgtatgatactgaataatgcaatcaataattaatacttgacacaaatcgtaattttcattaccttattgttttcaggtgcagttcgaaaagtatcat

SEQ ID NO: 5657 - DNA, 384 bp, Glycine max
tcgtgcaccgcagggaattctattagcacagacagtagtggtgcgaccacaattgcccttaaaagtgcaggcactcattacttcatatgttctgttcctggacattgttctggcggtatgaaacttgccgtcactgtcaaatcaggaaaagcctctgatgccacacccactacttccactactaccgccactaaatcaaactcgtcttcagcgagtagtgtctcaccaattgttgctatgttcattgtttcctcgatctcttactatgttttgcgtatgctataagtttccccactcagtcaggacagaggcagtgctttctttctttcttatattattatcactctgttttctggtttgatttatctctgagtactaatccag

SEQ ID NO: 5658 - DNA, 687 bp, Glycine max
tctggtgatccaaggcttaattacttccatattcaccttcgtcatgtccacctacaaaccatatttcaagcatttctgaatttgaaacaaaaagaggcggtgcctactgactagcgcaacacgtactttatttatcaagttcacatcatccaaatagcaaaaacacttgaaaaaaaccctgaaaaattacagatcaaatttaaccaaggaaacagaccagatgctccagttccggtgcaaacttctgcgatttcatcagcttcgcttgcttgttcgaaaaccgagtgtcttgatccgccgatgtgccctatatacaaaaattcaaccaatacaattcataagctaagtaacaagctccaattgagatagcaaataatataagatctaagaaatgttgagataaattaggtttaattcaattcaacagaagagtaattgcaatttgcaagctcaaaggttgcgctatactaactcgaaagaaaccgcccgacatcttctgatgccaatcgttaccgaacggagagaagagtgtgtagcggagattgcacgtgtgaatctacgcacggaggttcggaacagcactttagttcaagctatggaacgcgccgatacagtgatatatataagggatagaagatggatgggttctgaacttcttattctcgacactgagttggagaagagaag

SEQ ID NO: 5659 - DNA, 439 bp, Glycine max
tacactggacgcatgtattcacactaagcgtccattctgcatctaaatcagttggccacttgaatcccattcaacagcatgccatcaaagaatcaactcctatctcctaagcctgttgtatgttcaaaactccacaggaggcaggaattcactattccacgccaacagcttcttaagtggtctcagaagcattccccttacgcggggtacattcctgctctttggcaagagcttcatgttgatgcaaaggagcagaaaacacggtcgtcaactatcttttgcccccttctttgtcaagttaatgccctttgccttctccatttcagcctctttctcagctttcttcttctctaactctgcttgtttgatattctcttcatgtgctttccgaaacaaccttataaaatttagcagggttgtggtaactgcaattgttaaa

SEQ ID NO: 5660 - DNA, 340 bp, Glycine max
ccccatgcgccgcctcgccatgcagcggttccgccagcgttacatgtattattcatattgctatgatacattaaggtaccccgtgccacaacccgagtgtgtcattgtaccctcggaaaaacaaaggtttaaggagaccggaaggttgaaattcggtggcagccaccgcaggcaatctcgacggaggggccgtacaacaactccggtggatgataccgatcagggtgatatgtgatgattgatattgagatgtatataacagtgtccattttttatgtctttattggtcttttttttacattatatattatttatttgttgacaggcatacataaaccat

SEQ ID NO: 5661 - DNA, 705 bp, Glycine max
tgtggcccctgggttggacatggggtatcatatgccttattgttgtgggattctacactgcctatgcaaactggctcttggcagcatttcatttcatcgatgaccgtagattcattagatacagagatctcatgggatatgtttacggtgaaattttcattctttgcatgatatccaaactttgaattaaattttaactgaagtattccttaatttcacaaggcaagagtatgtaccacctcacctgggtcttccagtttttgacccttcttcttggaaatatgggtttcatcctcctcggaggcaaggcacttaaggtaaagtttatgctataaattaagtttattaagagtggacaaatgatgtaaaagattttcactatcgtccaattccgatagtggattatcgagaaaaaaaaaactgttaagattattgtaataattattttagaagttattattatatttaaaataattcataaaaatgacaattcataaaaattaaattcgtcaactaaatgagttttatttgagagaaagtggttatttatttactgcaggcaataaactcagaatttagtgattctcccttgaggctccaatactacatagtcatcacaggagctgcttatttcttgtattccttcttcattccaacaatatctgcgatgaaaaattggttgggagcttcagcggggctcacttt

SEQ ID NO: 5662 - DNA, 870 bp, Glycine max
  misc_feature (498)..(503): n is a, c, g, or t
  misc_feature (506)..(511): n is a, c, g, or t
  misc_feature (517)..(527): n is a, c, g, or t
  misc_feature (529)..(533): n is a, c, g, or t
  misc_feature (535)..(535): n is a, c, g, or t
  misc_feature (537)..(539): n is a, c, g, or t
  misc_feature (551)..(552): n is a, c, g, or t
  misc_feature (554)..(578): n is a, c, g, or t
  misc_feature (582)..(591): n is a, c, g, or t
  misc_feature (593)..(594): n is a, c, g, or t
  misc_feature (597)..(599): n is a, c, g, or t
  misc_feature (604)..(608): n is a, c, g, or t
  misc_feature (610)..(622): n is a, c, g, or t
  misc_feature (628)..(633): n is a, c, g, or t
  misc_feature (636)..(642): n is a, c, g, or t
  misc_feature (648)..(656): n is a, c, g, or t
  misc_feature (667)..(670): n is a, c, g, or t
  misc_feature (677)..(679): n is a, c, g, or t
  misc_feature (681)..(682): n is a, c, g, or t
  misc_feature (686)..(691): n is a, c, g, or t
  misc_feature (694)..(698): n is a, c, g, or t
  misc_feature (705)..(705): n is a, c, g, or t
  misc_feature (723)..(726): n is a, c, g, or t
  misc_feature (729)..(731): n is a, c, g, or t
  misc_feature (733)..(737): n is a, c, g, or t
  misc_feature (739)..(744): n is a, c, g, or t
  misc_feature (754)..(759): n is a, c, g, or t
  misc_feature (768)..(768): n is a, c, g, or t
  misc_feature (779)..(780): n is a, c, g, or t
  misc_feature (786)..(790): n is a, c, g, or t
  misc_feature (792)..(795): n is a, c, g, or t
  misc_feature (800)..(803): n is a, c, g, or t
  misc_feature (805)..(809): n is a, c, g, or t
  misc_feature (811)..(816): n is a, c, g, or t
  misc_feature (818)..(822): n is a, c, g, or t
  misc_feature (825)..(828): n is a, c, g, or t
  misc_feature (833)..(834): n is a, c, g, or t
  misc_feature (838)..(838): n is a, c, g, or t
  misc_feature (840)..(849): n is a, c, g, or t
  misc_feature (851)..(853): n is a, c, g, or t
  misc_feature (855)..(855): n is a, c, g, or t
  misc_feature (864)..(867): n is a, c, g, or t
attccaattccactctcatctatgttactctttctacttcttgtaccttgctgcatttgctcttccccacttcaagatcctgaactagtggtcgaagatgtacaaaagtaggaaacaagtttttctcactatcaacattttttaagactgcatacatgtacttgtgtatttatttgagcatcatagtgaaaagggtaacaaaacttatgtcctattttattttgtttttattgcaggagcattaatgcctcaaggaggaacttagcatttctttcttgtgggacggggaaccccattgatgattgttggagatgtgaccccaattgggaaaagaaccggaagcgtctggcagattgttccattgggtttggtaaacatgctgttggaggaagggatggaaaactatatgtggtgactgaccctggtgatcaccctgtgaaccccaagccaggaacacttagatatggtgtgatccaagaggagccattgtggatcatnnnnnnaannnnnntccttnnnnnnnnnnncnnnnngntnnnccgccggggccnngnnnnnnnnnnnnnnnnnnnnnnnnncccnnnnnnnnnntnnttnnnccccnnnnncnnnnnnnnnnnnngtccgnnnnnnttnnnnnnnctttcnnnnnnnnnccccccccttnnnnctttctnnntnntttnnnnnnccnnnnncccctcnccttcctccccctttccnnnnccnnntnnnnntnnnnnntccccccttnnnnnncccctcctntcccccccctnnctcccnnnnncnnnnccttnnnntnnnnncnnnnnncnnnnnttnnnnccttnncccncnnnnnnnnnntnnncncgccttttnnnnttt

SEQ ID NO: 5663 - DNA, 369 bp, Glycine max
caccttcatcatattatccccttagacttttcttcacttaggaccttacctgattcgcatgcatggcctcaatctgaagatggtgatggtgatgatgataatcatggaattggatcatccatacccatcatagacctaatggatcctaatgccatggaactcataggccttgcttgtgagaattggggtgctttccaattgaagaaccatggcgtacccttgagtgttgttgaagaggttgaagaagaggcaaagaggctctttgccctccccgccgaccggaaactcaaggcgttgagatcggccaccggtgccaccgggtacggccgagctcggatatcgccattcttccccaagcacatgtggcat

SEQ ID NO: 5664 - DNA, 377 bp, Glycine max
tctgaagaggaggaggatagtgaaagttcagattctgagattgattcagagatggagagaattattgctgaaaggtctgggaagaaaattagtgggaagagaggttcttctagaaagaagggggatttggatgatgatggatccgacaaacattctggcgagaggagaaagagaggtaggtcaaagaagaggagtgctaagagggaagttagtgattcggatgattcaggtgaagaaagaaggaggaggaagagaaggcgggaacccaggaggaagagggacaattcttcagatgaagacgacgagtataagcgcaggcatagaaagagtaggaaggagaagaggagaaggagaagccgtctatcagatcctgattc

SEQ ID NO: 5665 - DNA, 334 bp, Glycine max
tcatgaaaagcagagaaaattgttttatcagcactacttcccttgggccattcctgctggcatgcaaaggactgatcttatgtgtgtatattatgagcaacattttcatgaagacttggaagatgttcgcagaaaattgcaaattgttcctgctcccactgttccttaaccgtatttggaccagataaattgtgctcgagttttgcaatcaaaattttggaataaaatccagtgtacaagctttgcctctgagatatagtcaatgagcattgtataggttggatttgatcatatgatcagtaaaatagacttttcatcacatattgtatttttt

SEQ ID NO: 5666 - DNA, 381 bp, Glycine max
gggtaatggtcttttgacatgttaaaaaaccatatttaattacgaaacataaaaacatccaccttcctctcttacgccgttctttgccctcatctctctctcgccggcgccgctacgaaggaaagcaatttactggtatttttctttcttttaccgtttttcagtgtctccttgcttcgctgaatcgcatcttctttcattcagttttatatgatgcactgatacaatacatgattattattggtacaatagactttgtttagttccgagcccttcttttgtgaacttagctggacagtaagaagggatcacattgattgcatgtcaaaagttttgaacttgatagagcaatttatggtgctgttcaatttgctttttttt

SEQ ID NO: 5667 - DNA, 340 bp, Glycine max
agcaagaaaagcctatatggctgctgtttcgatttccaaggaaaaacgagatgaggaatctattgctgctgctgccaatgctaggttacatcttcagtcacttgttttcaaatccaaaaattttaacctgtaatatcattgctagttttatttaatgtgctacatgttaggtccctttagtcaaaatggtgaggcacttatcttgtgtgtgagatttatttgtacaagcctgttatgaacaaatatataaagttatgccatttaatgtgatgaggtactaaacgagcatattcaatgaagtgaaaatgtgttctctcgcgggtctacctgcattcagaat

SEQ ID NO: 5668 - DNA, 811 bp, Glycine max
agcgctgttcccatggtaatgtatgcttttctccgagtgtaaaagcattatgttttcctttccttcttatttcatgtctggactgataagttttcgaccgtatatgtggttcagaattatgttcattatgagatttgtaaatttcacgatatctgaatttcgtttggttttaatttacatttttcatctgtgtgtaaacagagggtgtgatggcaggagccaaggctgcagttgttgctactattgcaactgccattccaactgtaagtactctttccacctgttcaattttctttggttcattcaattattttggacataaagttctcaagaatcaggatcgatttacatttgaaataaccacttcttaatattccaatagagattttctgtaaaaaaactaactggaataatacttgatcatatgcagctggctagtgtaaggatgctaccttgggcaaaagccaatctcaatcacactgcgcaagctctcataatttccacaggtaattactcatccatagtgctgccattatctcctaatatataatcattacaatcattgttcgaattagtcatctaactacaatattatgctaacagtggcaggagctgcatatttcatagtagctgacaagaccgttttggcaactgcaagaaagaactccttcaacccacccaccaatgcatgaattccaaatggataatttgaatgttgcattcggctgcactacattgggatatcttagcattatgacccaatattggaagttatcatatatgtaaatgtatttataataatatagtagaa

SEQ ID NO: 5669 - DNA, 1159 bp, Glycine max
tctcccactcctttcccttcaccctctctgggctctccctctgctgctccaccgtctccgccgccgccgctgccaccggtggtggttagcccttgtgctgcctgcaagatcctccgccgtaggtgtgtggagaagtgtgtgttggctccatatttccctcccactgatcctctcaagttcaccattgctcatagagtctttggagccagcaacatcatcaagttcttgcaggtaccatagcatgcatttaaaccaattattattattattgttgttgttgttgttgtttttaattgttgttgcttttaattgttgttgctttgtgtgtgaccagttcacacttcatggcatggcattttttcttgaaaggcaacaaaagaatgggttgaattgactctgatcattttagagaaacaaaataatgggttttggtcaaaagtgggagggaaagctagcaagggggcatacctaattgatgggcctgatgggttgttgttttctaacttcctaacacatcaaagctatgcatgattctctcttctttcaacactagctaccactactttcttttccatctttttgggaaaagaatgcccaagtcaaacatgttgcatactactacttatgtatcttttcttttctatcttccttggaactccccattctgaccaccaaggttaaacaaaacgttctgcaaccacaatttcagccacaatatcaaagttttttttctctctcaataatcgtaattgcgattatatctgttcacactttctcacaatgtcaaagattgtaagtttgtggcaaaactacaatagcaactgcaaccctaatttaaaacttgggttaccactatataagataatgctcaaaatttaggtgcccacatttggaaattatctttattaattttggttaaattggtgctgtactacccattatgaccagcatagcaccaattttctaaatttgtccaatttaaattaccaagggtttaatttatgttaacaacaatgaaattgcattgattttcaggaactgccagaatcccagagagaagatgctgtgagcagcatggtttatgaggcaaatgctaggatcagagacccagtttatgggtgtgctggtgcaatatgccaacttcaaaagcaagttagga

SEQ ID NO: 5670 - DNA, 579 bp, Glycine max
tatctgcaattcaaatgaatccatgatttcaaattttattttgctccaaattatttgaattgaaattatccaatagaaagaaagaggtgtattattaaatgattaactaatattgtgttagtctaaataaaactgggtttggatcacttaaataagattttagatttgaattttttatttgaaaaaaagattattgaaagaaaagattttaataaagatagtgaatcaagttctaaacaaagtcaacagatagttgatacttacaagatgaaaaaaaaaagttagagggatttacctttgcaggataggatcctgggaaaactaagttgtctttggattcattggggatccttaattgaagtttgtcatattcatccttatacatagttgtaacctgaaaaatgatttcatttatcaagaagacgtaaaaatagctgaaatgggctaagtagctttttatactttgaggccctgagtattaagtgtaaagaaattaaaatagaaatctcactccaaataagtaatgaggccctgagtattaagtgtaaagaaattaaaatagaaatctcaccccaaata

SEQ ID NO: 5671 - DNA, 366 bp, Glycine max
atacagttttcacacgcacatcatttgcataggaaccaaaattttcacacctcggctttttcatctgctgccatcattggatatgttgtgcggttagaaaacaccatttgttaatgcggtctccatggaagtctccgagaatagtgcctcttcctgccaaagcatacaatacttctaatctttctaaaactaccaagtatacatttgggcatagttgttggccaaatcttgcttttagttctagttcttctcacaactgccagtggagtgtatgaaaacagctctcccaaaaagccagctaatttgttctttccaacacactcttcttctctttcttcttcttcctcttcttcaatatggtgcttg

SEQ ID NO: 5672 - DNA, 375 bp, Glycine max
atttatgattcactataaatttccaacaacatgaaccttctggctagtaaattttaaatatattacctctcaactattttctttctttcctttcctctaattctattgcaatgtacaataaatatgaataaacgagattaattatggacttctccccgtgaatttttcctaatttgatgctccatttcaaggaaacatcgttgattcaatggtctgtagtttcctcatgcatcttcaatctgcataatgaactatctttacgtagttcattatatcatcaatctatgtcgcactgctacttccaaacgcaggactatcatcttgaactattacttcaactgggttttcctttgcccagacagaagcatctaaata

SEQ ID NO: 5673 - DNA, 855 bp, Glycine max
  misc_feature (744)..(751): n is a, c, g, or t
  misc_feature (753)..(755): n is a, c, g, or t
  misc_feature (797)..(802): n is a, c, g, or t
  misc_feature (806)..(807): n is a, c, g, or t
  misc_feature (809)..(815): n is a, c, g, or t
  misc_feature (819)..(820): n is a, c, g, or t
  misc_feature (823)..(826): n is a, c, g, or t
tcgcctgctgcaccgccgccgccgccgcgattaactcctcggaccgaaagcgaagagcgaaaggcaaatagagatgaacgcttgcaggtgacgtggcatctccaaacttacttttgatttcacttacccaaacccccacacagcagaacacaaattccttactctcgattcgacgcttctctccttccttcaacggcactttccactctggccaccggtaacctccctcttctcctctcagaatctgtaattctctcttattcttattataggttgaattttcccgaacggtctctctctgctcagcttctttcttcaatgtgtgaaaatttaattgtattgtgataataccgagttgtgttaaccgttaaatctgaattgcgaaatgctgacatacaaagcatgttaagtctgcaaattatgttaaggatcgataagggtgcaaataaaatggaggaataaaatttagaagaagtaaggaaatatagtgcacagtgagtgaaactgaaataacagttacacaaaatcacgcatcagtttttatttcaatgtgagaggcgtcagttttttatttttcttttatcaagtacgcattgttggttgtggacagttttgtttcacagcctaagacagtttttacccattattatccattataataactgtcttgaaaccttaactgcgacaacaacatggtgtttctgtaatgtgcaatgacccaattacttgttttccttgtattgnnnnnnnngnnngctactttctcttcttttgtctctgcatatcatttgctttcnnnnnnctcnncnnnnnnntganngannnntctacgtttgttctcatgacaactttttt

SEQ ID NO: 5674 - DNA, 796 bp, Glycine max
tcgaagcattggtggagatccgaggcgttaaagctcttgatgatgcaactgaaagagggcgaacaatgtttcttagggctcctgcaaatcccattctctctgcatgtaatagaaatgattaattcacgtgcacggcagaggccctgatgtacttttcctcttaagaatttcttagatacacatcaaatgaaatctcttcattggaagcactagaaagtgagcttctgagttatcataatatgcagattccaatcataattttacaggataataaacaacacaaatagcacaccaaagtcaaattcagcactaaacatgctgatttgattgggcatttgaaaatataatgctgtacctcaactttttaggaccaaattagactaattacgttttcaacatgacgcatcaaactataaatacattttatgtcccaattagaataataatgacacaaaatggttacaagcaatggcaactggaagcaggaaaagtgcggttaatttgagaaaaattacccgatgaaattcatattaaaaaaatatcaattcttagttgaattgacttattagttatttgcctggtgggtgaaacgtcgtgcatgactgagatgtgcagagcagaaacaaactgaccttcagaaaagaagtggtttaggctcaattgatgacaaaccacttacgagagaggcaaaaggcccaaaccagtggtgacggaggcgcaacggcggcggcaggacgacggtcgccaacgatgtgcgactgaaaccgcgatggtgttgagtgcgaccagggcacga

SEQ ID NO: 5675 - DNA, 739 bp, Glycine max
aagcatatatcgaacccaaagttctccaacccaagggcagttcttagttgccctagaataaacattgctgacaatattaccaacctagagaaagaagcaaaagggagaaaactccaaattagaaatttggacataggtaatggatgttgtaatgtgacaaagataataaaacaaaattcctatcccactaagtgaggttggctaacatagatcacatgatgtcattcggtttggttaaagaccaactcttcaaggatattaattaccataagatgtgacaaagatagtaacaaaagggaaaatttaaaaccttcaaagtgttgtccaaattgcgagtacaatccagccagagatcaggtgttataggaaagtcagtaatggctcgttcatatagaacttgaattctggctggcattccagaagactgctcaaatttcaaatagttctgcaatacaaatctcattattaaaaggacttacacatagtcacatactattgaacaataaaaaaataaaattctaggattctatctctgacaagtaaatagtcatattttgacttgggcttggaaacataccatgtagtgttgtaatctttctgaatctgaaatattcgggctcaaaatctgttcttcaagatgaaaacgagcattatacatctccaaggccttctggtatgaagccgcaacatgaggataaatatcaaccaaatcaatggattcaacatcttgaagacttcc

SEQ ID NO: 5676 - DNA, 1124 bp, Glycine max
  misc_feature (1118)..(1120): n is a, c, g, or t
cgccctttgatctgtcaagatgctgtgtccaagtttggaggaagaattgattggaaatctcgtcgaacccagagtctggtggaggaggtatgtatattgtttgaattgcgtttatgctttacattttttttatgattttgggtttgtttgtagcatcatttgcaaataacttgtgttgagaaaactggagaactactacattaagaacatgttattagataatcaaattacagttgatggtgttggtggcttgtgaacataccaaaagggttcaggttttcacattgttgcctaaatgaagatatttttccacggatgcgagtcataactttagagtactattttacaaatttaaatatatttttagtcccttaaaattaaaaaccctttttttagtcctctaaattaaaatatgtagttgttagtatcttaaattcgtgaaatgttttttttaatctctcgaggcattaaaaaaaacattccatgaatttgaaggattaaaatatataaattttaatttaggagactaaaaaagatagaccctaattttaaaggattaaacatatttaagcctattttataaattgatcctaatgttgaggatatttttccattgacccaagtcataacttaagaataatgcccagtaatggatcagaaagcaaaggtgttgtggtcccgttatagaaaaaacatgcaattacaattgaatgagtgtactgtgtactacttgcagagtgaactaataacttattcactaactcacttgtttcccattgctctggggcatgcataaaccactagttttactttttttaatttttttggctgaacagagaagcaagctcgtagaagactttagaaaggaagaaactgcagaggaattggaaaacactaagaagcttatagaagaactcaaaactagcttagaaaagatagaaaaagatgagcttcaagcaaaagaagaggctgaacgtgtgattctcaaaattgaagagatggagcaggacattgtaagtgaagctagtattgaagccaaggcacaacttgaggctgaaaaagccatgcttacagaagcgctttcggagtttgaattcgttaaaagagaactggactcnnntgcg

SEQ ID NO: 5677 - DNA, 342 bp, Glycine max
tcaccttctggtggagtggaagctagtttggaggttggtgcaagcacttcaagtaatgatccagagcacaaacaacaaaatccagagagtactgaatctagtcaagaagcaactaggacatcatcagattctctagaacttccattaagttcctctgattcagtaacactagaaagcagccggagtttagaagaacagaatacaccattgttagagaatgacaaacctcaaaaaaccagcgatattaaagaatttaggacatcattgatacagaatgacaaactacttgaaactaatgaacaaaatatagagaataattctgagtcccaatcacaacacagt

SEQ ID NO: 5678 - DNA, 1024 bp, Glycine max
tcttcttctgatcaatcattcatcactctctggttctgatttttctgacaccaaaatggtgaatcctcgaattccacgttcaaggatcccaactttcacacttttcacttctgctatctccatcgttctgtgcattttcttcgttctctcttttctcttcactgcccattcttattcctcccatcaacaccacaacgcggtaagcttatacttttacttaattttcaaccttttttatgttttctcccttctgtgatttttcccggagaacaaaaaaacttttattttttgcaatttcttgatttctggctttttgatttattgggttagtttaattcgaagaaaaatttggtgggatgggtttagatttggatcttattgtgtaggttcaaatgcgtcggatctgattctctcctgatccagtgagggtttgattcgtgcttattttcatggcaatgttactagaaatggaaaaagattgtgttttctattctgggaaagtacagagatttgattaagccaggttattaatctgttcttgtgctttggaactaggattgatttgttttaatattcctggcaaacaaacagggtatgatttgtcttgtaggctgggaaaatttcgatgaaaatgtcactgctagaaagggaaagtttgttattttgtttcctgagaaaggaacaatattgctgttgtgcttttgaaataggcttgatgcgagctaattttcttaggaaacaaacagggtttgttttgttttaatttgatttgtgcttgtggtgtggaaatttttcaaaggaaatgttactgctagaaagtggaaaagtttgttattttcttcaaactgttttcattttctgagaagaaaaaaagatttgatgatgttaggttactaatctgttgttgtggtggtgaactagggttctgacggtggtgttgcacatggatttgagtcgattaggagatccgtcctagctctgaaaacagatcctctcaagcctcggtggaccagattcgtaaact

SEQ ID NO: 5679 - DNA, 426 bp, Glycine max
  misc_feature (399)..(405): n is a, c, g, or t
  misc_feature (408)..(410): n is a, c, g, or t
  misc_feature (414)..(416): n is a, c, g, or t
  misc_feature (421)..(423): n is a, c, g, or t
tcgaatcgacgcgatggagtttctgttggcgcgctatgatgacgagctagaggtggatgtggtagactccgaggggaggaaaacgatccacgtggcggcgagggaggggcacacgagggttatccagttctgcatcgcaatggaggaaaccctaatcgcatggattcgaaggggtggaccccactccactacacggcatggaaggggcacgtgaaggccgctgagtgtttgttggaatgctccaacatgaagtgcgcgagggatagggaggggagaatggcattttctgttgtagcagagagtgagcacgaacaatctcacgcgcgcacgtgcttggtcgatttgctgggttggggcgacacgctgttgcgtgcggtgagagttgacgatgttcacgannnnnnntcnnnccannncttcnnnccc

SEQ ID NO: 5680 - DNA, 460 bp, Glycine max
cattaccactagctcacccgctgatgaccctggttccttgtaaatttgtcctgcaacgtaaaaccatacaagcgtatatatattattaattcatagtcatatacataataacatgcatagtactttaattagtgtttgagtatgcgaatatgtatatatggtagagagtacagacgcaaagcaagggcagagccttctccagcaaagacaaagatgcaagtggagaggaattcagccaaggcagctctgatggagtctgggtggctagcctcattcatccttccaaactcatatcttcgagttgccatatccctgatcaaatatacctttctttttcactttcccttgatgttgtgctaccaattgagattgtgatcaatgacccagttggtcttaatttcaagacggttgtgacccggatccagttgagttgagagagcttacgcgattcacaagatta

SEQ ID NO: 5681 - DNA, 352 bp, Glycine max
cccttacctttcagcttctcttccgttatgtcacccaaagacttgcgcttaacgcaattcacgcgctgcccagcaacgtaaatcttgaacacgaccccgccgtgattcacgaactcttgcagcaccatgggaacgctcaacgcgtggagtccctcctcgtcgaaaaccaaacacagttcgtgagagccggcgccgccgtcagccgccagcggtttcgcaatcaccgggaaccgcaagccctgttcttcttcgaatttgtgcaaatcgaaggatttgggttcgttcacaaccacttgctttggaaccccaatggtggcgttttcgagggaaaattgtaagtgggtcactgcgt

SEQ ID NO: 5682 - DNA, 377 bp, Glycine max
tcaaggagaatttacctacagagaatcactggcacttgtttacctcataaatgtctaatagcattaatttgttcagaaattcagatgatttatttaacattaccattctctggtttggtgccggatttatggataggttgagcatactggaaaacctgcaaagtcaatacttgttttcaactgtttggattaatgagcagaaaaaggtgatgttgattgccctgcctttggttactacgtttttacctcattaaagctctcgtttcattcaagcgagcatatatatgcaagttgttgcctaagtgtaaagcgtttcaagtgtacaaagcgtacaaactaattgaggaaataagccacttcacatgctgtccgatgtt

SEQ ID NO: 5683 - DNA, 565 bp, Glycine max
atattatggaattagtcaggtttgctgtgcctaacggtattccttggtatattgtgattactcatacaataaactaagttgaatgacttctgccttttcaggctagtggggcaaggataaagatatcagatagaggtgattacgtatctggaacaaccgataggtaggaatttgttcactaaaaaaatttgcttgctttataccccagtataacaaaaatcattaagcaaatgacttgacataatatatttgacggtaaatgttttatgtgtttctatttttttattacaggaaagttaccataacaggatcccagagagcaatacgtacagctgaatctatgatattgcagaaggttgcttatgctaccgagaggggggtgatggagtagtttgctactgcacttgtctgctgttagatgcttaatgaatctgcttgctaattgcttatacatttgctgaattttgggatttgtttgcataaattatcatcacttattatacctttgaagatttttattgtagcgggagagggcaggaattttttttttcttgaattgagagcg

SEQ ID NO: 5684 - DNA, 1201 bp, Glycine max
  misc_feature (350)..(350): n is a, c, g, or t
  misc_feature (775)..(777): n is a, c, g, or t
  misc_feature (814)..(816): n is a, c, g, or t
  misc_feature (997)..(999): n is a, c, g, or t
  misc_feature (1030)..(1030): n is a, c, g, or t
  misc_feature (1081)..(1085): n is a, c, g, or t
  misc_feature (1089)..(1091): n is a, c, g, or t
  misc_feature (1094)..(1094): n is a, c, g, or t
  misc_feature (1106)..(1109): n is a, c, g, or t
  misc_feature (1118)..(1125): n is a, c, g, or t
  misc_feature (1129)..(1133): n is a, c, g, or t
  misc_feature (1148)..(1148): n is a, c, g, or t
  misc_feature (1171)..(1172): n is a, c, g, or t
  misc_feature (1174)..(1186): n is a, c, g, or t
  misc_feature (1189)..(1192): n is a, c, g, or t
acgtagtaccttgaactgttattattgagaaaaagaaagcttagttttgtcaaggtgtagaagaggaaggatatacaagatataggatgatcaaactctacaggttgtgtgtataatcctacataaggcaatgtcccacactaatttcaaggaggggaagaaaaagaaagacaacaaaaaaaggtaaataatctatactcggacggtctaatcacaaattgacctgcatgataaattaattaacttttacaataattatcttaaaagtcatttatcattatttcttaatgattgatactgacagtgtacaaaattttgcactgataatgcatataaatgaaactcaaatnaaatttctccaagaaatcatatcccactcccccacggcgcacgatagcacctgcccccgttcccagctccagaaactgaatcccgagcccatcgcatggatcatggactcgcacacacccgaatccctctccaccttcttcaacctcgtcttcaccatgcgcctcttctggctctgcgcctgccacgcgccccccgaagccggctccctctacttccactacctcctcgcccccagcctccaaacggcgtcgtccaaactcgcctcctccgtcctccgaaccttcttcatcaccgtgggcgtcgacaccgaactctgcttcatgcgcaccctcggttacatcattacaaagcttcacatgatcaaagaactcagcgttggattgggcttaaaaacgatttttccttctcccagattctcttacgnnngacaacaaaaaaaggaaaataatctatactcggacgnnntaatcacaaagtgacctgcatgataaattaattaacttttacaataattatcttaaaagccatatatcattatttcttattgattgatactgacagtgaacaaaattatgcactgataatgcatataaatgaaactcaaatgaaaaatgatgacattcatgataacaaccaaacccctctnnnaaaaaatacatattgagagaaatgttagcancaattctctctctttataattggctgaaattcattgaaaaacgactcccannnnngaannnagnccaacccaaaannnngattaatannnnnnnncagnnnnncacagaggatgattnaaaataaagtgttacagagatcnncnnnnnnnnnnnnnatnnnnaaaaaaaaa

SEQ ID NO: 5685 - DNA, 385 bp, Glycine max
aagactgtttatgaaacattggtttctgtgtgccaaagtattgtctgcaagagtagtcagtttggtaaatgttatctaaacagacacttgacaattggatgcagttcttgggattttgatcagcagagtctgatgggatggtgtcagtgagtgtttttattgcaaattcaatgcatggatccatccatgacatgtcaagtgtcttttcagaagatggtcctgcattctcattcttggcctttgaatcagttttgtcatcaccggcatgttcttttggaatagcaaggttctctagagatgataacacacggtcacctaatccatcattgcttttcttatcatcgcctttgccactggcgagggtgggagcagaagttttggaatg

SEQ ID NO: 5686 - DNA, 403 bp, Glycine max
ctcaagtgttctatagctggggttgcttatggacgaggagttactgaagttgagagagctctatctaggagacatgaatcacatccaggccaagagttgaaaaagattagtgaatcaaagtcatccattaaagggtttaactttatggatgaaagggtcatgaatggaaattggatcaaagaacccaatgccaatgtaatccagaacttcctacggttgctggctgtatgccatactgcaatacctgaagttgatgaagaaactggtaaggtttcatatgaagctgaatcaccagatgaggcagcttttgtgattgcagccagggaacttggatttgaattttatgaaaggacacatacaactatttcactgcgtgaattagacaccatatcaggccagaaaa

SEQ ID NO: 5687 - DNA, 1025 bp, Glycine max
  misc_feature (19)..(19): n is a, c, g, or t
  misc_feature (999)..(999): n is a, c, g, or t
  misc_feature (1004)..(1012): n is a, c, g, or t
  misc_feature (1017)..(1022): n is a, c, g, or t
gtagctcaagggcctcagncctgttgtaatcctcttgccctaaggaagataatggaaacaaatacaacataacaacctttttcttttgacaaatatcattctatcagccaaaccagaaaacaatccccatcatcattcatttgaacaaatttgattgatacgtcctgtggtttattgaaattgcactacctttttaagatttacactttgcaataactcttcttatggggatacatggtgtaatgtatttcaaacaattaagagaaattactatagcggctaaaaaggcaggagtattgtgtgctatctcaagaaaccacatggggtgtcactataatttgtttgtatttttttttaaaatgtttgtgtataactgaacaccaaccttaaaaaaaaacactataacaagtttcataccagctgtatcccaaaggcctaaattgacagttatgccttcaacaaccacatttgcactgaaattatcaaacacagtggggatatagtcctgatgatcaacatagggggaagcaaaatcagataaacccaatggtgaagcttcacaagataacaactgggttactttctgcacttagcacacacataaaacagttttctttactcaaattaagatgatttcaacagaacagagaaaaattcagaaagcacacatacacacacacacacacatagtggacattacaaaacaaaaataacatcaaacgatggcaattcaataaaaaaatgatctcttgaaaacaaaagatgtggaagaaagcatccacaccgtggggaatttgttgctggtatagcaaatgagcatgcaggtcttccctacagctccatcgccaacggtcacacacttgatgaatcttggggcagttgcagcagccattggaacaagaagaaaagaagaaactttctcagaataatttaagcaaaacaaaacagaagtggggttgttttgttgtgtgttggattgttaaagattgaagctttttntttgnnnnnnnnngggannnnnnggg

SEQ ID NO: 5688 - DNA, 404 bp, Glycine max
tcaccctccgatcccgctcctcctccacgagacggcggaggacgcgacggtcggcggttacctcgtccccaagaaggcgcgtgtcatgatcaacgcgtgggccattgggagggacaagaacagctgggaggaacccgagagcttcaagcccgcccggtttcttaaaccgggcgtgcccgatttcaaagggagcaacttcgagttcattccattcgggtcgggtcgcaggtcctgccccgggatggtgttggggctctacgcgctcgagttggcggtggcgcacctccttcactgcttcacgtgggaattgccagatgggatgaagccaagtgagatggacatgggtgacgtgttcggactcaccgctccaagatccacgcgactcattgctgtaccaaccaagc

SEQ ID NO: 5689 - DNA, 380 bp, Glycine max
gagcgaagaaggctatacgaggagtggggcattgcattggattcaaagcgcaggagggtgcaactagggaaccgtttatggagcgaaaatgatatgaaccacgtaatgcaaagtgctacaatagttgccaagttagtgaggttttgggaaagaggcaaggccctcaaggagatgtttggccttagcttcacaccccaactcacggggcgaagatcatcttatccatggaaaaatagctcaacatctcttttatagtcgtttttattttttggccctcacgtgtacagtgttagagaaattttatcagagtttctgattgatgtatgcctcttcgttgagatgagagatgtatgagttcttcttgattgggcggttgtatt

SEQ ID NO: 5690 - DNA, 660 bp, Glycine max
ttcgaacgtgtgagtccacccaggcacgtgccttcaatccgtcttaaatcccttgccattttttcttcactcacattgctcctcacagcacgacttgttcaccgatcagagctgattttcgcggctgttaccggtcaccggagattctatccgaaatcgttttccgatgacggtgagttttcgtaacaccgcctctgtctttcgcacgtctattctacgaattttttcgaaccgtcaaaatttctgaaattattattaggctttttctaccgataaatttatctcacacagcagcgagtgtattttctgaatcctttacaacatatttgattgtttaatttctgtattttgattgctagcgattttttgcgtttgcttttttaggcatgtgaacctgagggactcataactgttgtgctacacgattagtgaaattagagaacgttttgctaatgctgtgagtgaagttaattgtttcatgactgatactcaaagttcgatatcaaacttaaaaccaaaacacactcggtgtattgttgcttaaacaattcaagtgaatagaatcagtaagtgagaactatgtaaacatggtaataatttatagcttacagtccttagtgggataaggtggttgttgtcgttgttgagggtttcggtgaa

SEQ ID NO: 5691 - DNA, 510 bp, Glycine max
ctaaaggtaaagggtcaactccaactattgcaagtgataagctggggaaggctgttgatgctggtgctcatttgtcaaaccaaccccgaggtttaattgtctctgggtagtgtgtagcctgtactcaatttttgcactgtttctcatctgttgtcttgtttttctattcagtttcccatttaatggagtccatcgagaaagattatgtctttgtcaattcccatttcgcatcattggaggctttctctgactactttgaagcatctgtgcaagatagttcctcgcacaggatttctctgtttccttcaaagaggactaatatggaggttagagatgcaaaacaaacaaaggatctgccctcttcctccactgaaggattagaaaatttaaaaagcaataaacttgaggcatgtgcagcttcctgtgaatttgctgccttaaggaaagaacatcaaatttccccactgcacccttcaaacaggttacagttgttgcatcagtatgtgcaga

SEQ ID NO: 5692 - DNA, 979 bp, Glycine max
  misc_feature (917)..(920): n is a, c, g, or t
  misc_feature (956)..(957): n is a, c, g, or t
atcaattttgctatccctttatacttgtgttttttttatacgttcaaagattgtagtaaagttcttgacattgctaattttgttttgtctgaagctcattggtcacaagagaggccggttggcgatggaagaagaggacgatgaccaacccaaaaagaagattcgtataggtttgccagcatcccagtggataagtgtttacaatgctcggagaccaatgaaacaaaggtatagacccatgttacatgaagtttgttttgtcatatatatgattctattttaggcattttaaattgatccatagggtcatagggatgataattgatcatttccccatccttgagattaagggtggagagggtgattcttcttcccataccatctcgtggaatctgttttacaaccttttgtgtgtatttgttgcatattgtatgtttgactttggatttaagaattatccattttttgaagttatcaatgtaacggagttgttgtgcatttggaatgattgtgttttattttgtagatatcactacaacgtatcagatacaaggctatcccagcacatcgagaaaggaaatgaggatggcttatatattagcggtgttgcttcatgtcagaacctatgggcgttaatcatggatgcagggacaggtttcactgcccaagtttacgagctctcacccttctttctccataaggtaaatttcaatccattgcttttatttttctatttgtgtattgtttagaagacatgcttgctacacactttccaaccaacatacaattcacccaataatgaagaggtaagtgtgtcagaaagtatatagtgagcattctcatgttttctgcttacatgattgtagtctgtagatctgttaatatataatctcaaggcatgcttattaagggatttnnnngtttggtttacctgaaggaatggatcatggagcacnnggaaaaaaattactatatcagt

SEQ ID NO: 5693 - DNA, 363 bp, Glycine max
tctgtatctcagcgtccctttccgaccagaattcccggtgaccgcaactccctcgccgccgctcattttagacctcaccgccgcgtttcccagcgagtcgtaactcgcagccgccactgagaatcccatttcctcttcctcctcttcctcttggtcctcgtgctcgtcaaattccatatcgctcaccacttttttttttttttttaaaaaaaaaaaaaaaaaaaaaatttttgggtttttttgggtttggggggattggttggttcgggggggacggggaaaaaaaaatcaaaaaacaaaaattttatttgaaaaagggaagggggagcaattggagggggaaattaaagggtttcgcccccc

SEQ ID NO: 5694 - DNA, 450 bp, Glycine max
gccatggcatatcattggaatgaaaatcgatattgaccatggcatatcaatgatttggaccatttcttatcccaatcatgaggcaacctgtttatcagttgctttatagtaaagcatcttctgtacatagaacatcatgtaacactgtgcagccctcacaatgttctcatctacttgagtaacccaggcatcatcacacttgtaccactgattacttaatcgcagataagtgacataatggccagcgtctagcttaccactgtgcgtgacaacggcaaacaactcaaactctgaacacaactcatctgaagcatccggctcatccccatcaaaaggaaagatcctattcccaaatcgattccttaaaattgttgatgatagataaggagacatgtccagtgaaaatgggaactgcaggtagcgatccactttccttgacatctttcttga

SEQ ID NO: 5695 - DNA, 895 bp, Glycine max
ctttccctgacctggcacttggtgttggtcgccacaaggattccagtgctttaactgtgcttgcccaagatgatgttggaggattacaagttaagagaaaatcagatggagaatggattcctgttaaacctaccccaaatgcatttattatcaatgtgggggatatagttcaggtatgttattagtacatgattttgttaacatcaactcttgaagtattaccctttctcctaaatggtccctaaagtcaaaaaaatacttaagtagtcaagtatttgaaatcattctaattagtcttccaaatgtaaaagaatccttttcaaattggttcttaaactttactcaaatatgtcaacttaaggactaaagtgatacatgttcaacgctttggagattacttaaaatagttttattactttagggacaacttaagagagaggataatactttgaggacgaaattggtgtcaaaatgtactaaatgatttgtttcttttccacaaaataatattctattattagtttcttaaaattagtccttcataggctgatgtgaacaattactatgtaatatgctttagcttgaatcatcaattgaggacaatataattggttcaatctaaatgctttagctttactccttcatggttgaattggttcaatctaaatgcttaggccaatgttgggggttacttttgcaggtttggagcaatgacaagtacgagagcgtggagcacagggtggtggtgaatacagaaaaggaaaggttttcaattccattcttctttttccctgctcaccatgttatggtgaagcctgccgaggagctggtaaatgagcaaaatccagcaagatatagagaatacaagtatggtaagttctttgccaacagaaac

SEQ ID NO: 5696 - DNA, 384 bp, Glycine max
tgaatgttgcaatcctagattgaatatataagggaatggaggatattgactccatacctcccccctccccgaaagagaaagaaaattcagattgatgtataacaggaaaatgcaggggggttccattggctaaaagattttgtagttgttctgtatccaaatcatcgtgatccatcaaatattcagttgtagaaaacctagtctgggttgcaagtttgtagaggttttatgttgatgttctgacgtttattcaagtgttcattgtgttctaggtcattgccattgattgacttctggttaatttctgtgccgggttggtgctgaaatgtgaatctggaccctttatcagttgattgcttaatacacaaatgatgcttgatgccc

SEQ ID NO: 5697 - DNA, 1351 bp, Glycine max
  misc_feature (668)..(676): n is a, c, g, or t
  misc_feature (678)..(680): n is a, c, g, or t
  misc_feature (683)..(687): n is a, c, g, or t
  misc_feature (695)..(695): n is a, c, g, or t
  misc_feature (697)..(697): n is a, c, g, or t
  misc_feature (703)..(720): n is a, c, g, or t
  misc_feature (722)..(722): n is a, c, g, or t
  misc_feature (725)..(726): n is a, c, g, or t
  misc_feature (729)..(737): n is a, c, g, or t
  misc_feature (739)..(739): n is a, c, g, or t
  misc_feature (746)..(757): n is a, c, g, or t
  misc_feature (760)..(760): n is a, c, g, or t
  misc_feature (762)..(762): n is a, c, g, or t
  misc_feature (764)..(768): n is a, c, g, or t
  misc_feature (773)..(773): n is a, c, g, or t
  misc_feature (776)..(796): n is a, c, g, or t
  misc_feature (798)..(805): n is a, c, g, or t
  misc_feature (807)..(821): n is a, c, g, or t
  misc_feature (823)..(831): n is a, c, g, or t
  misc_feature (833)..(840): n is a, c, g, or t
  misc_feature (843)..(849): n is a, c, g, or t
  misc_feature (855)..(864): n is a, c, g, or t
  misc_feature (866)..(885): n is a, c, g, or t
  misc_feature (887)..(892): n is a, c, g, or t
  misc_feature (896)..(899): n is a, c, g, or t
  misc_feature (901)..(911): n is a, c, g, or t
  misc_feature (915)..(930): n is a, c, g, or t
  misc_feature (932)..(939): n is a, c, g, or t
  misc_feature (941)..(959): n is a, c, g, or t
  misc_feature (961)..(968): n is a, c, g, or t
  misc_feature (970)..(972): n is a, c, g, or t
  misc_feature (975)..(979): n is a, c, g, or t
  misc_feature (981)..(988): n is a, c, g, or t
  misc_feature (990)..(999): n is a, c, g, or t
  misc_feature (1001)..(1006): n is a, c, g, or t
  misc_feature (1008)..(1020): n is a, c, g, or t
  misc_feature (1028)..(1031): n is a, c, g, or t
  misc_feature (1036)..(1049): n is a, c, g, or t
  misc_feature (1057)..(1057): n is a, c, g, or t
  misc_feature (1059)..(1069): n is a, c, g, or t
  misc_feature (1071)..(1075): n is a, c, g, or t
  misc_feature (1077)..(1110): n is a, c, g, or t
  misc_feature (1119)..(1120): n is a, c, g, or t
  misc_feature (1125)..(1126): n is a, c, g, or t
  misc_feature (1128)..(1147): n is a, c, g, or t
  misc_feature (1149)..(1164): n is a, c, g, or t
  misc_feature (1167)..(1171): n is a, c, g, or t
  misc_feature (1175)..(1183): n is a, c, g, or t
  misc_feature (1185)..(1199): n is a, c, g, or t
  misc_feature (1201)..(1202): n is a, c, g, or t
  misc_feature (1204)..(1208): n is a, c, g, or t
  misc_feature (1210)..(1221): n is a, c, g, or t
  misc_feature (1223)..(1223): n is a, c, g, or t
  misc_feature (1225)..(1225): n is a, c, g, or t
  misc_feature (1227)..(1231): n is a, c, g, or t
  misc_feature (1238)..(1240): n is a, c, g, or t
  misc_feature (1242)..(1242): n is a, c, g, or t
  misc_feature (1245)..(1245): n is a, c, g, or t
  misc_feature (1247)..(1252): n is a, c, g, or t
  misc_feature (1254)..(1260): n is a, c, g, or t
  misc_feature (1267)..(1267): n is a, c, g, or t
  misc_feature (1271)..(1282): n is a, c, g, or t
  misc_feature (1287)..(1288): n is a, c, g, or t
  misc_feature (1293)..(1294): n is a, c, g, or t
  misc_feature (1296)..(1296): n is a, c, g, or t
  misc_feature (1298)..(1301): n is a, c, g, or t
  misc_feature (1303)..(1303): n is a, c, g, or t
  misc_feature (1305)..(1305): n is a, c, g, or t
  misc_feature (1307)..(1309): n is a, c, g, or t
  misc_feature (1314)..(1329): n is a, c, g, or t
  misc_feature (1334)..(1335): n is a, c, g, or t
  misc_feature (1339)..(1340): n is a, c, g, or t
tcggcggtgaatcgttcgagtccaccgccatacacaccgaatcaatttcttcggagatcaatttccccttttccgttttggattttcttgcgttgcctaatttctcggcaaccaaacagcttctacaacttccatttccattccgttgattttgccgcatctccgatcatggaagctcctgacaactcagaagccaccgttccatatgtacgaaactcctctatgttgcttttttttattcttcttctttatttttgttattcgatttcattttaacttagaatttagttgaactattcggagtgtggataacagtgtgcaaagaatttgaataaagaaccctagacttttcggtttatatgatagttgtgtaacttatcaatttggtagctgcaatgatttggttcatttagcactcaattggcggttgacaagaacagaaaaagacttttaattttgaagcatctctacaaaatgatgatcaagcctctgtatgctgattacagttaaaatcaacagaatagtgaagaatatgagaataccttacttaatagcaccaaataaaacttgtctaatccgaaattgcaatgttgaaattgttaaatctgagtgtggattttgcttttctgttttctagatgtttttttaggtctcaccttaggtgtttnnnnnnnnntnnnaannnnncccccctncnacaaannnnnnnnnnnnnnnnnnancanntcnnnnnnnnnantaaacannnnnnnnnnnnaananannnnncaacncgnnnnnnnnnnnnnnnnnnnnncnnnnnnnncnnnnnnnnnnnnnnnannnnnnnnnannnnnnnncannnnnnnactcannnnnnnnnncnnnnnnnnnnnnnnnnnnnngnnnnnnaccnnnnannnnnnnnnnnaaannnnnnnnnnnnnnnncnnnnnnnncnnnnnnnnnnnnnnnnnnncnnnnnnnncnnnttnnnnncnnnnnnnntnnnnnnnnnncnnnnnntnnnnnnnnnnnnncaatttannnntccgnnnnnnnnnnnnnntcctcttncnnnnnnnnnnntnnnnnannnnnnnnnnnnnnnnnnnnnnnnnnnnnnnnnnggtatcgtnnccccnntnnnnnnnnnnnnnnnnnnnnannnnnnnnnnnnnnnngcnnnnnaccnnnnnnnnntnnnnnnnnnnnnnnngnncnnnnncnnnnnnnnnnnnanancnnnnntgctccnnncntcntnnnnnntnnnnnnnacccatnctcnnnnnnnnnnnntcgcnncccgnncngnnnncntncnnncatcnnnnnnnnnnnnnnnntgtcnnaatnncttttagtctt

SEQ ID NO: 5698 - DNA, 936 bp, Glycine max
ggtctaatcctttcaaattccgtgcttcggcttgacatcggtcagttcctttcttcttcacattttctattttttgctttcttttgtgtcagtattatgttgcatgtgttatttgcggactttatgtatgttagatagatggttactttgttttgtaatctctctattttcctcagtggttttgatagtgtagaaaatggttcaactacttatgtgcctcttgtgcagttatattgtaacatgtgtgtgttcaatttgggaatttttttattactggtttggtggttccaaattttactgccgagtctttgagaatattctcattttgttgtgaagccaaaacataaggtcttagggtcactgttttgtcccattctgtgacacgcattagctgcaccagttcttgctgaaatacggggttatgatcccctctcctctctagtaatcagctttgaagcaacttaggtcttagcttagttgcatagcgtttatgttcagtttctgttcttttctaacagtatgttgcattcccttcattttgaagtgtttttttgtgcatgactggtgtcatttatagttacctcttttaattttaattattacccttttcggtttcagatttctctgcacttcccaaagaattggttgtgcagtccttgttttcagacaccgtctttaagttactgtcgacgtttgagttctataatgcccagtgattcttctgtaatctccaatggacacagcaatggcagtgtcaatccactacctaacctgcaaaggacttaccaagtggtagtggctgccactcaagattggggcatcggtaaggatgggaaattaccctggagattgcctactgatctcaagttttttaaggagatcactatgaaaacatctgatcctgggaagaagaatgccatgtaatggaagaaaaca

SEQ ID NO: 5699 - DNA, 359 bp, Glycine max
tgcttgaatcccaagccttccaaacgccctcctatgaggcatgtcctgaaagcattggaaaatccattgaagattgtgagagaagaaaatactagctcagcaaggttgagatcaaactcttctaggaaatcttggagcactgcattctttggtagctggagacacagctcatcagacagtgttgttgccacaaacaaagagggttctagtgacactaaaaaatcaggaaaagtaggttctcaaagtagtggaaacgatcactcttcttccaataaaagatcgtccaatgaaattttccccgaaccattggaaatactagatgtggagacaggagtggcaagataagcacttgtgaaatg

SEQ ID NO: 5700 - DNA, 711 bp, Glycine max
tctgctttgtttttaggtacttgcgagtagcgactccctaattttccttttatatgctatgaatcatatgaaagaatgaatcaaaaatcatttacaacatctgtgttgagttagtagtttgtgtgatatggggacagtctgtttggacctttacaagcacgcatgttacttgtggttacttatcttcctaaaggctttcttaagtttaaatacgtgttgcaatttccatgtgtattgatacttgaaatttcttattaaaagatttctcatttcaaataactcttaatcatcatcttcaattcctgttttcgttatgtctacctttttatgatgctgcatgtaggtctcatattggccgcaacaggaaagttggaagcgtatattagtaggcagaatggaagttgatctacgatttgttactagaaggctcactcctacaatatttttctagggtaaactggtactccaaagggaagataattggggagagggaagggagtgggaactgaaggaggagataaggagaatcatggaatattgtacgtgtgcagctgcccatgcttctctagcttggttgccgagtaatattagttgcacctccacattcattgttttatcatcagaaaacctcacattaaaattcttttatattcatttaatagtaagaagatgctaaaggaggttgcaaatactagtatgtcttcacctgtg

SEQ ID NO: 5701 - DNA, 408 bp, Glycine max
agcttcgactcaagtcaaaagcattacaaatgagttgaatgcgttgcggcaagaagtggagtccctccaacaccagaaattggacttggaatttcagttagtggaaaaagtccaagaaaattctgagtatgtgattcaaatgcaaactctgaaagaggaaattgacagaaaaatcctggaacaagagagacttctggaagacaaggaaaatttagccatgaagctaaggaccctggaattagagatgaacactataaagaataaaaacagtgaagctgaagagcaaataagggctaaaagccatgaaatcagtcacatgagtaagggaatgctggagctacacgaaaaaatagcagaaatagagaaaatatcaacagatagagaatcacatttctttagttctccagg

SEQ ID NO: 5702 - DNA, 385 bp, Glycine max
tgggaaagggtggagcaaagaggcatcgcaaggtgctccgcgacaacatccagggaatcacgaaacccgcgattcggaggctagccagaagaggcggcgtgaaaagaatcagcggcttgatctacgaggaaaccaggggtgtgctcaagatcttcctcgagaacgtcattcgcgacgccgtcacctacaccgagcacgctaggagaaagaccgtcacggccatggacgtcgtttacgcgctcaagaggcagggaaggaccctctacggtttcggaggctgagggcttgggctttttctgggcctggatttgttcttcgctgggctttaaaatgttgttgggaatttgtgttttgtttaatggttatgtatattatcttctgctcg

SEQ ID NO: 5703 - DNA, 1022 bp, Glycine max
tcacgatttgttccttcctctgagcaggaaatgaaggctaggatatgaaaaagctaagtctaatcctggctatgctcgactccaacagaatgctaaggtgcttcattctgagcttttctacttgtttttgctatctagtagatattctcattcaaatttctgagtgttaaaatggcgactgtgcttatcaattttttggcctgaccttcacatttggtatgttaataggttattggtacatgggatgatcacgattatggattaaatgatgcagggaaagaatttcatggaaaaataaccaaccaaaagttgcttcttgatttcttggatgaacctcaagatagcccacggtgggtggataatctcttttgctgcattatcatgtcgggcgtatctgtattctacagcttgggtgatttgatttacattcttttaagaatactagtatataaatgaatcgttctcttgattccaggggttgttttccaatattatgagacatatgattatattggctggggaacctcatttttttcttggagagtgaagacatgtttacgtgtctggctaatatacgtattcacccattaatagattttaatggcaacagatacatatttagattttagatacttactctagcttctcatttcaggcggaaacaggctggtgtatatgcctcatatacgtatggtcctgtaggtagagatatcaaggtattgatcaaataaaatatatcttctttgttaatttcataaagtcctttcacgattattgtgctgtggtaggatgtaaccatgatcatcttaaatgtcttttgatggttaagaactcattttgtttttgtcaataattaaggcttgagagttgcttttaaattgtgtattagcttttaagcatgtctcttgtgctaatatttgcttttactgtggattggggaaaactattcagattgtcctcttagataccagatatcacagagaccctgtaggaagtgatggaaccattttggggaatcacaa

SEQ ID NO: 5704 - DNA, 375 bp, Glycine max
cctatgaagtcccctagccctctacactgcacaactcctaccacccttttggatgtgttgcaattattaccatgtcttcctctccaacccttcaccactctcatcacactgttatgctgttttgtggctatgaaactgttcctcattgtctgatgaacaacattgttgaagcaggttggacccccataacccaagctagcagtggatgacattgttttttctttttttcctaagtattattttggtcacaaaatgtgagagcttattgaagaatgagatccatggttttttttttttttttaaaaaaaaaatttgggggaaaaaaaaagttggggaaaaaaataaagggggggaaaaaatggtggggttaaaaaa

SEQ ID NO: 5705 - DNA, 353 bp, Glycine max
tagtgtgggaaaatggcacttcccctacctctaaggatgtatcaaatccaacaaattattctaacagcaaaccaggaaatcaacatgctgttgctttaggagctgcctctgcaccattgaggaacccgaataacctaaaatcccccacggagcggaagccaacttctatggatttgaaattaggttccaatttggagaagaaacattccatctctcaagtgcagagccggaatgatttcttcaatctcattaagaagaaaacattgatgaactcctctgcagttcttccagactctggcccaatggtttcatctcctgccatggagaaatctggtgaagtaaataggggagta

SEQ ID NO: 5706 - DNA, 398 bp, Glycine max
tgaccgtccatgcctcatcgacggcgacaccagcgaaaccctcacctacgccgacgtcgatctctccgctcgccgcatctccgccggcctccacaaaatcggcatctgccagggtgacgtcatcatgctcgtcctccgcaactgcccgcagttcgcactcgccttcctgggcgccactcaccgcggcgccgtcgtcaccaccgccaaccccttctacactccggcggagctcgcgaagcaagcgatggccacgaaaaccaggctggtcataacgcaatccgcgtaccttgagaaaatcaagagtttcgcggacgacagcgatgtcatggtgatgtgcattgatgacgattattcttctgaaaacgatggcgttttgcatttctcaacgctcaccaacg

SEQ ID NO: 5707 - DNA, 354 bp, Glycine max
  misc_feature (5)..(5): n is a, c, g, or t
ctccngctatatatgtacatgtttattgtattcattttatcttatatctattagaagctttgtttgtcctagcaatctggctttgacctttgtcacaatttacctatatgacacagtttttgtgtagcagtttaggttgagtgactccattatcaataatctaattgatcgaatacatgtttttagttcattaaactgcttgattatcttgagtttcacgtgaatcttagattgtttacaactatatatgttgattgttaacacttttccacttcgtgcatgttacaaattttcatgtatagcattggctaggatgtctactgagtatcttatatatggattttttttaaagga

SEQ ID NO: 5708 - DNA, 553 bp, Glycine max
agagcggagcagatcagttgataggtattcattcattgttagctagctctttcaactgtgttttttcccaattattgttattatttgactcctacattgttattctctgtagccgctcccctgcacgacgcagtcctagtcctcgaaggagtccctcccctcagaggagcacttcccctcaaaggagtacttcccctaggaagagtccacggggtgaaagtcctgcaaatcgtagctgtgaggaacgttcccctacccctcgcagtgtctcaccacgcggtcgccctgatgcttcacgaagtccttcccctcgaaattcaaacggggatgtaagtaatgtttgtcttcaacaatgtagtgataaaattaccaactttgtagtcaatgtggtatttcttctacatgtggtgactttttaattttgctctcttgcaggaataagctatgtttttcatgaaaaattctggagacgtcggactattgcacctgtagctgttttgccattgttggatcttttagtctatgtgaatggtcttatcagagtcatgaagaa

SEQ ID NO: 5709 - DNA, 620 bp, Glycine max
  misc_feature (611)..(612): n is a, c, g, or t
atgactttctttagtgtgtttgatgttcctgtgttctggcctatactcctcttctactgggtggtcctattctcacttacaatgaggagacagatatctcatatgattaaatacaaatatttaccgttttcatctggaaaacaggtaaactaacattttcattcttcaaaattattgtcataggttgtgttgtatggcttggtccattatttggtgttcttaacatatctttgttgctaatggtaaagatttggttttgtttgttttacttgcagcgctatgatgtaaagagagcaccaccagaaaccacaagcctttcagtttcagaggactgaaattttcaggttaattgaattttatttgcttgatttaggtcacaaacaaacatgtggcttgatattatttgctgtatattttgacagctggagcaatctgaggatttgatggaagctgaagaaagttcttttgaggtcttgtgtggacaccaacgggatgtcttggatgtttttaggccctagtaaaagattcagtttagggagatataattggagtttctgagggtttcttttactcctttattttctatttctttctatataagtgggctaatnngctctcgt

SEQ ID NO: 5710 - DNA, 527 bp, Glycine max
tagcagaaggaacagacatcataaccaccaactgcttaatgcaaagaaataaagggctcagactatgacttcagaataggaatataccttaagaacatattgagattatgaacattttgaggcaaccaataagccaaaaccagttaaaaaaaggtgaaacagagaatctaccttagagtaatactcaattgcatttttgaaatccttgtctctgaatgcaatatccccaaacttttttgtgttcaagatatcttgcacttgttgtgtccattcttggaatgaaagctgcaattacatttttagttaatgaacaatagcaagcacaaaaacagttggcaaaacaacctgagattaacaagtaggataaacaattaacaattttgtgctgcagaaaaagtgcattatccattaatgcaatgcaactacagtgcaacccattatagctgaccatgcgtttattttatgagtttttcactttccaaggcacgttgaacgtcaatcccactctcacaggtaattggcattca

SEQ ID NO: 5711 - DNA, 760 bp, Glycine max
tcttgaccttgatatggagctccaccgtataaacaacatgaactcaatcccatcgccccaccatacacttcaaaatcagcatgcacctaaagaacaaaacactcctcatttaaaaagaacaatacattcaccctgcaatgcacaggtaccgatactcatgcatacaagtacatacctggcaagccaattccctagtaggtagaagcacgagaacactcggagtcctcccgtagccagtctttctcgcagattttgctggaccatttattaaagactctaatatgggcaacacaaatgccagagttttaccctacattttcaccaaagaggagacaattgagataataaaactaaaaccctttacaccactcaaaaaacattgacatcttttctctcaagtgttacaaaagtcaaaacaaatcatgcgcaattcaaataacaacaacaacaacaacaacaacaacaaaaagcttatccccgactacgtgaagttagttaaaaaaacaaaactttaggaatactattaaagaattgaacaaaacaaaaatcggtaggaattagggtttgtgataagaaaagatacaaacctgaccagtgcgagcacggccaaccaaatcagaaccatcgagaacggtgtcgaaggtcatggcctgaatgggaaacagcgattcgatacccttctccttcaatttctccctcaatggttccgaaatcctgaagttggaaatcgcgttggggtcatccttcttttcttctttag

SEQ ID NO: 5712 - DNA, 722 bp, Glycine max
cgatttattaattatcattgatatataattgttactgagttccttttatttgatttttaaaaatgttacactagaagatattgcttttgcatacctttttgatagattctattatagatcaagttgttagaaatataggaattgtttgcatgagaagagaaaagacaatatatttcactaattccactagtcaggactatgagtaatactgatcttatatggtttgaaccactaaccttatacttctatctatactatggttttgatctaaaacaaccaaacttcatgcattttttcttgaattgcattgtattaattaaggtcttactctatgttaattaggtgttcatataccacaaggcttttcccatgccagcattatctttcaaattttacagtagtgaccctctttctgggaatgaagaggatgattcggcacagttcatcacttctgtttgttggcgcggtcagtcatccaccttagtggctgcaaattccacaggaaatgtcaaaattctggagatgacttaagtaggtctttagttgggaataattttctacattaggttacagaataattgttcatgcatggttagctttgtgttgccggaaaaggctatagagaagcgtatacaaattccatgattagggtgtctaaggtgtgaaagttaaagaacttacgcactatgtggaagcttataagaatggggcaagaatcatgt

SEQ ID NO: 5713 - DNA, 486 bp, Glycine max
agtctattgagtggtaaacaagttcacattttgatatttatcaacttttaaatcattattttcatttaatttgcagtctcactgatgaagaatacatccactatgccatttctgaaggaaaaaggttccgagattcacttgaaattattgctcttcttaaaaaagcttatgaatcctacagcagtatgaaaattcagaggatgagctctttttgtgcattccagatgtctaaagaatatttcggtgaaggtgatatcagtaatgcaaaaaagacttttgatagtatagctagcctatacagaaaagagggatgggtaactttattatgggatgtcttgggttacttgcgtgaatgctctaggaaaaatggtactattaaagattttgttgagtattcccttgaaatggctgcgctgccaatatcatctgatactggtgtccggagagacactggtccagccggtcctgcaaatctactgcaaagag

SEQ ID NO: 5714 - DNA, 847 bp, Glycine max
atgccttccttcttgaattgatcatccatgtgctcagaggtacattgcagatgcccgcagaaaagttgaggtaagcaaattattgctctgtatggctagattgtatcctgagttatgaaggaatctgaatatgctttgaactttgttggcatactctgttaactacaattcacttcaattgctctggggaaaaaaacatatctttcatattaaacattaccatttatttactctgttgtattttttaaaaaaaacatctatgctgttcaaaatttatctgttcttttccctgtatttgactatttcctttactttttaaaattattgttaactaaattttttgctcagccaactgggattataacccgtgtaaatacttaataaatgttgtacccaaaaggaaaagaaaagaaagaaaactaagggaatgaacggatgaaaacaatttgaaatgctcctgtctcagcatttctggcatctgaatctgtgtctgagcctgaccttaattgagttttgggattcctaatccctcttttatgatgcagtcaattcctgaagaagatgaccgcattcaaaatctatcacattctcgcaagccatcaacggatacaggctctggatctggaactgatgtggcacagtggaacgtccttcaattcaatacgggtaatacctcaccatttataattaaatgtggagcaaactcaaattcagaactaatcattaaagccgaggctcgagttaaggaacctaaaggcggcgagattgtgagggttgccccaaggccgtccattttggaaaatatgagcttggaggaaatgaagcaagtatttgctgaactacctga

SEQ ID NO: 5715 - DNA, 822 bp, Glycine max
  misc_feature (478)..(478): n is a, c, g, or t
aaatatgtcctttgtccgtgaactgccaaacaattacagaatcagttttaataatattttcaagaaatacacatcaactttgctctactaatagtcatgcttggctagaacactaaatagaagattttttttcatgagactatgatgaccgtagcatgtctataaggcaaggatgtaggacaagggaacatctctaagtaacttatatgaaggatatcagactaagtaacttgaattatacataatgttcttctctctaccataaacttaccttaattgagttacccatgagattggtaattatttgtcgaaatcttcctggatcacctataagtaattcaggaacatgatctgacacataaactgccaactgcagttaccacaaaaattatgaagagccattaactattagactacgcacattttgaaaattccatcatgataaaaaatcaacagtagatgagagagatattacctntactctttttccttgagacttctcagaaaatagagacaatacatcatccaaaattgcccgtatgtcgaagagcacagcctcaagctctagcttaccaaactcaatcttagcctgatccaaaccctcatttataagtgacaccagagcttttccactttcctgtgctgtcctgacatattcctgttgggttacatctagatctgtgtccataagcatatgcaacatccctgaaaatccaatttagagcagggtcatggctgaagaagctcttcttttctgtggaaataatatagataaaaattggataatagactaagccgtagacagaagacaactcaccccaa

SEQ ID NO: 5716 - DNA, 372 bp, Glycine max
tcgtagacattgcgatgattcaatttcagagaaaggggctcagtctcctcctgaatcaagatctccttctccttccaaggtgggaaggtgtcaaagctttgttgaaaggcctcatgctcagccactaccacttcctggcttgcacccatcaaatataagccgagcagattccgaaattagtataccatcatctagaagaagacatggaaagggctccaaatcatcgttgtttcttccactaccaaaaccagcgtgcatgcgtggtaggttgaaccctgctgagttggatggagatttggtcacggcttcagtctctagtgagagctctgctgatagtgatgaaccagtggactctcacaatcgtagtcctca

SEQ ID NO: 5717 - DNA, 1473 bp, Glycine max
  misc_feature (399)..(399): n is a, c, g, or t
  misc_feature (411)..(415): n is a, c, g, or t
  misc_feature (418)..(420): n is a, c, g, or t
  misc_feature (452)..(455): n is a, c, g, or t
  misc_feature (457)..(460): n is a, c, g, or t
  misc_feature (463)..(463): n is a, c, g, or t
  misc_feature (467)..(469): n is a, c, g, or t
  misc_feature (483)..(483): n is a, c, g, or t
  misc_feature (489)..(495): n is a, c, g, or t
  misc_feature (507)..(510): n is a, c, g, or t
  misc_feature (514)..(515): n is a, c, g, or t
  misc_feature (544)..(546): n is a, c, g, or t
  misc_feature (548)..(563): n is a, c, g, or t
  misc_feature (567)..(578): n is a, c, g, or t
  misc_feature (581)..(593): n is a, c, g, or t
  misc_feature (598)..(598): n is a, c, g, or t
  misc_feature (601)..(607): n is a, c, g, or t
  misc_feature (612)..(617): n is a, c, g, or t
  misc_feature (619)..(622): n is a, c, g, or t
  misc_feature (624)..(637): n is a, c, g, or t
  misc_feature (647)..(649): n is a, c, g, or t
  misc_feature (651)..(657): n is a, c, g, or t
  misc_feature (659)..(667): n is a, c, g, or t
  misc_feature (672)..(690): n is a, c, g, or t
  misc_feature (692)..(692): n is a, c, g, or t
  misc_feature (694)..(694): n is a, c, g, or t
  misc_feature (702)..(704): n is a, c, g, or t
  misc_feature (706)..(707): n is a, c, g, or t
  misc_feature (715)..(719): n is a, c, g, or t
  misc_feature (722)..(725): n is a, c, g, or t
  misc_feature (733)..(735): n is a, c, g, or t
  misc_feature (740)..(742): n is a, c, g, or t
  misc_feature (745)..(758): n is a, c, g, or t
  misc_feature (763)..(765): n is a, c, g, or t
  misc_feature (769)..(787): n is a, c, g, or t
  misc_feature (789)..(789): n is a, c, g, or t
  misc_feature (791)..(805): n is a, c, g, or t
  misc_feature (808)..(811): n is a, c, g, or t
  misc_feature (813)..(817): n is a, c, g, or t
  misc_feature (820)..(824): n is a, c, g, or t
  misc_feature (829)..(844): n is a, c, g, or t
  misc_feature (846)..(858): n is a, c, g, or t
  misc_feature (860)..(866): n is a, c, g, or t
  misc_feature (868)..(868): n is a, c, g, or t
  misc_feature (871)..(876): n is a, c, g, or t
  misc_feature (878)..(881): n is a, c, g, or t
  misc_feature (885)..(886): n is a, c, g, or t
  misc_feature (890)..(902): n is a, c, g, or t
  misc_feature (904)..(918): n is a, c, g, or t
  misc_feature (920)..(922): n is a, c, g, or t
  misc_feature (925)..(926): n is a, c, g, or t
  misc_feature (929)..(931): n is a, c, g, or t
  misc_feature (933)..(936): n is a, c, g, or t
  misc_feature (942)..(943): n is a, c, g, or t
  misc_feature (945)..(946): n is a, c, g, or t
  misc_feature (948)..(948): n is a, c, g, or t
  misc_feature (953)..(956): n is a, c, g, or t
  misc_feature (958)..(974): n is a, c, g, or t
  misc_feature (977)..(980): n is a, c, g, or t
  misc_feature (984)..(989): n is a, c, g, or t
  misc_feature (1011)..(1013): n is a, c, g, or t
  misc_feature (1015)..(1016): n is a, c, g, or t
  misc_feature (1020)..(1021): n is a, c, g, or t
  misc_feature (1025)..(1026): n is a, c, g, or t
  misc_feature (1028)..(1028): n is a, c, g, or t
  misc_feature (1030)..(1039): n is a, c, g, or t
  misc_feature (1042)..(1046): n is a, c, g, or t
  misc_feature (1050)..(1065): n is a, c, g, or t
  misc_feature (1070)..(1074): n is a, c, g, or t
  misc_feature (1076)..(1079): n is a, c, g, or t
  misc_feature (1082)..(1085): n is a, c, g, or t
  misc_feature (1088)..(1097): n is a, c, g, or t
  misc_feature (1099)..(1102): n is a, c, g, or t
  misc_feature (1105)..(1108): n is a, c, g, or t
  misc_feature (1111)..(1113): n is a, c, g, or t
  misc_feature (1121)..(1121): n is a, c, g, or t
  misc_feature (1125)..(1129): n is a, c, g, or t
  misc_feature (1133)..(1134): n is a, c, g, or t
  misc_feature (1136)..(1139): n is a, c, g, or t
  misc_feature (1141)..(1149): n is a, c, g, or t
  misc_feature (1156)..(1163): n is a, c, g, or t
  misc_feature (1165)..(1169): n is a, c, g, or t
  misc_feature (1176)..(1181): n is a, c, g, or t
  misc_feature (1184)..(1186): n is a, c, g, or t
  misc_feature (1188)..(1220): n is a, c, g, or t
  misc_feature (1222)..(1226): n is a, c, g, or t
  misc_feature (1230)..(1231): n is a, c, g, or t
  misc_feature (1234)..(1242): n is a, c, g, or t
  misc_feature (1244)..(1246): n is a, c, g, or t
  misc_feature (1248)..(1256): n is a, c, g, or t
  misc_feature (1258)..(1267): n is a, c, g, or t
  misc_feature (1276)..(1281): n is a, c, g, or t
  misc_feature (1283)..(1296): n is a, c, g, or t
  misc_feature (1302)..(1307): n is a, c, g, or t
  misc_feature (1309)..(1314): n is a, c, g, or t
  misc_feature (1316)..(1317): n is a, c, g, or t
  misc_feature (1321)..(1336): n is a, c, g, or t
  misc_feature (1338)..(1345): n is a, c, g, or t
  misc_feature (1347)..(1350): n is a, c, g, or t
  misc_feature (1355)..(1359): n is a, c, g, or t
  misc_feature (1361)..(1376): n is a, c, g, or t
  misc_feature (1378)..(1380): n is a, c, g, or t
  misc_feature (1383)..(1385): n is a, c, g, or t
  misc_feature (1387)..(1392): n is a, c, g, or t
  misc_feature (1394)..(1394): n is a, c, g, or t
  misc_feature (1396)..(1401): n is a, c, g, or t
  misc_feature (1403)..(1404): n is a, c, g, or t
  misc_feature (1406)..(1422): n is a, c, g, or t
  misc_feature (1426)..(1428): n is a, c, g, or t
  misc_feature (1430)..(1434): n is a, c, g, or t
  misc_feature (1436)..(1439): n is a, c, g, or t
  misc_feature (1441)..(1456): n is a, c, g, or t
  misc_feature (1458)..(1461): n is a, c, g, or t
  misc_feature (1463)..(1469): n is a, c, g, or t
tcccaaaaattcaacaatactaacattattaactcttctcttcgtttttcccaattaggtttccgagtctcaaccaatttcaccatgtccactcaaattccgagttagttagttatctctttccgccatggaaggtaacaaggacgaagcattacgctgcgttcgcatcgccgaagaagcaatcgcgtcgggaaacaaagaccgcgccctcaaattcctcagaatcgcgcaacgcctcaaccgcgatttgcccctccagtccctgctcgaaaagtgcgaccgcttcgattcgcactccgccgccgctgccgcctgcggcggcagcggcgcctctccggcgaacggtcactctccgcgtcgcgagggtttgaacggggagaggaattacacggaggaaanctcggaattggnnnnnctnnnggattgggtgagactcggaaacctaattgggnnnnannnntgngggnnntttttagagtggtnttattnnnnnnnttttgggatggnnnngganntagggatttggggggaaaaaggagggaannntnnnnnnnnnnnnnnnngccnnnnnnnnnnnnccnnnnnnnnnnnnnggagnaannnnnnngaccnnnnnncnnnnannnnnnnnnnnnnngcgtctgtcnnntnnnnnnngnnnnnnnnnctcannnnnnnnnnnnnnnnnnncntntgtctttnnngnngatttacnnnnnccnnnncctccgannnttctnnnctnnnnnnnnnnnnnnatcgnnnagcnnnnnnnnnnnnnnnnnnncngnnnnnnnnnnnnnnncgnnnncnnnnnccnnnnncctcnnnnnnnnnnnnnnnncnnnnnnnnnnnnncnnnnnnntntgnnnnnncnnnngcanncggnnnnnnnnnnnnntnnnnnnnnnnnnnnncnnnccnnttnnntnnnncccccnncnnanccccnnnncnnnnnnnnnnnnnnnnnacnnnnctannnnnntctttgctactcatcccgtcannntnncacnntctnntntnnnnnnnnnnaannnnntctnnnnnnnnnnnnnnnnattcnnnnncnnnnccnnnnccnnnnnnnnnncnnnnttnnnnttnnntccccacncacnnnnncatnntnnnngnnnnnnnnncactgcnnnnnnnntnnnnnccactcnnnnnnccnnncnnnnnnnnnnnnnnnnnnnnnnnnnnnnnnnnntnnnnnctcnnctnnnnnnnnncnnncnnnnnnnnncnnnnnnnnnntctcttcannnnnncnnnnnnnnnnnnnntacttnnnnnncnnnnnncnngtannnnnnnnnnnnnnnncnnnnnnnncnnnncctcnnnnnannnnnnnnnnnnnnnntnnnatnnnannnnnncnannnnnnanncnnnnnnnnnnnnnnnnnctgnnntnnnnnannnnannnnnnnnnnnnnnnnannnngnnnnnnntacc

SEQ ID NO: 5718 - DNA, 398 bp, Glycine max
gttgctgatgcttcgggggaaaaggagggtgaagaggagactgtagacacagctgctgcaaagaagaagaagaagaaaaaggaaaaggagaaggagaagaaggcagctgcggcggcagcagcagcagcagcagcagtagcaggaactgtaccagaaaatgaaacagcagaagataaagctgaggtaattgaaccaaagaagaatgattcaaaggctaaaaaagcagctgataagaaagtgccaaagcatgttagggagatgcaagaggcactagctcgaagacaagaggctgaagaaaggaagaaaagagaagaggaggaaaggttaaggaaggaggaagaggagcgacgtaggcaagaggaacttgagagacaagcagaagaggctagacgtagaaa

SEQ ID NO: 5719 - DNA, 396 bp, Glycine max
aaataaaactacaagaatgcaaaatggaaattgcactgatacatgtgcaacaagttcttgaactcgggtgcaaaattgaaattgaaaaacttatactagagagtaatacccactgcaaaaagaataaagaacaaaactaagaaatagaacagagtcacacgttagtatttttcgaccgagaaaaaagaagagcattgatattttaagttgtcatacgcggtcatgctaacaactgctataattatatcaatcatgttaaaggccattcatgcaccgcatcggcttttgtgaggatcaaggatgatactacgattccacgagcattgtatgctctcattgcaccttttggtaattttaagcttcagttgcccgactcattcacatccagagcagtca

SEQ ID NO: 5720 - DNA, 1333 bp, Glycine max
  misc_feature (784)..(784): n is a, c, g, or t
  misc_feature (788)..(788): n is a, c, g, or t
  misc_feature (800)..(800): n is a, c, g, or t
  misc_feature (802)..(802): n is a, c, g, or t
  misc_feature (1256)..(1256): n is a, c, g, or t
  misc_feature (1313)..(1314): n is a, c, g, or t
  misc_feature (1323)..(1325): n is a, c, g, or t
cttcgaaacaaaaaatttacaaattatgcaaccaacaaattacaattcaagaagatgtctaaagatattttgggtcacgaagagaaaatttccatgtaggaatcaagtaaaaaccagagttaaaagctattaagacctaagcaagagttaaatcatacacagacaaaatttatagctaattcaagccaggcaacttagaagggaaaaagcaattgactccaagcatgcactgcataggcagtaaaatgtagaaagttaatcagacgaagccatttgagttgatattccgtggaaacaatgtacatgcaagaaagtcgcctcatattatgacaagatggaaaatatcaccaaaccttagccagtccatcaaaattgataggcaatatctctgaagaggcttcttgtccctgatcgggagttagaacaacctgaccatttgcctcaagtgagattgctttctcacttttgttaacaacctgcatctctgcgcccaccgtgtccagcataacctgtcaaaatcaaataacaaactctcagctccttccccactgtctattttcaacataaaacccaagagaagtgggaaaatacaataacacagaaaccaaagattcctcaagcagttgctaaaaaagcttcacttcacctttgacaaaacaaacatacaaagacagtaggtttcaatttctattacttttaaccaaagcagcaaactttcaaaagggaaaaagaggaaaactgttattttggcatggccatctttcaccccccttttttccttttnctcntgaaacaaactngncccttttttttctttcccgcccccagggtaccaaaaattccccggggccaaaaccgggaagggaaaaacccccccccccaaacttttttgttcttttgatagccacccttaaatttttccaaatttcctggggggtttccggggccatcccagaaaaatcaaaacgaaccccttccccccaccaccaccacctttgaaaaacccttaccattccaccccataaccttaccccttttcccatttttcccttaaacttttaaattttcccaatttaaaaaaaacccttaaccaaaaaaagggaaaaaagtgggccatccccaccatcccaccctggggccacccgaaaatattttggcgggttttaaatttggcccccggggtcccaccatttttgtcctttccgggaaaaaacttttccaaaataaaaaattaaaaccaatccccattatttttnaaaaaaaaaatagatccatagattgaaaagtaaaagggaaagaaaaactaacaggcnnggatggtcnnnggatgaga

SEQ ID NO: 5721 - DNA, 795 bp, Glycine max
  misc_feature (726)..(730): n is a, c, g, or t
  misc_feature (777)..(777): n is a, c, g, or t
ctcatgattatgttttactgctcgtgcaggatggatactaccttgaagccttacgatatgcacggaaatacacggtaatttctactgtgctgactcctggtataggaagtaattaggcattattttagataattaggagagcagggagatgatggaaaactgaggactctggtgttgcacttttctcatataggcattgttgctgtagaaatttcattcatccagttagctctgtatgatagtctttattccctgcatctgaagaaagatagtcctttgctgaaaataaagtatcagtgttttactctttttaaatacaaaacccaactaaacttcttcaccaatggtattggttaggtgcctccagatttccctgggggctgcagacccctacagattgtggtgctggtagatactttggaaattagtaacagttattttgatctgtgagctttcacaaattaaagacaatgtaattctcaaattattgatatatcttgcaactattatgtatattgttatttaaagtaaatggttagttttagattccatctgaagtacaaaatcaaatatcaaaatacttcgagtaattgtactgttgagataaagtgcccagggaaacaagtatcactatgtttgtgtttatgattttgtttttctgattttttttttgttcgccatgtttatgattttgtttaaatttcaaaagtcttaaagctaactagnnnnnaaaattactttcagggggataccatccggccatcattgttcttaaangcagcatttgtttccaat

SEQ ID NO: 5722 - DNA, 405 bp, Glycine max
cactaacacaataattcataaacccctttctcacaggcatagctatataccttgttcttcttcaacctttttcttttttccttcgatttgggcccaacacaaacgcaccattggctccgatcactgcgtatcatcacaattccatggcggctggccctacatcactctccgatcgatccacgatggtccctcccccaatgctcgtctccgactccttcgccaaggacgcaatcctcgcctggttccgcggcgagttcgccgccgccaacgccatcatcgacgccctctgcgcccacctctcctccgccgctgcatcctccgcccacgactacgacgccgtcttcgccgccatccaccgccgcaggctcaactggatccccgtcctccagatgcagaagtaccact

SEQ ID NO: 5723 - DNA, 403 bp, Glycine max
aatccgccaccaagtttcgcgtcttcatgttgggcctcaagaagctcaagcccaacgcccctgccgctccaaacctcaagaagaaaaaacttttcaccgtcaaattcaaggcggaagagtatcccattgtgtccttgttctccagagataacagctccagacccaaagcctctcagaatcaccacacagacgaatcacaatcctcactctcagagacactttcttctgcttccgaggagaaacgcttaatgcgaaagtatttgaaaatggtgaagcctctgtacgtgagggtttctagaaggtccgagaaggtcgacgtgagttctcctgagtccgctgaagcttctacggtggcggagaagattccgacagtagcagaagattctgaaagtgcaaacttgaa

SEQ ID NO: 5724 - DNA, 414 bp, Glycine max
tttgtactagcatctagggatgaaaaactatccaagtatttggatggtcaatctgtcaaaaaaagaatttacgttcctggcaagattttgaacgttgttttggaccgtaaaaacattaaggttggtgtacagtagctgctttcactcgtgtccgtttctactggaagcaacgatcaaccgttaaatatatgctgtgcctggtcaacttggtaatggccctgcatccgccgctttaaaactaaagcatatgtaaagaaggtgtctttggccggagagttatgcttctgttggatggaaagtgacagctgggcaagtattcacctctatgactgttaatttatactccgctttaagaggtgcataacttaataaaagagaggcagcctggttttccggcttgctttgatcatttca

SEQ ID NO: 5725 - DNA, 390 bp, Glycine max
gagcgcccatttccgtttagtgccctccggggttttgttcgatcccaccggatgcaacggaagcattacaggggactttcaaatcctcaatgtgtgcatggcatcgaggttgttccatcgcccaatcttatgagtcttgataaggatgagcggagaaagtggattgaactcactggacgagatttgaacttcacaatcccacctgaagcaagtgacttcagttcatggaggaatcttcccaacagagaatttgagctcgagagaccacttcccctgatcaagagcactctgaatccacacccaaagaagctgcttaatggatctgtgttgaatttatcaactcatctgcctagcctcagtaatggtaatgggactgtcctgtcttctaaa

SEQ ID NO: 5726 - DNA, 808 bp, Glycine max
gtcactgaagacatgtccatacggcgattgccaagcaatacaggaaatagtgtccagagagggagatcatgaatccaatgatgaagagataacatttgagcagctccgtgttttgtctctcgaatctttaccaagcatagtaggaatttactcagggaagtacaagttgaaattcccatccttggatcaagtgactttaatggaatgccctcgaatgaaatattcttatgtacctgatttgcatcaattcaagcctcttgagcaaatttaattggaagagcagaagttttaggtaggtattaactagcatagttaatactcatggttaagggaatacatatgcgcttatttggctaaccaacatattcatattttaccatgttttttgctaaatttccatgcatatatatacactctgtatttaccttgccccttaatccttgccatcacattgcatgtgttttttgcctaaggcaatttttaagaacataaagattaattgtgtgagaaaaaaagttatgcactaatcatgtaaaaaattttacataatcatctaatcataactcatcatgtatgaaaatttgttgactattaaaataatcatcttaatataattcaagtaatgatttataattagatgacactgtaaatttattttacactattaatgcatagacattaaagtcttagttgtatttgcatcaattgaagccccattagcaaatttaattggaaaagctgaatttctaggtaggtattaaactatgttagtattttagggtaaaagtaaaatggttgattgttgaat

SEQ ID NO: 5727 - DNA, 403 bp, Glycine max
ccctactacctccgtccagaaccgccgtgccacgcctccgctgcgcgccaccaccggcgtcgtccagcgcgtgcatcccatgtgaaacctggtcaagtcatccatagcaaatcatattgctattaatagtgatccaaaaaaaatagaaaccccttcaaaattggcatagaagtagaagcattctttttccttgacatgattgattgaacaatgatgtgtgagtttttgtaaattttttaataatatctttgatttatatgaaccaaaaaaaatattccacctctctctcatttacacaattgaccttggtcgtgcacgaccggggtcaatgtagaaattcttaaatttccattatactgttgataaattattaataatagtgttatcgaatttctgtgaggca

SEQ ID NO: 5728 - DNA, 489 bp, Glycine max
  misc_feature (416)..(416): n is a, c, g, or t
  misc_feature (418)..(422): n is a, c, g, or t
  misc_feature (426)..(426): n is a, c, g, or t
  misc_feature (434)..(435): n is a, c, g, or t
  misc_feature (444)..(444): n is a, c, g, or t
  misc_feature (446)..(447): n is a, c, g, or t
  misc_feature (449)..(450): n is a, c, g, or t
  misc_feature (459)..(460): n is a, c, g, or t
  misc_feature (462)..(467): n is a, c, g, or t
  misc_feature (476)..(477): n is a, c, g, or t
  misc_feature (486)..(486): n is a, c, g, or t
cagaaatcccaaaactcccttttgaccatgcatactggagaacttgtctccaagaactggactacgaacctgcaacattattaaataacagatttatccggtgatcaaatttacggtagctttcagttgtgtaacaaaacatccatgttcggatgatgcacaaattagtacgttttaatgcccatctacatgcatacagtaagttatgtacgttgcagtaattcctaaaagttcatgcacaagcatcttcattaaagtagttttgggattcaccagttacctgtcttaatgaaaccacagcaaaatttttaccctcgtcatttgaagacagcacaaccttttgcacataacccatttcagtgtgctttaactttacactattgtctgcaccggataaaaaagctgttatttaatgntnnnnncatnttcgtaanncagttctgngnnanntgttctccnntnnnnnnggtccaaanngagttttgngat

SEQ ID NO: 5729 - DNA, 741 bp, Glycine max
  misc_feature (704)..(705): n is a, c, g, or t
atttaggtgaaataacaagaaatatagccggaggagaaagggctacgatgctcgacaacgtgtcactctacgcctgctggcaacttggcttgatatcaagtgggcaaaaatggttggtgaatgaatcatttaattggtaactgaatgtttttgatgaattgaggtgatcatgagatataagagcaaggttttttttactgtttatactgtattaataaagacatggcaaaaactaatcttcactttgatgaacattgcctatacattcccccttgatatataagttactaattcagagcctaattctacatggggatattcaataaactttgctttcaattgtcccttgtgaaaaaaaaatcactttttatttggttccatattttctagtgataaagatgaatcttcgctttgcaggaggccattgagacaatagttgctagttctgcaatgtctttcattaaagagcaagaggcaagtaaagaagaaactcaatcaaaagaagacaagtgggctaaatggaagaggggtggtatcattggtgctgctgccttaactgggggaactttgatggctgttactggtggtatgaataccttaacatcttttctgtgttctggaatatatgatttcaaattggatgagtttccttgttgatttaattgtttttgtttttatgcatttaacaggattagctgccccanncaattgctgcagggcttggtgcttggctccaacctt

SEQ ID NO: 5730 - DNA, 402 bp, Glycine max
atgaaccaagtcctaataacaacaaagagaacctttggaccacaaaatgggcagctattagaatggtcactgttatgttatctggctttggagttggctttgtttactatggagttcaactcaatgttgaaaacttgaacttcaacctctatgtctcagtggcaatcaatgcacttatggagattcctgctgtggtgattggtacctttctattgggatttactaataggcgtttgttgttatctatgtcctcttatatagctgcagtgtcctctatactatgcacatttttatcacacaaaggaagtacatcaaaagtgcataataacaatagtggtaactggggtcaattgattattgaagcaattggattcatgggtgcttccacagcatttgacataa

SEQ ID NO: 5731 - DNA, 453 bp, Glycine max
ttttctgaattagaatcatccatgtatgttatctatattcatattgcatttaatttgtttatttattcatagagtggcgatgagatcaaggttttccctccctattttgatgaattattgggaaagacttgggctgtcagattttagtaccatgcacgatgctcaaaaaggcctacaatgtgttgctgaaccttggtaccaatatttgagagacaatgccttcagtgttggagatgagatatgtttctactttaggccttataaaaaagtatgagagttgataataaaaaaatagttggcttgggatgatagtgactccaattgaagatggtagtttagtagcttattttagaattgtttgttggtgaaattattatgtgtcgtctatgctaaagtacttctatgttgtaattcaattacctagcattaccagacaatgtttcctttcggtat

SEQ ID NO: 5732 - DNA, 399 bp, Glycine max
aatggcaagatgctaagtgctcaacttgaagcgcagaatataaatttccagttggatcgtgagcagcggaaagaccatgcaagtaatttggttgctgtgcttgataagcttgcagatgctctagggaaaatcgctgataaattatagtgcaagagcaatcagaatacagtgtacataacagttgaagtcctgtagataatagtggtttctgttatttatctcagaaggtctccaagaaaatgactgccacacttgttctccgtttgttttcctttctggatatgccatatttttgtggtttattactgctattttaggattatatacacacatttggattactgctctttctctcttactgttatattaatattcacgaggtcattcgaatctttctct

SEQ ID NO: 5733 - DNA, 920 bp, Glycine max
gaataatctagataaccataaataggcagacatacattcagatctctgacctttttacattcatagggttttgaagctgcaatagctgctggtgctagagaagttgctatttttgcatcagcttctgaatcattttcaaaatcaaacattaactgtagcatcgaagagagccttattcgtttccaagctgttactcatgctgctaaacaactctcaattcctgttcgagggtatgcctttcattttctttttattgagactacatcatattatggttgcttcaatatatgtgttgggaaagacctttcaaatagtagttggatgcatgaaagtcccattggttgatattgtaaatgttgctgacaccattctgtttttattctgtgtattccatatttcaattagtttctttgtaatgaaatgtgataggtatgtatcatgtgttgctggatgcccagtggaaggaccaatccctccctcaaaagtagcatatgttgccaaagaattatatgatatgggttgctttgaaatctcccttggtgacacaattggagttggcacaccaggtaacaagtttaatcaattttgaacttctaaagtttaagtgatccatgcttgatacaataattctggtggtggatatgtttcattttgttgatagactagattgtctattcttgtagaccttttacagtatgaaattgataaggtgaaaatgtcaattcttggcggaacttggggatgaatgtaaaactaagtgctttgtattttactaagtatttgtcattggtttctggtatatgatccctctgtacttaaatagtttcctattcattttgttatgttcaggaactgtagttcctatgcttttggctgtgatggctgttgttccaatagataagatagctgtccacttcatg

SEQ ID NO: 5734 - DNA, 404 bp, Glycine max
aatgtttaagctatcttctttattccaaccacattgaactgatgaatgtgtttatcaaatccaatgactgatgagcaggtgctgtaccaactttctggttttatagacactgataagatacatcctaatgcatgccctgccttagtagctgatctgtctgctggggagcagggaataatagctcttgcatttggtaagccatattctctttgtaattctaaaaaaatatttaatcatgtgcttcttagtgaattttcatttctattcataataatttctttgttgtttcttttatcctagttatttctagtctgattttggttttcggttttcacttatgcttatatttttggggttgtgcatggggttgggatattcaaggttatacaagattgttccagcca

SEQ ID NO: 5735 - DNA, 338 bp, Glycine max
aatttgatgagttgatggcggctgctgctgctgctgctgaagatggtgaaaatggagatgttgaagagcacactgcataagttcatcgaaggttatacctgtcttgggtgaagatatgtactctttaatgaactgcgcttgtgttgttagtatgtagcggacaaacaaagcaaagaattcgttatatagactggcctgcaatgttgaactatgcaattccttcatttcttttccctataaatagaggctttttgtgtcttagctgttgctgtgttcagttttcgatggataaaaagcattggcacatttaacttgttcagacttcccaagttatattt

SEQ ID NO: 5736 - DNA, 242 bp, Glycine max
cggccagagaaaccggttttcccaagtggatcagctgaaaccgggaaccaacggtcacactctggttgctaaggtgttgtcctccaacactgtgttgcagaagggacgaccctcttcttcgcacaacattcgccccactctcatcgccgagtgcctcatcggcgacgacaccggcaccatcatcttcaccgcgcgcaacgaacaaggtaaccccatcataacccttttcgtttttttttttt

SEQ ID NO: 5737 - DNA, 756 bp, Glycine max
accccttttgatgtgatcaagactagattacagacacaggtatgtaataaacatgcccttcaattgtataaattcttattgctactactgaagaataatctggtgcagccatctaattagatgtcgaagacaacctttcttaacactaggtttctgaaacttttttttattcaactatgttcaatatcatttatcttgttatcctcaatactattattatttcagtatgttattttaaagaattcaatacattttttagccacttttttttggttaatgtatgtcattttactcttaattcatggttctgatagaagtgagtgcgccgcagattcctgggtctgcaaatcaatatgatagtgtgctccatgcactttacaaaattagtaagagtgaaggatttaagggcctgtacaggtatcattgtctgaatcttgccattatcatttagatcaaaagaaaatattttataggagcaactgctatacattctgtcttgaaatctctgttcaaatgtgaattgcacatttgatatttgtcttttgatgtgctttgtatgtctatcatcagggggttgattccgaggttgattatgtacatgtctcaaggatcactgttctttgcttcatatgaatttttcaagaggacattttctctggaagcatcacatcccactgatttatgcattcaggacaatgacgggaatgctgaagagtgaagaacgcaaaaattttgaattaacaggtccatcatagg

SEQ ID NO: 5738 - DNA, 407 bp, Glycine max
gcggcggcttaatggtgaccttgtacactgaattagggtccccaacattggtcacagtcctaataaaatgtgtagccattctcttctttccatatagctgaaacactgcagacaatgaagggtaattcaggttcccagaatgtcctgctcttttagccccactgcaatcagcattcctcctagtaatgacatggatagtgttggtggtgtaatttgaattgcacaagaaattcacataatcagaagtggagatatcataaaccaatccagggttcatggccttcactggatgaacatggccagcaccataatcaaacactgatgaaacattcccagtggactcatccaacatgggatcacccttgttgtccacagtgtaagcagtggtcatcaaagcagacctaatg

SEQ ID NO: 5739 - DNA, 550 bp, Glycine max
  misc_feature (399)..(399): n is a, c, g, or t
  misc_feature (497)..(498): n is a, c, g, or t
  misc_feature (533)..(533): n is a, c, g, or t
tcgttagagttgataaacgcctgctatattaaaaagtaaaatagcaacttggtcccattatcatcagtccataatcaaagtttccttaatgctctaagattgaactcatgcttgataagatttgatctcagtaacatggaacgaacatcacgatcaaattcccttccagtttccagaaccctttgaaaggtggcattcctttgatccgcatgccgtgcatacaaaattttgttgtgcgaatcaattcgagcctgcaaagtgcaaaaggttccaccaacaataaactgcttaaatcccatacagactgttttattgtaaatacacacacacacacgtatatataaaactgtcttcaaaagttataataaaaaaatgaaacgaatgtaatactgaggtgtngatttctttccattataaattcaaccaaatcaagctatagacaaaacaaggcaaattaagtgaaatcagacctgtatctgattatcagtaatcaatgnntctagttccttctcaagtcccgcaacagttgtctngaatgcattagccatca

SEQ ID NO: 5740 - DNA, 376 bp, Glycine max
tttcttctcaagtctcattaaatacaatacaacaatgggttttcgtctactcggtaccagaagggcatcatttgctgcaaaccaagcatcttcaaaagctttggaggtgccaaagggctatcttgcagtctacgttggagagagaatgaagcggtttgtgatccccatatcatacttgacccaattttcattccaagacttgttgagtcaagctgaggaagagtttggatatgatcaccccatgggtggtcttacaattccttgcagtgaagatgtcttccaaaacataacttcacgtttgaatggactataaatctcgtagcgtagaagactgacatagatttgtagacatttggtacactaggcatcttctcaa

SEQ ID NO: 5741 - DNA, 941 bp, Glycine max
acctccaccacaacaacaacaggttcaacggattagaacatacaccaaggttttaatattattattgttgtagttttaatagtaaacatgtctcaatggtggatgtatgtttcttgattagtatgcttgtttatagccgttacgttgttctaagttagtcttttgttcctataggtatataaacgtggagctgtgggaaggtccatagacataacacgatattcaggttacgaggaccttaaacaggatctggctcttaggtttggtattgagggacagctggaggatctacaaaggattggttggaaacttgtatatgtagatcacgagaatgatgttttacttgtgggagatgacccttgggagtaagtcctattatttcttttctggttagatttgcttttgcgcacatgattaatcctcactttttctaaattcaaaagtcattttttctcattactagcctacaagcaaccacaacagaaaccttttcctatggggttgattgcatggatcaactaatactataataaatcatgtcttactagcatacttaccgttaaattttcccacttccctatttcttgtattttatgaacatcaagatcatgaaaattagaattaaaaacaaattgtttggaacatttgtatgatgtaaaatatcaagcaccaaaataattggataatgtgcttcatgtacaaggcgtgattcctgaacttggagtatgtagttgtatccaatgttgaaattagatcaattccataaaccctattattgttattattataatttgatatcttaattgcttgttatggatatttcagggagtttgttaactgtgtccgctgcattaaaatactttctcctcaagaagttcaacaaatgagcttggatggagattttggcaatggtggccttccatatccagcaggcagcagta

SEQ ID NO: 5742 - DNA, 450 bp, Glycine max
atgacaaggatgttcaataccaaccttgtgatgattttggccatcatcggaatcctagtgttttctagtgccaacaatgttgttgtggggcagtgtccaggcatggagggcctcataacccaatgttcggagtatgttgagaagtctggccctgagatgagtccatcgccacagtgctgccacgagatcgagaacgcggacactccatgtctgtgtcagcacttcaacaaggcaatcctgcagtttattgacattcagaaggtcatttatgttgccaggtcgtgtggaaagccaataccctctggaaccacttgtggaggtatatactatatggaaaaaagatttaatcaaaccaattttgtgtgctaatctcagctttatatatatacaacaactttatcttcttgtttgttttgcaggtgttacggtgtcatgatcaaatggaggaaa

SEQ ID NO: 5743 - DNA, 591 bp, Glycine max
gtaaacgaaagattgatgaaagaagaagcatccctaggcactgctgaccccaaattcccaaagacaatttggccaccgaagcagctttgctcttcctgttacctaagtgttgaccagaggaacaacaaaattgaatggaaccaagatgaggtctttaagttcttggctgattactacagtaaaacactagcgtctctgtacaaggacaagagtattgtcggaaatgacggaagtgaaggagctgttgaagatttaatagtagcaactaatgcaattgtggtgcctgtgggagctgctttggctattgctgttgctagctgtgcttttggagcacttgcttgctactggcgttcgcagcaaaagagtcggaagtattttcaccacctacactctctaaagaacatttgataattaggagggtaatgaactctttcaaaattaactaatgactgggtcctgaagaattaaaagggggggtaaaaggagagagagattgtgttcttgagctgttgagagactcttcttattaataacttatttttgttttgttttgtttgcataatgtttcaggcctagaagaacgtggaagta

SEQ ID NO: 5744 - DNA, 349 bp, Glycine max
aaaaagccccgagttctccaaacgcaatgtaatccctagagtgatatctcggtcattagctattgctatttcaaccactatagcagccatgcttccattttttggagacataaactctcttataggagcttttggctttatcccacttgacttcatcttgccaatggttttctacaatttaacatttaagccatctaagcgaagccctgttttctggttgaatgtgataattgttgtggctttctccgcattgggagctatagcagcagttgcagcagttaggcagatagttcttgatgctaaaaattaccaattatttgctaatgtatgatcatgtggggaccatcca

SEQ ID NO: 5745 - DNA, 408 bp, Glycine max
ctgaagcatcaaagtcacctcctggacccagaatgccagatggaacacgtggcttcgcagttggacgaggtcggcctcctgtccctgcttcgaattagcaagatttgacacaacacgagggattgtatttagcagtattatgtggtccgatgttttagtgatggtactagttttaatctgggtccctatgcgtgttcggttgagtcaacatgggtttgttggactgttaaattatgcattcaatctttggaagcgagtgttggtggtgaagtacatgcccattttaagattattaggctgggaaacatagaactgtttttgttgtggtaatcctcaccttacgaggattctgtgtaacaaaatcatatcgagaaatttgttaatggggatgaaagaaagctgtgtttg

SEQ ID NO: 5746 - DNA, 391 bp, Glycine max
tttctgagcattcatcatactgttcgacatcatctgagccccattacccatagggacactaccaataggaggcttagcacccatagggggcttcatcatcatcatcttattcagaggatgctgaggatcatccatatcatcgtcatcaaactcgtcgtcgaactcgtcgtcgaactcgtctaattcatcatcagataaatcatcctcaggcaaactgaacttaaccgctttcggattcggattcgggttcgggttgggcagcttcatgtccttgaattgaggcagcttcagatcttgaaaccctttcatctgctgaagctgttggaggtgctgctgaagctgctgttgagggttctgctgctgttgggggttctgctgctgttgattatta

SEQ ID NO: 5747 - DNA, 591 bp, Glycine max
gtgctcaaaacaggtacttatatgtttaatcagaaacgattcttaaatttaaatgtctttattcgttaccctctttaaaatcatactggagctgttattatttaaatcactagtattttagtcttgattgaatatgcactaccgtgagatttcttataccttgtttttgtctattttgtgcatgcttgcaatggcttaggctccatcaaaaataaagataagcaaggttaccttcaagaatattcagggcacttcaaaaaccaaggaaggagtgactcttatatgtagcaagggtgtaccatgtgaggatgtggaactaaataacgttgctcttacattcaatggagctccaatagttgctaaatgtgctaatgtcaagcccatagttacaggaaaagctcctgcttgcacatgtacagcttaagagacttgggttgacacattctccttgaccagatttttcttttgtagatatgtaaggtgaggatgaggactatttgaagtctatagtgaataagcatttgtatatacttacgttgtcaatgtctaagggcatttattcaatacgaaagccttgtgcaagagcatata

SEQ ID NO: 5748 - DNA, 393 bp, Glycine max
gtttgggagatctttttagctcaatccatgcaagttctggtgcagattacaatagagataccattttgactgggggtcttgctgacttgatgtcctcattcttgtatgaaatatttatctctattgaagatgttaaccgaatggctagtttgttgactaattcgagacacagagttccattatatgacagaaggtctggaacaacaaacagggtatcaaatgatacacagacaagtcaatcagctagatggagatccaatttaccttcagtgcatcaactggagagaattgccagaagtagagtgagaagcaattttccgtatttatcatcccgtgatcttgaggcagaggcaaatcgtacggctagatggagaacaaatttatcatctttaa

SEQ ID NO: 5749 - DNA, 373 bp, Glycine max
ccaacatcgtcaaaatcctcggctactgggcctcaggcccggaacgcctcctcgtctacgagttcatcgaaaagggaaacctcgaccagtggctccacgaacccgatctctctcgctcccctctcccctggcccacacgcgtccacatcatccgcggcgtggcccatgggctttcctacctccacggcctcgacaagcccgtcatccaccgcgacataaaggccagcaacatcttactggactctaacttccaggcccatatcgctgactttgggctggcccgtaggatcgacaacactcggacccacgtgtccacgcagttcgcgggaacaatgggctacatgccgccggagtacatagaagggtccaatga

SEQ ID NO: 5750 - DNA, 407 bp, Glycine max
atatgcgatgaagggcttcaagcagtggctgagacttgcaaggatttgcgtgagcttcgggttttccctgtcaatacccgggaggagatagaaggtcccgtgtctgaggtggggtttgaggcgatttctcgaggttgtaggaaactgcagtcgattctgtttttctgccagaggatgacgaatgctgccgtggtagccatgtcgaacaactgcccggatcttgtggtgtttcggttgtgtataattgggcggtataggccagacccagagacgctagaacccatggatgagggttttggtgccattgttatgaactgcaagaagctcactcggcttgctgtgtctggtttgctgactgatcgggcttttaactacattgggacgtatgggaagttgattaggacgct

SEQ ID NO: 5751 - DNA, 500 bp, Glycine max
tctcttaatgcctccgctagctctgcctgtaggtacaagtacaaccattcaaatcaacatttttaattaagaattgttcaatatatagttattaattaaatttagttgcaagaaattaatataatatttattttgttcttgttaaaagatcgatatattaattaacctgaaaagcatgatcacggagggcgtttttgaactctgcttcgagctgggtcaaagaagctacaagtgtctcaggtacaaacttgccaccaaacctaccaaactttccactagtggtggaggggatgatgaagtctttgttcttgatggagggtgtaggtgggggcacatggctaattgtcaactcaggaaccttagtcttaaagggttcctgatgagtagtgagcacagcggagatggcgcgccctttctcatctatcgacaactgccttgttctggaatggcagctaacaattgccccttgcaatttgttcgccatcatcttctttctgtgt

SEQ ID NO: 5752 - DNA, 518 bp, Glycine max
cacagattctcggcttagggtaacactcttatcataaactttattgggaccaaatctcttgtttggtcatatcgaggttaaatcatgttaatattattgacatttacttgctgcttatcttttatgtttctgttgtgaaaacagcgggtgcagaagaacttagcggttttaaataagcgaaccaagggtggttgctcctgcatgtgcatgctattatcagtggttggtatagtggctttgattgttgttatttggctattggtcaaatatttgtaatgtataaaatacccaacttggcttgagtctgcttttcatctttgtttctgccgtgtgcactaaagaatcataatcaggtttccccatttctcttggtacttttccaatgcaatggaatttgttgaggtcgtgaaaggcgatgtattgtaattggcatacttggtgttttatatatcgtgtgtttttctcttttacaaatatgaaagtgaatgctactggctggagtatcctcgtggttgagt

SEQ ID NO: 5753 - DNA, 437 bp, Glycine max
tccacagggatattaaagcaagcaacgtgttgctggattctgatttccgtgcccgggttgctgatttcgggtttgctaagttgatgcctgacggggcaacgcatatgactacaaaagtaaagggtaccctgggctaccttgcaccagaatatgctatgttaggcaaagcaaatgagagttgtgatgtctacagttttggcattctccttctggaactcaccagtggcaagagaccaattgaaaagcttaattccacagtgaggcgatctatagttgattgggcattgcatttggtttgtgagaagaaatttagtgaaattgctgatccaagactaaatggcaactatgtggagggagagcttaaaagagttgttttagttgcacttatgtgtgctcaggatctacctgagaagagacccaccatacttgatgtgaag

SEQ ID NO: 5754 - DNA, 628 bp, Glycine max
aatgctgactgaaaagagtgatgtgtatagtttcgggatactcatcatggaattaattactggaagaagtcctgtggattatagtaaaccacaaggagaggttagaaatcatcacctacacactcaacagttttgagattgttcattttatacttatctatgcagttctttctctcgtttctcctaactgtggaagttggaattattgcaggttaatttaatagagtggttgaaaagtatggttgggaatcgaaaatctgaggaagtagttgatcctaagattgctgaaaagccatcttcaaaggctcttaaacgggctttgttggttgctcttcgatgtgtcgaccctgatgcagcaaagaggcctaaaataggacatgtgatccacatgctcgaggctgaggacctcttattccgtgatgtgtgttcttttcccttctcaaactttacattttagttgactgaaccaataataagaaatttcaattttgctgtaatctgatgcttgtggtttttgttttgtccttcctgtctgtaggatcgaaggactggaggagaatcctcccgttcccatcgcgattatcaactagagcataaggactcaaaattagataaaaggcagataggt

SEQ ID NO: 5755 - DNA, 1423 bp, Glycine max
  misc_feature (1404)..(1407): n is a, c, g, or t
  misc_feature (1414)..(1419): n is a, c, g, or t
cacctgtaatcactacgagcatcggggatgtggcaagcactctcaatatgttggcctgactttaaattcatagcaggacatacttgcaaagacattgcacagattcgattcactcttggttgcctctgcacagtaagataaatatgcatttttaaggtgttttgggtaggagaggaccacacaacttgttgaagcgaatttccacacatcactactaacaagataagtcttgttttcttttctaagaaaaaaaatctagaaaatactagtatgttagtgcctttcaaacatcacgtgcaaatgaaaaggaggaaatagaaatcaaaatgtgttatttagggaaattgtacataaagcccttaaacttagacccatttgcaaaatgccatcaagacctctaaaattgtttaaattagtccttaaaccataacaattacactaacagatcattagatcctttaatccaccagccaagctactaatagaagagatcaacaataacaacaatatctttatctcactaggtgagactggcaaggcaatatggatcatatgacgtcatttgacttgggtgaaaactaatctcaaatactattcatcatgaaatccttataataataatttcccccaatacccgtcttggtctctattatgaaccttcatataggatcaagtcacaggtctaaacacatgaagcaaacccctagttaacagatttcctactagactaacaaagttctttctgaaaataatttctcatgataatattccaatcaggtctgctctttaaaaagactgcaaggatatcccaaatttataagataataatatctaacaattatcctaattgataaaataaaaaataaagagtacccaacagccagtggatggaagggtttaatgatgtaactgctatactttagggactaattgggacaacttttaaggttcatagaggcgttttgctaatgaggaaaaacgaggaaaagtttaggggatttataccccctttccgtttatctatataaacaaaatttacaatccctatggtaaattgcaaaaataccttcacgaaagtccaattagttgggatataagcttctggaagctcttcatgccaagtgcttagtactggaaggggatgaccttcggtggtaaatacataattgttttcatggacaaatgaatcgtcaaatagaagatataaatatttgcccctgaagaaaacccaggatccctactcaatctcaaatccaataactatttgagagagaattttcccattttttttttattttctttgtaatttttaatttttgcatgagacaagaggaaagaaaaaaaggtctcacgtttcagcaagaaaaaaactatgctgatgatcttccaactgcattagtttcnnnnaaccctnnnnnncccc

SEQ ID NO: 5756 - DNA, 399 bp, Glycine max
gattgtcctcgagctaaattcaacgatttgaaacacatacttgccaaagtccgacccaaagtaaaagtttgtaacaacacttaataaaagaagaatcttgcaactatactcttcaagcttttgatgttcggtaatatccgagaatattagaaagctaacgagtagattgatggaatgtgttatgaacacagaaccaacaccaagaacagagcaacataaggaagaagaagaagcaggggcaaaaaggagaatcatcagaccaaggtacctggatgactatacacccaaattacagcagccacgtcagcaaggattctagaaaattgccgttagaaaagctgtacctcgtccccaaggcaatcacgcagtgcatttctcaatttctcaattcctccaagg

SEQ ID NO: 5757 - DNA, 325 bp, Glycine max
catggagaagagggtgaaaagcaaaaactggggggaaggaccccaaatctcaagaatggagccggtaacacatggtgcctatggtggtggaatgtacggtaccgagaaagggcaaccggagaaacaaacaaagccaccggcaagtgagagccagagtgctgatggccccgttgataaggacgctatcaagcccaaacacaatcctcccccttcaactggggacagagatttagatatcactggccagtcttatatccagtaacaaaatatatgtaaatacaatcactataataatcagggtgtagcttcctcttttatgtttttt

SEQ ID NO: 5758 - DNA, 355 bp, Glycine max
aatttcaaatttttatttttcaaaaaacgtgcatgtaaatgtgtgtttattcaatttaacgtcgaaactgtgagtttgtttcatacgttgttgttggttgtgtttttctttttttacgttgttgttgagttatggctgatgaagcttctggagatgttgatctaaggttgggagagcccaaggggcctaaagaggagcccgagacggaggaggggtccgccatacgtgtgatgccggtggcggtgcacgtgccggcggggatgtctatgtccatgtccaaggctctggcccaggcccaagcccaggcccaaccacaaaagcgggcctccaccaaagaccgccacaccaaagtaga

SEQ ID NO: 5759 - DNA, 700 bp, Glycine max
aacttgaattatcaaacaaacttttgaattttaatttaaaaacgaataaattcatccaatgttaaacctcaacctacctcatatggtagaaaaattaatgcatgtttagtttgtagttgaaaatattgcgacgtgcattttaatgaaaatccaacagataaaagcaaaatgaacataaaagtaaaagtcatgatccattgataaaattactcctgtcaaatatgctcataatcttgtaaactgtttatgtgttcattaatgttatgtgcataattaattaatctgcattctgcatagatttaattggattttctggttcaatgtgatgcagaatatgcttatacacttcgggtgaatgaaaagagtgacatttatagctttggtgtggtcattttggagttggtaactgggaagctccctcttgacccagagtatggagaaaatgatctagtaaaatgggttcagtccacattagatcagaaaggactggatgaggtgattgatcccactttggatattcaatttagggaagaaatcagtaaggtactcagcgtggggcttcattgcactaactctcttcctataacccgcccttcaatgcgtggtgtggttaaaaagctgaaggaagtaactgaacttccaaaatccttaagtggaaaactctcttctccttattttcaggaagaggcttcggatattg

SEQ ID NO: 5760 - DNA, 489 bp, Glycine max
  misc_feature (418)..(440): n is a, c, g, or t
  misc_feature (442)..(445): n is a, c, g, or t
  misc_feature (447)..(448): n is a, c, g, or t
  misc_feature (450)..(453): n is a, c, g, or t
  misc_feature (455)..(464): n is a, c, g, or t
  misc_feature (468)..(478): n is a, c, g, or t
ccgcgcgaatcctaccaccgcccctcccgcggcggccgcgacggctgctgctgcggctgcctgagctgcttctgcggctgcatcttcgactgcatcctgggcctcatctgcaagatcctcaccacaatcctcatcatcgtagcaatactcggctttctcttctggttcatcgtgcgccccaacgtgctcaaattccacgttaccgacgcgtccctcacgcgcttcgactacaccaccaacaacactctccactacgacctcgccctcaacgtctcgatccgcaacccgaaccgcagggtcggcgtctactacgaccacatcgaagcgcacgcgctgtaccaggatgttttgttcgggaaccagacattagggccgttcttccagcaccacaagaacaccaccttcgtgaatatgaatnnnnnnnnnnnnnnnnnnnnnnntnnnncnntnnnncnnnnnnnnnnctcnnnnnnnnnnncctcttcctct

SEQ ID NO: 5761 - DNA, 1112 bp, Glycine max
  misc_feature (45)..(45): n is a, c, g, or t
  misc_feature (992)..(993): n is a, c, g, or t
  misc_feature (1088)..(1093): n is a, c, g, or t
  misc_feature (1098)..(1105): n is a, c, g, or t
  misc_feature (1107)..(1109): n is a, c, g, or t
tatacgacagaagagctatcagggtcagaagatggtagccacatnttttgaggtattcacatttcccaaagtttcaggatgaaggatatttctgtgaaattttttgttgttatttttcgtctctcatgtttattgacatgttttgtcaggcaattggtttattgattggaacagaagatgtcctgcctgaaaagcaatctgattatctatcttctttgctcagtcctctttgtcaacaggttaatttttacttgaaaatgcaagatactttctaatccaaaaaaataataaacaaaaaactgcaagatacttaaaaaacattcttgtccccatttcctgtttccagaagcatttcttcttttgagattattacggttggtatttggtgcatgtaatttcctattctcgtttgatacaggttgaggcactgctcataaatgccaagttattgaatgctgaggagactaatgccaaaattgctgtaatccagcaaattattatggcaattaattctctcagtaaggtgctttttctaatttagacttctgctttccccacctctgatattaattataaaagtctcaaaactcacaatccgttagtgataagaagatttatattttgttcgattgtatcttaatttgaagtttaaagggtagtattgtgggttaaatgaaaatacatcaacagttttgtttttttcctccattcttactattttttacatgatctagggctttagcgagcgtcttgtaaccgctagtcgccctgcaattggtatcatgtttaagcaggttagtattttcaaaattgtttggttcatgctccctggaggtgtatatggtttatcagatttatagtttctgtcttttttgtggtaagaagctttagaaaataatcttgttatagtcttatagatgaaaattatggagttttgctataaaatgtatatttgcaacatgctgtgtgattgataatatttcatggtaagnntatgtctctatttttattgaacttgtgtattgtttcttaatattttattttgctaaaccttgtcattctgtcttctatgtagacattggatgtannnnnnaagtnnnnnnnngnnngtt

SEQ ID NO: 5762 - DNA, 620 bp, Glycine max
  misc_feature (609)..(610): n is a, c, g, or t
tcaggcaacccctggagttcaaatggtaactggtggcgatgctttagggcagcaatataacactccatattctgtaagtttctgcttaagctaaagatgtgctaaagtattttgcctcgttattagttgtactatcttaggttgaaaagatttttttgtggatgaaaaaggtaaggggaagggagagggagggtgtcctagtttatcagtcctaagagctgagaaaagtgctgtcccttggtttctgcactgagcatgaaacagaagcagaattaaaaagagaagttaacactatcttgatacatatcattgaatatggtttggacattcaaatataatacaagtgatatggatattttggggttagtacctaaatattaggatataaatagaacgatgcaaaatgaattattggtttgcgtcttgccaaactaatttgattttctggccttcatatcaagattttttctctttggcaaactaacttggtttgcgtcttggctgtagaagctgtctccaactagaattttatcttatcatttgtttttgtaaatctttctgttaattcttatgattttatcttgagtgtataacatacttttcaaattnnttacagttct

SEQ ID NO: 5763 - DNA, 438 bp, Glycine max
aagagtttggggagaatgttagttcgggtccggttgcggatccgggttcgggtcggaatcccgggttggagatgcaaagcaatgggaacgcagagaattttctgagtttgcaaaatggtgattcaagctgttggaatggtactagtggttggtctcaccttgctattttcactcctgggtcaagctttcagtaatgacaaattaatgaatatgattactctgatctgtatatttagacatatgtcgtactattatggaggatcacaaaccagaaggccactgctataggatcattaggtaaagtttctcctgttttggatttttatatttgtgaattgtggttggtgttcttcagttatatcaatgatggaagagaaatggaaagcaagtcatattttagggcagggtatggggggatatgaatgttgttgtagtgag

SEQ ID NO: 5764 - DNA, 838 bp, Glycine max
ttatgatggatcccttgtggctgtaaagcgtgccaagaaggtataataatcatcttttgttatttcacatctctagaattgttcaattgtgctttaagttgatgtaagagaagcaggttcatcatatataagcctgatcatgtatgacttttttagttttattactttttattgatgagcctgatgtagtgaagtttcttggcaggatttaccaaacaataacttagctgagttcaagaatgaaataaacaccttgtcaaaaattgagcacattaaccttgtaaagtggtatggatatttggagcatggacatgaaaaaattattgttgttgaatatgttagtaatggaactcttcgggaacatttagatggtaagtccagggttataacggaactctgtctaatggtcttaggaatccctcatagtctatatatttggtctataaagaagttatcaaatacatcaactttatagtcagtttctatagcctatattgacataaacagaaattggcacttattaatgcaggtattcggggagatgtactagaaattggtgagcgtctagacatagcaattgatatagctcatgcaattacttaccttcatatgtacacaggtatgtgtccttagaattagattacaaaacaaaatgtaacaacaaatttggattgcttaattattgcattatatttacatgtattcatgcatgctatttgcaaagtttgataaagtaatcttacaacaatctttagtcttatttgtgctcttaatgactgaatgtatgtgttgtttgattgacagatcatccaattattcatagagacatcaaagcatc

SEQ ID NO: 5765 - DNA, 160 bp, Glycine max
tacttatgcaggctattgacggagaacctgtgataggtccaataagtgcaccaagttcaggttgtgaaaaattattagggagagtaccagaggacctgaatggtggaatggtgaagcttacttggctcaaggagttcttctctgagtgtcctgaagatgc

SEQ ID NO: 5766 - DNA, 270 bp, Glycine max
catctggaagatcttgcacaactgaagttatggaacaagaaatttggaaagattttcctgaagatttatttgaggctgtgattgcacgacttcccattgccacatttttccgcttccgctctgtctgccggcagtggaattccatgctgacttctcatagtttttctctgcattgtactcaagtcacacaagaaagcccatggttttacaccattacccatgaaaatgtgaattcgggagccatgtatgacccttcattgaaaaaatggc

SEQ ID NO: 5767 - DNA, 432 bp, Glycine max
cgaaatctatgatcagaaacagatctatataaattacttgtacaaactgcaaagtacctttatgttaccagatccttcttctataatccagcatgaccagtgtctgaattaagaatcagaaaaatgtcttgtattttctgggattgaaaacacaaactatgtgtttctttatttatttttctatattcttactacactcagaaggtagatcaacattgtgcaatgtttatacacatattttgactgtggtctgagggtattatcgtgatgtaatgatatattcctccttgcatataaaatagagtgcccacgttaatatttggaactagggatgaacatgtcatctcatccaagtaataaaattaaaagtctgatgccaaaatcccagtctgtataagagataatgccagaagcatagtaatgttggtaaaa

SEQ ID NO: 5768 - DNA, 389 bp, Glycine max
cagcattttggggatctgatgggaagctctcaaaccacattgtcaacgggaattctgcatcagttctaaaatgaagctctcataatgtttggattaccgtttgcaggtggtgaatctatattgaaagtacgtagggagaagcatgcttttgttacttttgagttaataactttggaaggattggaacggtaatccaaacatacacttggttttagtggagatggtatggatactaatcattgtaaagccattagctcctggcaaattagaactaggggtgcatccccagtttaattaattactgcaaagagggatttataatacagttatcatttatatactgcatcactattccatcctgatatggtgcaacttgttcctaagctaga

SEQ ID NO: 5769 - DNA, 412 bp, Glycine max
agttatagctggggaagcactagggataaagtctccaatctacacaaggacaccaaccatgttcttggacttctctctcaaacctggaggtcacttgcaacaacctataccaaattcttggaatgcttttgtctatatattggaaggagagggtatatttggaaacatgatatctcagccttcaaactctcaccatattcttcttcttggtcctggggatggcctagaggcatggaacaaatcttctaagctccttaggttcattttggttggagcagaacccttgggggaacctctagtgcaatttggaccctttgtcatgaattcacaagaagagattgatcaaaccattgatgattttgagaactttgccaacggatttgaaaaggcaagacattggacatctgaaagc

SEQ ID NO: 5770 - DNA, 968 bp, Glycine max
  misc_feature (46)..(50): n is a, c, g, or t
  misc_feature (898)..(899): n is a, c, g, or t
  misc_feature (944)..(946): n is a, c, g, or t
  misc_feature (958)..(959): n is a, c, g, or t
  misc_feature (962)..(965): n is a, c, g, or t
tttcctgatgagttaatcagacaagagatcgccagtgacagattcnnnnntaccagatgaagttcttgatgtttacaagctttggcgcccgacccctctcattaggtatttaggtttgattgtccatcactatgttagtgcatttcctttttgttatttggagatatgagaaatgctagtagcatactcttttgaacacatttttttatttttagtattagctgaaatttattgaaaatcacaaaattttatgagtcagacttttttatttaatgagctctactcatgattttgtattttaataatgtttaactaatagtaaatagtgcattagaaagactgtgttagatagtatgttgctatcattcctcttggagctattgtctgaggcttatatatctctgttgaatttagagccaagaggctggaaaagcttcttgatacgccggctaggatttactacaagtatgaaggtgtaagccccgctggatcacacaaaccaaactctgctgttccacaagcctggtataatttacaagcaggtgtcaagaatgttgtgacagaaactggtgctggacagtggggaagtgcattggcctttgcgtgcagcatatttggtcttggctgtgaggtattgccctatggggattgaattcattaagaatttaactaactgcttgctagtcttggtacatttaactatttgttataatgcgttttgtttacaattaagaaaaaaaaatgtaattgaagttatatacaagtaattgtgcactttgaaagaagtcatcaatggtagtttcttgtttagcacctcatataatcttttgagtatcattaacctgttcaactccaacaccaacaaagttagtgctaattgaataattcatcaaggcannaatggaattgtgcacatgatgttattcgagttcaagttatgaaannnatgatgtttacnnaannnngtt

SEQ ID NO: 5771 - DNA, 408 bp, Glycine max
  misc_feature (398)..(398): n is a, c, g, or t
aagtgttaacaaccaaagctactaccacaatcttgtgctacaagacaaattacaagaattcaggaaacagtaccctcaagctgtcatactttatgctgattactatgatgcctaccgcactgtcatgaagaatccaagcaaatacggattcaaagagaccttcaacgtttgctgtggatcaggagaaccaccttataacttcactgtgtttgccacatgtggcacacctaatgccactgtgtgttcaagcccttctcagtacatcaattgggatggtgttcatctcacggaggccatgtacaaagtaatttctagtatgtttttgcaaggaaatttcacccaacctccgtttaattttttgttggaaaaaaaggagagggtggggtgaatggttagantttggggata

SEQ ID NO: 5772 - DNA, 912 bp, Glycine max
ctttcctttggcctaaatcaacaacattacttgtggtagtaacactttcttgaagagatggagctactatgcttctctgtttgcttgaaaatcggtagtgctgaatccatggattttccatcaaatcatgacactggttaatcctactcatttgcggattcactctctcaaaattgattttttgccaacagccaccacgtagtaccttgaactgttattattgagaaaaagaaaacttagttttgtcaaggtgtagaagaggaaggatatacaagatataggatgatcaaactctacaggttgtgtgtataatcctacataaggcaatgtcccacattaatttcaaggaggggaagaaaaagaaagacaacaaaaaaaggtaaataatctatactcggacggtctaatcacaaattgacctgcatgataaattaattaacttttacaataattatcttaaaagtcatttatcattatttcttattgattgatactgacagtgtacaaaattttgcactgataatgcatataaatgaaactcaaatgaaaaatgatgacattcatgataacaaccaaacccctctgccaaaaaatacatattgagagaaatgttagcaacattctctctctttataattggctgaaatttattgaaaaatgactcctaatttagaagtgagaccaaccaaaatttgtgatttataataaatttcagtcaatcatagagatgattagaaataaagtgttacagagattgtcgctagcatgtgtgtatattaaaaaaaaacaagtcaaatttatggagtgtgtagaaaaaattaaaaaggcaacctggccggaagtggtagcagagtcatatgaagttttcatttgcttagaatcatataactgattaacgaaagatgcttctat

SEQ ID NO: 5773 - DNA, 715 bp, Glycine max
  misc_feature (710)..(710): n is a, c, g, or t
  misc_feature (712)..(712): n is a, c, g, or t
atgttggtgtggttgattctgagtacatagttcatctgggtctgcctactcttgggggctcaaatggcaatgaggcaagtgattttcatttctacatgcagtgaaactagtggataatagttgcataaagatttgttatgtttgtagtaatccactgctaccaactttaaaatgcttgaattaaacctaattgttttgcaggttcaggtaaatataactatgttttgattatactatagtctaagtattaataagggttttgtgatttgtcctttgcgttgcaggcgccatcagactccccaggagataatagagctaaagtaagtaaacataggataatgtagatttatgcacctttagttccaattctcgcccttatttgacaaaggaatatactacacgcaggttaggatgcagtcatacattgaaatgcaggtttttggtaaaaggtggaaagatgcagcagagaaagacaaatgttggattgatccgtatgaacaggcaaacaagacaagccattagtgtattttgtgaggctttaagtgatcaaaatccaagtacagtgtccatgttcataatcagcttttgttttctagtcttcgttagagcttttgatttgatatctcaggtgtgggatctcgtaagagtttgcaggaacattgcttcctttaccattattttactttcgttttgtcatcaagccatttcantncaa

SEQ ID NO: 5774 - DNA, 380 bp, Glycine max
gcagcacaaaatatggtcctaaagtaccaagtgggtgtcctccaaggtgccacagttcaagaggtagacttgaaggatgttgtggacaaggaatccaacaccaaagagatgagtgccttcgtgatcaaagagggtgcaaggtctaagtcccttgctttttacgagttctttgttccacttcttgtagctggtctatattttggttaccgatgcctcacttattagctcatcttataattgagactcgctgtctgaatgtttattgtatatttatattcgcttttaattgagacttgagtgtgtgattgttctactcattttctactttccaatacactttcaacgcaaatctgtctttatggttattgacgtttaacttg

SEQ ID NO: 5775 - DNA, 766 bp, Glycine max
ttacattgattagtcgtaacacttagagattggccttctaccacaccatcctgtgcagtaggctttgaacgagcaggagcaggggcaggagcaggggactcactcaactcaattagctgagagagaagttttctgacagatgattcaataacttcccggcccggtggtttgtctcctccagaaagcacaagtggatctagtgcgtagaacaaaagtattcgaactatatcaacagttcgggcatcagtttcaaaatccttcagaatcacataagctctatcacaagagcttcgtagatagcaagcaccacaaacctagatggaagcaaaatgccccctcaaactcaggcagaaaaataaaaataataataataaaataaaattccatctcatactgtcatatacatagactaataataacaagcaacaacagttaacatctcacttcgttgactagaagaaagactaacaatacactgtctaacactcacgcttcagtattgagtaaaattccgcactactatttatgagaacagtatgagatttcattcacacaataatagtgtgttaaaaagggaacgttaaatcaatgcataatttcttcacatttatctataataactattacttgcaagttgcaaccgataacttcaaaaaacataaatacttccgatgaaaaattgaaaaaaaaataaaaatgaactaacacacatacatccccttcatctaattgcaggtgtgctctcagcctcttagctgaattaaca

SEQ ID NO: 5776 - DNA, 609 bp, Glycine max
  misc_feature (581)..(583): n is a, c, g, or t
  misc_feature (585)..(593): n is a, c, g, or t
aggtgagagaactaacgtatttcatcaaaataattgacttgattcgctgcagcagttaattcagttttgatgttcatttcctccgtctttgtttgttctctaaattctctccctttcctcatttcctgcaggaaatagaaaaattggctcctttcccccttagtttcagaaggaattgattgctcgacgactgttaattttgtaaggtaacattcagtttttctggatctcttcttaatctcaatcgctcacaagacaatatgagtgtcgctttgaaaagatgagccttccgagaccagttgaattgaatcaatcgatgcctcgttttcacattgtcttagctatcctttcaaaaacattgaacctctttttccatgtatatattgaatctcaagataatatagtatactgtatatcttagccagaaaattttcatgatctccggttctccctctcgtaactgtcatcatccatttttgtcttgacccagatatagaagatgctcacagtgcacaattccctttctttttcttttttaattttcggaatccatgaaccgtccgatgcacacatcctgtaannntnnnnnnnnnttcaatttgagtttgt

SEQ ID NO: 5777 - DNA, 387 bp, Glycine max
aatatttgtgattccatgcccaacgccctaccctgaaaatatggtagccgagagagaggttaacggtaacggtaacggcgtcggagagggaagaacaacgctaatattcacctacggaaccctgaagcgaggcttctccaaccacccccttctccaagacctcattcgctccggcgacgcctccttcgtcggaacctaccgcaccgccgccaaatatcctctggtctgtgggccctacaaggtccccttcctcctcaacattcccgggtcgggtcatggggtccatggggagctttactcggtctccacgcgcggcctcgagcgcatggacgagctcgagggaacctcacgcgcccactacgagcgtctcccgatcaaggtggttca

SEQ ID NO: 5778 - DNA, 512 bp, Glycine max
  misc_feature (412)..(414): n is a, c, g, or t
  misc_feature (420)..(424): n is a, c, g, or t
  misc_feature (426)..(441): n is a, c, g, or t
  misc_feature (446)..(461): n is a, c, g, or t
  misc_feature (470)..(476): n is a, c, g, or t
  misc_feature (478)..(480): n is a, c, g, or t
  misc_feature (482)..(482): n is a, c, g, or t
  misc_feature (484)..(495): n is a, c, g, or t
  misc_feature (497)..(499): n is a, c, g, or t
  misc_feature (502)..(504): n is a, c, g, or t
  misc_feature (506)..(509): n is a, c, g, or t
tcctggctccattcctcggaccacccagcagaccacatcacctgcattggcatccctttcaacccctcaccccactcttccaagccaaagctagaattcaccctcttcccaacattcacaaccgccctcctcccatctcttcccttcaacaaggccctcgacgcctctgaatcggcgacaccaaccctcttggaacagcacaaagccaccaccttagcaaaaacaaaagaaacccccaacaccacctccctcaccacaggcacctccagagcccaaacgggaaaagcccccttagtagacgacgccgtatcgataagcgtcacgctcctcaccaactcaggcctctcagaaacaaaattagcactcaaccccaatgcggaatcgtgaagaatcaaatgaacaggtgcacccnnntttccnnnnncnnnnnnnnnnnnnnnncctannnnnnnnnnnnnnnntccttatcnnnnnnncnnntncnnnnnnnnnnnnannnccnnncnnnncat

SEQ ID NO: 5779 - DNA, 408 bp, Glycine max
attttggaaaccgaacatgaaagattgtttgtgacaagttgcctacaaaagaggctgcagcaacagccatagtagcttcatgaagaatgcattgattggtgatgatttgtaagctccaatatagatgcaaacttagacaagtggggtggatttgttaattcatgtttcttgttgcttacatttttaattttcctcttttgttttttgagctgcttgtagagttggctttagagatttgttacatatcgggaagccatggtgtactttgaagcaagattgtatgtatgggtagagaacctctactgatatatataaatcgcttcttttgcatacagaaaggatttccaacttgtgtaaaaatttagtgttcattttcatgctatactgtaccataccatccaattggtg

SEQ ID NO: 5780 - DNA, 446 bp, Glycine max
  misc_feature (432)..(433): n is a, c, g, or t
gtcagatttgaataatggaggtcatgtaaaatcaccatatgtcatgtatttaaaggtgtggtcatcactgtgcctcaagtttaatactttttcctgctttgatttatttgcacaagatatgttactttgtgtatcttgaaacaaattataggtgaaagttttggtcttggaacctggtccacgcttgggggaccaagagaaggaagggatcatagatgcagatggtgaggttctggcaagggggaaagggtcgtaccaatgtgagcagaaggctttgatggcctatgataaacttcaaataacagtagatcaaggtttagctactattttttctccaatataaaaaccttgatttttataacaaaaaagaaaaaaaaaacaaaagaaagaataatcttggtttaataattttggaaaaaagcaactatcagnncaaccttatttca

SEQ ID NO: 5781 - DNA, 400 bp, Glycine max
aagcagcagctcctatatacagcgcacatgcctgcacagatgatggaccattttaccaacccaacacaacataccaaaccaacttgaagctcctcctctcttccctcgtctccaacgccaccctccaccagggcttcttcctcaccaacatctccctcggaaaccccgatgaggtcaagggactcttcctctgccgcggtgacgtcaccccctccgtctgtcacgactgcgtcgccgccgcggcaaccaacatcacagacctctgcaccaaccaaacagagtccgtgatctggtatgaccagtgtatgttgcgctactccaacctttccttcctcaacaacatagtccctggagttaacttgaattccgaacagaacgtctctgactccaacaataccgg

SEQ ID NO: 5782 - DNA, 370 bp, Glycine max
cctcaattctcagagacataagctttaccacggtccatggccaaggagttcgtgtgccagtacgcatacacggtagtgaggagattcctgtgagaaatgtgacttttcaagacatgtcagttggtctaacctacaagaaaaagcatatctttcagtgtgcatttgttcaaggccgtgtaataggtaccatctatcctgctccctgtgagaaccttgatcggtacaatgagcaaggacagttggttaagcattctgcgtcccagaatgtaacagatatagattatgatatttgaggtcattgttccttttacttgggcctcaatttatgtccgtattagatcaaatttttttgtggaggttggagaagtca

SEQ ID NO: 5783 - DNA, 669 bp, Glycine max
agaaagatataggaaaacatataagaactgtattctgcccagagtgccaaggtactggtatgatcattgatggagatggggtggagcagccagaattttctttgtcgcaggtttgtttattacatcgataattctttgttaatcatcaagcttatctagtatataatcaatcccttttctcttttcatttttttagcacaaatacttttattcctggtaaatatactcgtcttatgttcagaaaacaagtttatttggaatttatcggatattacctaatcttcttgcagatgttcaaattcaaaataaaggcatgtgatgcacgcagagattggatcaagagtcctgaagttttgcagaattgctcaactgggtttcacttcccttcacaatctgaagagatatttgaggtctttaacatttctgcacttattacatttaaattagattttcaattgtataatatcttctaataaatttattgtgattattgctttgatttcaggaaaaagtggaacccataaatttactgcatttttatcgtgctgatgatcagagtggggcataacaaccgggcaaacgtttcgtatacatctgagtatattggtcttatatttttaagagttatgtgtaactttttaggtaaatgttggtcgatagactgggtta

SEQ ID NO: 5784 - DNA, 533 bp, Glycine max
cagcaggcccttggtatatataaccagtatttgagcaaaagttaactaagcacaaagcattatcattactactataagcttatagttgaaatctttgagcatagaaaaaagatgccgatttctagaattgccattggaaatccttcagagtttggccaagcggatgcgcttaaggctgctcttgctgagttcatctcaatgctaatatttgtctttgcaggagaaggctctggcatggcatatagtaaggccttatttatttgtgcacaactcttcttttccgaatttttttttatcgataaatgttaattgttaatttttttttagcaaaaacccgtcacctttctcaccttctccttttaggcttttaccactcatccaaccttataattcttcttctctctgtcttgttttcattgacaatttgaaccatgcagtaactctatgaactcttttgggtgtttttggcagacaaactcacagacaatggttcggcaacaccagctggggtggtggcagcatccctgtctcat

SEQ ID NO: 5785 - DNA, 417 bp, Glycine max
aacaacccactacacatttttttgtttcttcttctcttcagttgttgttgttgttgttgccatgacaacaatcacaaagcacagttacaaactctccctcaagagagccacaaagagaataacaagaaggagaagaagacacccacagcacaaccacccaaaaagcaccaccacaattgtgcacagaaagtgcagcaacaacaacaataataataagctttgtgaaaagcttgaggctttgaagaacttaatccccacaacaacaacaacaacaacaacaacccacgatggagaagaagaagcggtgaaacccgaccagctgttcaaggaaaccgcagagtacatcgtgttgctgcggacgcgcgtcgtggttctccagaaactcattgagtattatggaaacaacaacgacaccac

SEQ ID NO: 5786 - DNA, 502 bp, Glycine max
agtcacacctcactcaatgaaacaaggaaggaacaacaaaaactcaatgttcccatctgcaacagcgacaaaaccgaggtaatgataaccaaagcgcgtcgttttggttcgtcttttttcttttcttttcggggaagctaacgttgtttgtttgtttgtttttgtagaatcagaagatgatggctcgcggtttggccgggtcgcctcagtctatactgagcggaatcggaagctggtcgggtcggagcggagggtccggcgacggaagcccgaacgggtcttcccgtgttgcgtcgccaaccacgacgccgtttgagggctcaaacgacgcgttggatgtgctgtatgcagctgcagggcaagttgcgaggttgaagatgaacgacgaagtctcttcgaagttcgattttcagagcaggggagtgctgggtggtcttcctccacctgttgcggcggagaacgcgttttttgcaaaccagagtgtttctcaagttcggtaaaa

SEQ ID NO: 5787 - DNA, 220 bp, Glycine max
ttgaagaagctcttttggaggccaaagatttgtgaaagaatgaggccaaaaaatttgagaaacggaatggccagtggttcctgcctgttgcagaaaccactatattaggaaatgatccgttgattcattaacaaaaggagatcaattggaaaatggggcacacaaataaattcaacccaacaaactcattaacatcaataacaatcaacaaaaaaaaaaa

SEQ ID NO: 5788 - DNA, 395 bp, Glycine max
tggacgcacagcaatggcactagcaaaaccaaagaacgaccaaaactggataaggaaacaaaaacagctcctcctaaaatcactgagcagacaaatgcggacatatcggtccaatcatgagcttcccaggattttactgacctccagctgagaggaaaatagccttcattgtcttaacagatggatactttgcagaaaagatggcctaattttcttttcatccggactgacatttttatgtgatttgcttgttttttttttttttttttaaatttggaaggggattttttttggaaattaattccggcactttttttttttttaaaaaaaaaattaagggaaaagggtgggcccgggggacaaaattttatttcccccaattgcccccaaagggg

SEQ ID NO: 5789 - DNA, 475 bp, Glycine max
ttgagaaaaaaatgtgtcctctgcgattcattctgatattcttgtccgcaaccctcgccggttttttcgttctcagaaacctcagatctcagcctcaaattgaagaaggcgacgctgttgttcctcccaaccctaaaatctcagactcctccgacgcttcctcaaatgtaacttccaaggttgacccatttcacccttttgcctcaatttcacaaaaaagttcgctttttctaataaccctaatttttttgtggttgcagcttcgcgctgtggtagagtctgggttctggaccttcgtggatatggctagtggccgttatctttggaggcatttggtctgtaattcttccaagagatcgtgatgatgcgattgtatgttgttgtaattgttcggttccatgatctctgtgggcccaaattaggtaattgaacgttgcctctgggattgtaatttttagggtcagtttggatgctg

SEQ ID NO: 5790 - DNA, 511 bp, Glycine max
acgacactctctcctgcttcttagctgttttgaggatatattgaagaaggatccaacatgtagtgacaccttagcaaaacttatcaagatgcaccaaaatggtactttcattctgaatcatgtttgttatatgatttgaataatttatagtcattcttctgctacagacaaagcaaaacctttatatgcttaatgatacattatgcctatgtcgttaattggtttcttctgatattttacaggagactatagtcttgtatctctgctggaaatgattgctttacatttagatgctacagatgcagagtacaatacgtggaaggtgttctcttcatgtttcttgagactgtcttcctacgaagaagactgcatgtcttcatgccccattcaaaatgaagatggacataagcaacattttccccttaacaaaacccctaaaatatttacggatggtatatcaggaaaatcttggaggcttcgctgtaggtggtggctaactaaacatttcagc

SEQ ID NO: 5791 - DNA, 1454 bp, Glycine max
  misc_feature (667)..(672): n is a, c, g, or t
  misc_feature (678)..(680): n is a, c, g, or t
  misc_feature (695)..(697): n is a, c, g, or t
  misc_feature (703)..(706): n is a, c, g, or t
  misc_feature (710)..(712): n is a, c, g, or t
  misc_feature (731)..(734): n is a, c, g, or t
  misc_feature (740)..(743): n is a, c, g, or t
  misc_feature (753)..(754): n is a, c, g, or t
  misc_feature (762)..(766): n is a, c, g, or t
  misc_feature (770)..(780): n is a, c, g, or t
  misc_feature (786)..(788): n is a, c, g, or t
  misc_feature (792)..(794): n is a, c, g, or t
  misc_feature (805)..(806): n is a, c, g, or t
  misc_feature (809)..(814): n is a, c, g, or t
  misc_feature (816)..(816): n is a, c, g, or t
  misc_feature (836)..(837): n is a, c, g, or t
  misc_feature (840)..(845): n is a, c, g, or t
  misc_feature (850)..(862): n is a, c, g, or t
  misc_feature (866)..(866): n is a, c, g, or t
  misc_feature (868)..(868): n is a, c, g, or t
  misc_feature (871)..(887): n is a, c, g, or t
  misc_feature (890)..(890): n is a, c, g, or t
  misc_feature (901)..(903): n is a, c, g, or t
  misc_feature (905)..(911): n is a, c, g, or t
  misc_feature (917)..(922): n is a, c, g, or t
  misc_feature (939)..(944): n is a, c, g, or t
  misc_feature (959)..(960): n is a, c, g, or t
  misc_feature (967)..(972): n is a, c, g, or t
  misc_feature (974)..(977): n is a, c, g, or t
  misc_feature (983)..(983): n is a, c, g, or t
  misc_feature (985)..(987): n is a, c, g, or t
  misc_feature (994)..(995): n is a, c, g, or t
  misc_feature (1001)..(1005): n is a, c, g, or t
  misc_feature (1009)..(1009): n is a, c, g, or t
  misc_feature (1011)..(1014): n is a, c, g, or t
  misc_feature (1016)..(1024): n is a, c, g, or t
  misc_feature (1026)..(1028): n is a, c, g, or t
  misc_feature (1031)..(1037): n is a, c, g, or t
  misc_feature (1040)..(1055): n is a, c, g, or t
  misc_feature (1058)..(1059): n is a, c, g, or t
  misc_feature (1064)..(1067): n is a, c, g, or t
  misc_feature (1070)..(1072): n is a, c, g, or t
  misc_feature (1074)..(1082): n is a, c, g, or t
  misc_feature (1085)..(1089): n is a, c, g, or t
  misc_feature (1091)..(1097): n is a, c, g, or t
  misc_feature (1105)..(1113): n is a, c, g, or t
  misc_feature (1115)..(1125): n is a, c, g, or t
  misc_feature (1128)..(1138): n is a, c, g, or t
  misc_feature (1140)..(1151): n is a, c, g, or t
  misc_feature (1154)..(1161): n is a, c, g, or t
  misc_feature (1164)..(1168): n is a, c, g, or t
  misc_feature (1170)..(1173): n is a, c, g, or t
  misc_feature (1176)..(1184): n is a, c, g, or t
  misc_feature (1186)..(1186): n is a, c, g, or t
  misc_feature (1188)..(1193): n is a, c, g, or t
  misc_feature (1197)..(1203): n is a, c, g, or t
  misc_feature (1207)..(1223): n is a, c, g, or t
  misc_feature (1225)..(1233): n is a, c, g, or t
  misc_feature (1236)..(1241): n is a, c, g, or t
  misc_feature (1245)..(1250): n is a, c, g, or t
  misc_feature (1254)..(1257): n is a, c, g, or t
  misc_feature (1271)..(1274): n is a, c, g, or t
  misc_feature (1277)..(1290): n is a, c, g, or t
  misc_feature (1293)..(1299): n is a, c, g, or t
  misc_feature (1301)..(1316): n is a, c, g, or t
  misc_feature (1319)..(1322): n is a, c, g, or t
  misc_feature (1331)..(1370): n is a, c, g, or t
  misc_feature (1372)..(1374): n is a, c, g, or t
  misc_feature (1376)..(1406): n is a, c, g, or t
  misc_feature (1413)..(1413): n is a, c, g, or t
  misc_feature (1415)..(1415): n is a, c, g, or t
  misc_feature (1417)..(1419): n is a, c, g, or t
  misc_feature (1421)..(1426): n is a, c, g, or t
  misc_feature (1429)..(1447): n is a, c, g, or t
  misc_feature (1449)..(1449): n is a, c, g, or t
tccctcgttatgttttaggatcggtccaaggaacatgtccttcaatctttggatcccccttcctccctcacccacggaatccacgtctttcattgccccgtaatcaacatacatactcttatgctatgccgttttggttttgttttctgttattggaaaagggaattgaatttgattttgttgataggatgcggttggaattgtagccaagctgtccgactgtattgcctctagaggtggaaacattctcgccgctgatgtttttgttcctgaaaataaacaagtcttctactccagaaggtacactcattcattctctaatttcagtaatgtttttttttttttttgggtaaaaggggggaaaggaaattcaaaccaaagttttttgggtttcccccaaaaccaaggggggtggacgggcaattgctttgtaaattttttgggttccaaaaaggaaaaaacttaaaaaaaattcccaaacctttttttcccaaaaaaaaaccaattttttttccccccctttttgccctttttttttttttgaaatttggaaaaaagggggggggtaccccaaaaaaaggccaatttttggtggaaaaaaaccggggggggttttaaattttttccttccccaaaaatttttttttctcaaatttttaggggggtnnnnnncttttnnngaaaaaccccctttnnngggggnnnntggnnntaacccctggtaacccccnnnncccccnnnnaaaaaaaaannaaaaagannnnnaaannnnnnnnnnncccccnnntttnnngggggggggcnnaannnnnntntttttttttttttttttttnnggnnnnnnaaaannnnnnnnnnnnncccntnccnnnnnnnnnnnnnnnnnatnaattggtgggnnntnnnnnnnaaaaannnnnnttttaaaaaaaaacggnnnnnnccccccccccccacnnaaacagnnnnnngnnnnattttntnnnttttttnnttttcnnnnnacanannnnannnnnnnnncnnnggnnnnnnncannnnnnnnnnnnnnnnagnntattnnnnctnnncnnnnnnnnnttnnnnntnnnnnnnttctattnnnnnnnnnannnnnnnnnnnacnnnnnnnnnnncnnnnnnnnnnnnaannnnnnnnctnnnnncnnnnctnnnnnnnnnantnnnnnntttnnnnnnnatannnnnnnnnnnnnnnnncnnnnnnnnnacnnnnnntatnnnnnntttnnnnttttcttttctttnnnnatnnnnnnnnnnnnnntgnnnnnnnannnnnnnnnnnnnnnnccnnnncccctcctnnnnnnnnnnnnnnnnnnnnnnnnnnnnnnnnnnnnnnnntnnntnnnnnnnnnnnnnnnnnnnnnnnnnnnnnnnttcctcntntnnntnnnnnnatnnnnnnnnnnnnnnnnnnnancttac

SEQ ID NO: 5792 - DNA, 400 bp, Glycine max
atggaaaggtattgtaattcattcatagctttgatattactgaggacttataaggtctgatgtgattttcctgtgatcaggttgcagctatgcggtgtattgatggacatatcttaggcctctatgaacccgtgtaaagatacacataacataggagattcagtatcaacagtaccctcttttgtcatggtggattccttgcaataattgatgctgttctcttgtcaagacctgtagcagcaggattgtagcgtgtgaagcaatagggctgagaataaggcaaaatgattaggagatagaaaaaaagctatccagatatctccaaattatctgtcttgtagatgggtttgtttggtgccatccatatctgctagaggtgacagcaaatcatctgttggtt

SEQ ID NO: 5793 - DNA, 322 bp, Glycine max
aatataggactataggtataaattccatttttaaaaaagaggattttttaattgagtatcaaggagttaaagaatttaagacaaaataccaaattaaagtagatcaattttttttcattcccgaggaagtgcatattttaccagaatcttcttccataatggtacggaacaatagtatcgttgaagtagatacactaatcactttaaatataagaagtcgagtaaggggattggtccgattggagaagaaaaaaaaaaagattgaattaaaaatattttccggggatatctattttcccggaaaaagggataaaatatccca

SEQ ID NO: 5794 - DNA, 417 bp, Glycine max
ccgttccggcaagggctatggcggcggaggcggcggtggtggctgcaccattgattgcaaaaagaagtgcatcgcttattgctaagccataatatggtagcacttatcatcacttgtactagtattattgctagtattactattattattattatgtatgcaattaaacttatattatatggtcatcttggttacccttttagataaataaatgaaaagtagatacatctctatgtaggtgggtttctttttggtgttttgggtgttgcttttgactattatatcttgttaaatctatgggtggaaaaaaatattatgagacactacttggtgggtgagaggagtgttaagcatgggctgtaattttggttactaaataatataaagatggtgtattattaattgcctggctgttcc

SEQ ID NO: 5795 - DNA, 1167 bp, Glycine max
atctccgcgcccttcgcacaccaagctttgccacttctctgcaaacaacgttcccttttctatccaaccctttcattccagattctaccacaaccaccgtttaaagcccataatcaccaattgcgatggcaaggtatatacttttttttgagtagtggcacaattctaatttcacatatgtttcacttttttctttctttctgggttttgaagctgaatagctcaggtgggggagaggcatatgcgatggatgaagcgggttttgacgagtacgatggagttgaagaggaaagcgatgacgaggatgatgcagagagtagcgtggatttgttgatcaaattcttgcagagcatgtttaagaaggtgtctaagcgggcaaagaaagcatctcgctctgttttgcccacagtgatatcgccccagctcgtgagtgcccccttttgttctctgcttttaaatcataaattttgtatttttattttaatttttgtagctaccaaattaatgagttatggttcagtttattgtactagagatcatgaatagtttaattgtggggggtataagattggtttagtgacgaaggaaaggggagagagattacacattcgaattcttccgctaacaaaaactaacaactaacatttgccaccgataaaaaaatgaatagttaattgtttatatccccaatttatgtgtataattgattgttgtacacttgcttcaaactgtagcttcagatttccttcttcccccctccacccaccccaattagttactctaataaaatttggctatgggattgtggaagggcaaaatttagatgcaattagttaattacgtgtttttggctaagaaaatgtatccaagttttggccttttagtaatttaagcttgtttagtactttacaggtttcaattttaaagattaggtgtacttttggattagtaatttgtgataaaaaaaaaatgaacacaattacttcctaaaatttaagctaaactaagcatgcattgaaccttatgtcctggttttcttttgatttctagacattaggcaaggtagtatttgaatgtgcctccagcttcttttctgaaagttcatgtactggaattaatctttgactgctttctcttatttctttccattcgaatcgggaaattcag

SEQ ID NO: 5796 - DNA, 658 bp, Glycine max
  misc_feature (514)..(514): n is a, c, g, or t
  misc_feature (602)..(602): n is a, c, g, or t
  misc_feature (604)..(608): n is a, c, g, or t
gacttgaacaatgttcgtgttcttcttttagctctctctccaatcgtgtatttccttagcgagatttctggtctatccaaccaataatatcggagaatacaatctgcaaattttgtggtggctctccatacaatagaccgtgccacatttctggatacgactttagtgtcttatctgagcttgccgcctcatcatatagttgtttgctaactgctttatcagtcacttgatcttcctcaccatgtaaaactataaagggtagtgaaacctcatgcagactttgctcaatttctgtactgaccctcagaagttcgtaggctgttctcaaacgaggatttcctttgtagcaataccggttggctctaatctgcactaccacatttgttagttacttaaatatcttctctgtgctatactaatttagatattttaatgatcaattctttcaaatagttgatagttaaataaaatgacctttgtcctttggagttaccctttacttggataaggaaantacttcgcatttttttttttttattataggaatcgaaacaaacaagtatacataaacttgaacaaataaatgtaactacatatgtctnannnnntatttcaaagtgatccagaattagctattattagtttgggaattaaaatc

SEQ ID NO: 5797 - DNA, 319 bp, Glycine max
caaacacaatggttcgacgtgagctttgggccgggttgggcttcctagtggtgcaaacagcagcattcatgaggctaacattttgggaactttcttgggacgtgatggaaccaatttgcttctacgtgacctcaatgtacttcatggctggctacaccttcttccttaggacctcgaaagagccttgctttgaagggttctaccaaagccgtttcagcagcaagcagaaaagcctaatgaaacttcacaattttgacattcaaaggtataatgaactcagggctaaggcaccaccctcttcatccattattggtcacaa

SEQ ID NO: 5798 - DNA, 400 bp, Glycine max
tgttcccgccccggccgccaagacacccaaagcggccaaggcgggacaagagccggtgatggcttatcctcctgctggggcgggatccagttcgatgccctatggtacgccacaccctcccccgccgcagcaatatgcggcgacgggatatgggtatccacctcagcaggtgcatggtggatacccacctcaagcagcatatgggtacccacctcagaccggttatggatacccacaacagtcgggttatggatatccacaacaatccggatatgggtacccacctcaggctcagaaaccaaagaagaacaaatttggaatgggattgggagcaggattgcttggtggtgccttgggtggaatgttgatcggagacatggtatctgatgctgctgaatat

SEQ ID NO: 5799 - DNA, 381 bp, Glycine max
agtgccccagaagtggaaatgataaaacactcgaaccccttgaccaccaaactccaatccattttgataatctatactttcagaatttggtgagtaagaaggcccttctccattccgatcaggagctgttcaatggcagttctactgacaatctggtaagaaaatatgctaccaatgctgctgcattctttgaagactttgccaagggcatgctcaaaatgagcaacatcaagcctcttacaggaagccagggccagatcagaatcaattgtgggaaagtcaattaaacgttagcaagtgatgatgtataatatgtttttaatataaattttatttccctcctccaaagttatgtcgaataatttgatcctcgaaccgtca

SEQ ID NO: 5800 - DNA, 376 bp, Glycine max
tataacctgtctgaacacatttttaaaggttccaaactatttcttatattatttggatttgatgcctacatgtgtctgttttactgatttgttgtacttctcaaatacgtgtttatgatgttgatttgaaatatgaatgaggaatgcaagaagtctgatgcacacaaatttatcaaacctcaaaatgtacaaggttggtaatgctcattgtttctgaatttatattttgttctgaattttcaggcagttgcacctaatattgtcaatgctactgcaaagagatgaagatgccaagtcagaagtaactactgacaaagagaaggaagttatatctaccatcacttctatctttctgaggatcaagcattctgaaaaa

SEQ ID NO: 5801 - DNA, 377 bp, Glycine max
ccgctccgtcctcttcatccaccgcctcctcctcggcctcgtccactatcgcatcctcctccgccgcctccctcaccgacgagcaaaacatcgacaacctcgtgctcccgaaacccgaagtcatccgccgcctccgcttcctgaagcagccggtcacgctcttcggagaagacgatgacgccaggctggaccgcctcaagtacgtcctcaaggccggcgtcttcgaggtcgacagcgacatgacggaggggcagaccaacgatttcctgcgagatattgcggagctgaggaagcgccagaagaccgggatcctcggcgagaggaagcgccagaaggccgacgacggtgccgctcaggaccgtgagggtggagccgga

SEQ ID NO: 5802 - DNA, 500 bp, Glycine max
aagaatttcagaggcttctttggcattggaatggattgaagaatgtatggtgaagtcaaactggtggattcatatccagagctcagtggatgaaggaaggctaattgctccaaccccacctgcttctcctcaggctcagtttagtgaagagagttggacttctctttcaccccagaagttctcaacggaaattgcttcaccaacagtagaagatcatatccttgattttgctcttctatacagaagaaacaaaaatgatggacaacttgtcctgcttagtgaggatgtcactttgaaaatcaaatgcatggcagaggtatcacaaattatctacataacattactcctttcatattactctactctcatattttaagcttgtgactgcttcaggggttgctatgtgagccagtgcaagagtttcgtgagagtctagtaaatccattctctgagaggttcttgtgaaaattgtgaactgcttcttcatacgttcaagttcc

SEQ ID NO: 5803 - DNA, 386 bp, Glycine max
gaagagaaccttagatggagaaacttagaagacgaatacttacaagaaggagaaaacaactcaggtggagaaaacttagatggagaaaacaacccagaaggagaaaatttagatggagaaaacttagaagtagaaaacaacttcgaagctgaaacttagacgcagcttcgtaagtgagtgcttgtggtattgttctctaattggcattaatgtttatgtagtttcatgtcaataataatctgcataataaaggttttcattaaatgtcaatgcagattagccagctggttaaattcttattatgtcgtcgaagttttattgttgtatatgaaacaaattaaaattaaatcttgggcatgattttggtttgcccaggttgtatcttt

SEQ ID NO: 5804 - DNA, 655 bp, Glycine max
  misc_feature (528)..(529): n is a, c, g, or t
  misc_feature (550)..(554): n is a, c, g, or t
  misc_feature (557)..(560): n is a, c, g, or t
  misc_feature (564)..(566): n is a, c, g, or t
  misc_feature (569)..(574): n is a, c, g, or t
  misc_feature (578)..(578): n is a, c, g, or t
  misc_feature (581)..(590): n is a, c, g, or t
  misc_feature (592)..(594): n is a, c, g, or t
  misc_feature (605)..(619): n is a, c, g, or t
  misc_feature (623)..(636): n is a, c, g, or t
  misc_feature (638)..(639): n is a, c, g, or t
  misc_feature (642)..(647): n is a, c, g, or t
gcaaaatattaaaagtcattcagaaaggagttgacacagtctcttatgaggtagcttggcttgacaaaaacaagaatataagagaacaagcagaagtcagtgcagaagatttggtgcataagaagccgctttttagtagaaatattttgaagtcttttattcgtgagtctacatatcggaatgccccttgggttttacatgatgaactggctaaaaatcatggaatatcaactgacattcctgaagagttaagaggaagggttttttacaaagatggacttttagtttgctccaagaaaaggaaacacgaggtacacaggataagggaaatatgaaagtttctgtttctttttgctcttttatagaagtattatattattgataaatgagatagtataagaacatggtttagaaatcctaatatatggcttttatgattggtttattatttttttaattaattttattgcattattttctgtcctaaatttgtcatgtttaggaatcacgggaggacaccgatacctnntaaaagaagttggatggggcnnnnnatnnnntatnnnttnnnnnncaantcnnnnnnnnnntnnnatccctttccnnnnnnnnnnnnnnnttcnnnnnnnnnnnnnncnnctnnnnnncccctttc

SEQ ID NO: 5805 - DNA, 388 bp, Glycine max
cctctctttttaattcacttatttaatcaaataattgaataattttacgacacgaagtcacgaacgaacatgttgatgcgttaattagctgttgttgcagagtcgaattggaaaatgggccggatatgggccacggcggaggatttgggccgcaacagggcccgcgtgctgtctctttaccggcaaatactgcggggtctgaactcgccggagttgcggctgggcttcgcggcgaggctggcgaagaaggcggaggcgcgtgcaatgttctgggtgggctccgatgaacgctcgttgcacaatattgcggatctcattgatgctgcagagtactctctctcctttctcagaaaaggtcaactccctcctcgtcacatcaactaatcaa

SEQ ID NO: 5806 - DNA, 1329 bp, Glycine max
ggcagaggcagatggatgatccaatagagattgtaaattctgcaatagacctgcatacaaatatgattaaacaaatgaaaggagttcctggtaaatttatgtttctatgatgcaatcatgttgaagtagtataaggctatttgtcagattgatggacacataggtgataggtcaatagtgaagtagctaaagtagcccttgatcatgtcttgtgtactgtcaatcaccatgctctcattgaaagcattgggcacactaaggatgtgctatggtgaaggagttttgagggaaagagaaggggagggtatagttttcatttcaagtaaatattctcctgtttgagaacttttttaagtgagagattatacttgaatgtaactagagatgattgaatggaaatcctcaagtgtgttctccacacttaggctctattatattagaaaacttagcttactcagtaagctgaagagaggtaagtacaaaatacagagctctgaaaagagcaggtatacaaaagacaaaaaataaaatgtaagctactactctaggtacatcatgacctattttccaactattatcatgtaacctttcaatcatccctttggaacacatatatccctccctattcaaaaatgaaaatttaattgtcgctccatttcccttcaaaaacaacctctccatttaaaccatgccctcaatgaaaacttaaattatgttgtcatttaaaaaaaattccagtgttgatgttttattcagtgattgtattgttatatcaacactgtcttctatctagatagcccttcctaatgcatgtacatttatatggtgacaacacccattttgacattaatttccatattgccatgctgtgtgtaattttataaatcaaaagatttttttttggtgcaagtaccctgttatgtatcaattctgactgatattggggagattagcttcagattaatttcctttctgcacatcattgtcttcatgtgttgtgtgattagtttctaaactggctcatttaactcttcctgtaggagttaccttggagcgattatctgaaggtctctcaccacgtcattgtgcattatcgcttgttggtgaacctattatgtatccagagataaatgcacttgtggatgagctgcacaaaaggaggatttccacttttctagttacaaatgcacaatttccagagaaaattaagtcactgaaacctatcacccaggttttgtgactttccaaattaaactcatggttggttatgctaatgctagtaaaagttaatattcttgtttcccctttgcagttatatgtaagtgtaga

SEQ ID NO: 5807 - DNA, 392 bp, Glycine max
aaaatggtaaccattaaagcatcttacacagtccttccaaatgaaccaactccggagggccttttatggctatctgatattgatcaagtggcacgtctacgccacacacccaccatctacattttccatgcaaaacacaaccatgatacattaattgagaggatgagaaactctcttagcaagattttggttcactactatccaatagccgggtcgattgagaaggatagaaggtagtggtcgattggaattggattgcaatgcaaaaggggtggtgttgcttgaagctgaatccacaaaaacattggatgattatggagactttttacgtgagtccatcaaggacttggttccaacggttgattacacaagccctatagaggaacttccca

SEQ ID NO: 5808 - DNA, 377 bp, Glycine max
  misc_feature (366)..(371): n is a, c, g, or t
gactcatctatctctttcttttcttgagttgcttttagtttctcgtatgcttcttcgtttgatttgtttgcaagagccaacttagtttggagctctactacctccaactccacttcctttatcctactcagtgatgcttcaagctgcttttggcactcggttagatccatctctagctcaagtttctctgcctccattttctctagtttcttctccagtgcagcattcttttgaacgatagcttccacttcagcattctttgttccacagccaacattgagttggtcagatgcagtacgttccacaggaaaactgcttacactttcagaatcgggaagggcaacaagcctttccatctcaaggaannnnnnccttca

SEQ ID NO: 5809 - DNA, 1030 bp, Glycine max
  misc_feature (818)..(822): n is a, c, g, or t
  misc_feature (835)..(835): n is a, c, g, or t
  misc_feature (837)..(837): n is a, c, g, or t
  misc_feature (840)..(841): n is a, c, g, or t
  misc_feature (864)..(867): n is a, c, g, or t
  misc_feature (880)..(893): n is a, c, g, or t
  misc_feature (897)..(921): n is a, c, g, or t
  misc_feature (924)..(929): n is a, c, g, or t
  misc_feature (931)..(959): n is a, c, g, or t
  misc_feature (967)..(980): n is a, c, g, or t
  misc_feature (982)..(982): n is a, c, g, or t
  misc_feature (987)..(1011): n is a, c, g, or t
  misc_feature (1017)..(1027): n is a, c, g, or t
gagaaaaaaatgacagatgggaatcatggcaaaaaggataaggaagagaaagtattagagcacgaacagttgcagtaattttagtagctccatccaagaattcactaatcgattgtttcaaagaggttgatgacaaccaaatcaaagatagtttgagttctactagaataaggtatgctaacttatcaatcaaatgttaaatcaaatagcctagactcaggcaggagaaattaatttaatactacttaaagaacctttcaaaattttatctgttaagactaacccctaaatattaatgattttgttcagcataattggtagttcaataaactcacttccttgattgttgaaagcattcctatttcattcttccggcacttggggtaaattagatttaatggtaatgtagtttgtatgccttcatgcactgaacatcatggcattcttgcatatttaagatacagcatattaaacttagcataaagttgatgttgattccaacagttgagtggtcaagttgtagtgctcaatgcccttgcttgtgtttaatagctttgcactttacacaggtaaggagtggaggcaaaggcaaataaggaagataacagatcgagtttttgacaaagtaaagaatcaaatggaaactgataagttgaattttgaagatctgtatattgctgttttacttgtgtacaagtaagaagcctacttcattattgtatttcaacattttggtggccttggtaatgtttttgaaatactgaacaaatttgattatttcttctaaaagtgaactgtttctacgttatagtgatatnnnnnagtatatacctgntnccnntttttgaccctccatcaaaagannnngtcagagaagtcnnnnnnnnnnnnnncccnnnnnnnnnnnnnnnnnnnnnnnnntannnnnncnnnnnnnnnnnnnnnnnnnnnnnnnnnnnccttttcnnnnnnnnnnnnnncnctttnnnnnnnnnnnnnnnnnnnnnnnnnagaatnnnnnnnnnnntct

SEQ ID NO: 5810 - DNA, 385 bp, Glycine max
aaagaatgagacaacttcaagtttgcctaaagagaagcaatctgctgcagctaagactggcaagaaggggattgataaaaaagcttcaggtgcttcccttttcatctcatttgggccaggatcctctctgccttcaaattcggatcttaccacactgtatggtaagtttggagctctgaatgaatcagaaacatctatgctctctagtgattgcactgctcgtgtgttcttcctgaaagcctctgatgctgaaaaggccttgagccattcacagaacatgaacccctttggctcttccgaagcctctttcagacttgagtatctttctgctggttccaagtctgaaaaatccaagtttaaagcttcttcaacaaagaagaaagac

SEQ ID NO: 5811 - DNA, 730 bp, Glycine max
cttgtaggctcatcacaggtataactcattaggatgtttattaagatttaagagaaatgctagcaacacattatctgatgcattcatttcattgccctatgattcatagttctaaatagtgaatccttaaagagtggtttatggagtatatttctggaattccttgtgagaaaatagctagcaataatatactttttgacatactattattagatgtaattcacataggatccatcacatgatgaatttttcaccaataataaagaatgtgttagataatgcattgttagtaattcttttcatagtgaacctttatttgtattgaaggtttttaggattcatataggtgctgatgattttgtaaatatcaaacaggaaacaccaacacattggctggaaatgtgccacccaaggctaaccttggtgacatgaggggactagctggaggcttgaatgggctaaacacttcagccatgatagatggaggatcctttgacggcgctaaggcatacaaggacagcaaagtctgcaacatgcttacaatgcaagaattccacagaagataccatgatgaaactgggatcacatttgcttccctttacccaggttgcatcgccacaacaggcttgttcagagagcacattcccttgttcagacttctcttccctccattccaaaagtacataaccaagggctttgtctcagaagatgaatcaagaaagagacttgc

SEQ ID NO: 5812 - DNA, 397 bp, Glycine max
cagtgttgctcacatcatgaatgatgagaccactcgcaaatacttgcaatctgtgaagagattaatgacattttgccaacgccgttatccgacattgccttctaaagccgttgagttcaatagtttggcaaatggcagtgatttgcattcacttctagcagaagagagatttagtgggggcaatcaggcggcatctgaagagaggcttaggataatgcctgctccaagagacagctagtcatttatgttttgctggaatgacatcatcgtatgatgcatactatatatatgtttaattgctagatacaatctgtttgtgtttcttactgattgtataaaagaaaatgcatcttttaaaatggcaaaacatgaaaaattctgatgttgtgtacgtcgc

SEQ ID NO: 5813 - DNA, 703 bp, Glycine max
aattcatttgcaaagcagaaataggatgaacagcatgtgctctctttatagtgtcaggactagcttgagacaagccaatatactttatctttccttcgtttaccagctttttgagctcccccatcttccttacaaagaccaattttaaagcatataatcatctagaatttagaactgttagaagggaatgcataactaacaagagagacaaaaagcattcaaagcttacggtgtcttcaattggcactgaagtgtcaactcgatgttgatagtataggtcaatgtactcaacatcaaggcgcttaagactagcttcacagcactgccgcacatattcaggagtaccttttaccccagcaaacaccccatcagatctaacaagaccaaattttgtagccaactggactttttcccgaggaagttcttttaaagcctgaagacagaagcaaagaaatcaataagcacgttaaatgcaaacttgtattatgccatataatgaaatttgggacattaaattctaaatagtgtggtctctttctgaattagttgttgaccatcatataaactacagctgatataaaatgataatatattattggctcttagaatcaattaaaaaaagcaattagttggataatatgttacctttccaatcataatttcattatcatgattaagtccataaaaatctgatgtgtcaaaa

SEQ ID NO: 5814 - DNA, 495 bp, Glycine max
tgtaaaacatcagttgagctaacttcaaaattacttttaaacaatctttcccggcagaaataaataaaaatttaggtttacacataaaacaactttgtctattgaacacaacatgtcgtccagtcaaagcctctaaaggagcagtcagcacaactcaagaagcccgtcataccgaatatcaaaatttcaaattaacagcttctcaatagcatcctgcacaccaacaaaattaattcaattacaatcaaaccaatgaactgtgaattaaaactttcatcaacttaatgaccggtccagattttaacattaacaatgattaatatagttggcaaatacaccaaaattagtaatgtaaagcgctgtgaatatgaatacctttagttgctgaatttgggatttcagttgacttccttcattagttgttacagaacatgcaatcactggccgtgtgactccacatgctcgcccaagggcttgctttgatgggacgaatac

SEQ ID NO: 5815 - DNA, 369 bp, Glycine max
gagcatagttgcaagtgatgaaagtgcctccattatcacatgctactttggcacatccaagacgcacagagtctctccaaacaacctgagtgtaatgcagacactctccaccaacacaggaattagaattgtagtcatagttagacttctcatcaacccacaatttcactgcatctgtgccacttaggtcaccagtgctcatagcaagattctccccgtattggccaccaccaccagagtggatcagttgacaatcacctttacgttgattagcatagttctgtgcaaaagcagcaaccgtgtcatcccaagccaagttttgaacacccacctctgatcttgcagcgttgtgtgcattgacgtaatctg

SEQ ID NO: 5816 - DNA, 395 bp, Glycine max
gcataaaaagagagaatctcataagatcaaagcgataggatttaccttcataggcttcatttggtgtccaaaggttcgagtcttggcagaagaggcatcctcatttaacatttcgatcgtgtttcccgaaggattgagaagagaaaaaaagaaagaaagaaaggataggtttgatgggtcaaagcgcatcacgtacaacacataatagaggagagtttagcggtggtggatgccctgttcattcaaaacggcaagggcgctttgccatcataaaggagcacaaatccagattgtatattgtcagaagatgtatactgatgctaatttgttggcacaaatacaaaattagtgagtaattagagaggagctgacaattaattagctttgttcttcta

SEQ ID NO: 5817 - DNA, 707 bp, Glycine max
  misc_feature (66)..(67): n is a, c, g, or t
  misc_feature (646)..(648): n is a, c, g, or t
aatcattgaattatcacaagagatcatggtctaatgtgcataggcagtcagcatctggctcatatnngtctaattgggagcaagattgtcaccaatgctgcctcacgtgaaagcagtctgttttcaagctcgctgtctgacatgtttagccaaaagtgtaagaatttgtttcatgaatgttaaagatagtttcatgcatgtattatgggtattgtagcataatcaagttctggttgcttttactcttcctgatattttagatgggagtttctattgcattccatttgcttgtgtattgtcatttgcaatttagcatagaagaatatatgcttgttcttttgtaatgtagcaggacaatcctttcaccaaacccaccaccaaaaatatgaaacttagaaaagttatctatttgttttaggttttgtgattatactttagttttgttgatatgctcatgtgtcactgtgtgtgtatatgtatatctaatgcagtgaggttattggggaatggagtgctgtctggtcaacccattacagttggttcctttcctgaggaagaaccgtacaaatctcttgaagaaattgaggctgaaactattggaaatctccttcctgatgaagatgacctgttttctggagtcactgannngttaggattcagtactggcactagaatgaatgatgatttgaagatttgattgtcagcag

SEQ ID NO: 5818 - DNA, 661 bp, Glycine max
  misc_feature (546)..(546): n is a, c, g, or t
  misc_feature (648)..(649): n is a, c, g, or t
  misc_feature (653)..(658): n is a, c, g, or t
gcattgcgtttgattggaataaaagggtggatgttgttaagggtgtagcaaatgctttatgctatatgcatcatgattgctcacctccaatcgttcatcgtgatatatcaagcaagaatgttcttttggattccgattatgtagctcatgtctcagacttcggaacagccaagtttcttaatccagattcatccaattggacctcctttgcaggaacctttggatatgctgctccaggttaatttcctttctctatactatttgagtaaatcatgatattttagtttgtcttcgttagccatttacaaatatatatacatcacaattatcttcattttgtccttgtcactagctagtcatattttgcatataatagcacttttaatttgttacagaacttgcatacacaatggaagcaaatgagaaatgtgacgtgtatagctttggggtcttagcattggaaatattgtttggagagcaccctggtgatgttacatcttctctattgctatcatcttcatcgattggtgctacctcaacactagnagaggatcgggctcggaatttgaggaagctaagtatgaagaacctccaagaagggactgcaaggctccttcttgtaactcttttctcaatatagaaattgtnngccnnnnnnccc

SEQ ID NO: 5819 - DNA, 337 bp, Glycine max
gttggatggtcaattccacaatcccaaggaagaagtgccaaaaatttgatccctcagagacgaccatttaaagttcatcaaagtccagtagcagtgcatgaaggaatgtcataccaaatgaaccatgaaccctggttttggttccctagtccagccaccatctgggatgggcctgaatttcttgggagggtgggggttcagaaagacgatcttccatggaagatcagagcatctgttatatactctatacgtgcacatcatggagcagtgaggtctctggctgttaaccaagatgaatgtactgtttttactgcaggaattggccaaggatataaag

SEQ ID NO: 5820 - DNA, 411 bp, Glycine max
ctcagatcccaaggtgattgaggagagtgaagcaaagctggtgcaggtgttgaacatttatgaggagaggctgtcaaagactaagtatttggctggggatttcttcagcattgctgatattagccaccttccatttcttgattatgttgtgaacaatatggagaaaaagtatttgttaaaggagaggaagcatgtgggtgcctggtgggatgacataagcagtagaccatcatggaacaaggttctccagctttaccgagccccaatctagctaattgctgaatgaatttcagggaaactgctattagtatcatctttgaatatgttagtcaagaataaaattactttcaccaaattccaattaaagggagggattgaggaagaaagtgggtagtgttcaacctaatggaa

SEQ ID NO: 5821 - DNA, 397 bp, Glycine max
agcaatgaggatagttattaattctttgtaacactccttgtaatgacaagatggggagaagtagtggaccctgttatttttattgggtctcgggaattgtacaggctataagagttggctggagatcatcttggtgcagacatctatatgggaatgtattgggttgatgcgcatcatggtggtccacattgatgatatatgcatgtttaaagtttgtagtcgctgattacatacatcgtaattgttcttgaataagatcaattttgtacagacgatcaagcttttctatttttaatgcatcttgagggatcaatgtatatagcaagaataatgttaccctctattaatgaagaagatccaccttgactagtattgtcgagtcaatcctcctgtttag

SEQ ID NO: 5822 - DNA, 348 bp, Glycine max
tgctaatgtgtttgttgacaacaaagcttacagagagtttttgcactctaaatttgatgtcactgctattgacatggaaagtgctgccgttgctttaatctgtctccaacaaaagaaacccttcattgccattagatcactatctgatttagctggtgacagttctactttgtctaatgaagtggatgtgtttgcctcgttggcatcgcaaaacgctctagatgttgttgtcagatttatctccttattaaatcagtagctctaatgtgtttctcaaaaaatgttaacaagggatgtatttgagatgggcaaataatgtgttaaaattttaaaagtctatgtcatgta

SEQ ID NO: 5823 - DNA, 380 bp, Glycine max
gagcgtcttttcttctatgaattccccaaccaaaccatttcattcttcgacaccattcttccaaatctcaaacactctctttccctcacactccaacactttctaccttttgctggcaccatcatttggccccttgactcaccccaccccatcatcaactatgtccctggcaatgccgtttccctcaccatagctgagtccaacactgacttcaacatgctttgttccaatatctgtgatgcttctctacgccatcccttgataccccatttggccaattcacacgaacaagcttctgtgatggccctccaagttaccctttttccaaaccatggcttttctcttggaatagccacacaccatgcagctattgattggaa

SEQ ID NO: 5824 - DNA, 383 bp, Glycine max
  misc_feature (16)..(16): n is a, c, g, or t
atatccagtgtctctnggaagacttccagaagtttcatctccctctaactgtaagatcaaaacaaaaaatcctcaaattttgacttgcaattaatgtgttccagaagtgatccattaacacttgacatgataactcaaagtatttcctcctaatgctaagcaatgtttggcaattgacataattaaactatgataattctatcaatttcattatatccattaaatgataaactaacattaatggcgcaggaggttttagacaatctgataagatttatatctgcaaatataacagagaacagaatatagctttatttcctttaaaccagtttccaatcggtgatgtgtaatatttcaacatttgtgctctggaaaaaaaaaaa

SEQ ID NO: 5825 - DNA, 360 bp, Glycine max
ccacttagtcgtccctgtctggtcccccctcgaccgccacgagtggggggacgtcttcgatgtcctcaatcggccccgcctcgtccgtggcggccacggcaatttcatcctcatggtcggcggcctcaagtcctccttcgccctcaacgccccctgctccaccatcctcgtcctccgcctcgacctcgacaacctccgctgggacgaggccgcccgcatgcctcctgaaatgttccgcgccttccgtgagtcgaccaagttcaaggtcttcggcggcgccggcgacatggtctgcttctccgccaagaggatcgggaaattggcgctctgggaccgccgtgcctccgaggggcacgagtg

SEQ ID NO: 5826 - DNA, 386 bp, Glycine max
tgatgttcctcaaacaagatccacttggatgggccattcttacaaaagggtctcatgtgaagcttctaggtcatggtgatgctatgcttagaactgtcacagactttgagagttggaaagggacaatgcacaatgaagtgagctttgatgtagctttcaagaactactatgataaatgcaaggttaagagtgttcctcccaaatgtgaacatagggaatttgccaattaccccactgacattctagctcacataccatgtccaaataagtgtggacatgaaatggaagtttcttctgttaaatacatgtgttgtcatggtcgtgaagccagtgacattgcctaagacaaatgcatgaaataactgctacatgctcagtggtttctt

SEQ ID NO: 5827 - DNA, 1360 bp, Glycine max
  misc_feature (510)..(512): n is a, c, g, or t
  misc_feature (596)..(597): n is a, c, g, or t
  misc_feature (609)..(610): n is a, c, g, or t
  misc_feature (618)..(629): n is a, c, g, or t
  misc_feature (651)..(652): n is a, c, g, or t
  misc_feature (654)..(654): n is a, c, g, or t
  misc_feature (661)..(661): n is a, c, g, or t
  misc_feature (663)..(665): n is a, c, g, or t
  misc_feature (667)..(675): n is a, c, g, or t
  misc_feature (677)..(683): n is a, c, g, or t
  misc_feature (686)..(713): n is a, c, g, or t
  misc_feature (715)..(721): n is a, c, g, or t
  misc_feature (724)..(730): n is a, c, g, or t
  misc_feature (733)..(733): n is a, c, g, or t
  misc_feature (735)..(737): n is a, c, g, or t
  misc_feature (739)..(742): n is a, c, g, or t
  misc_feature (744)..(753): n is a, c, g, or t
  misc_feature (758)..(764): n is a, c, g, or t
  misc_feature (766)..(776): n is a, c, g, or t
  misc_feature (788)..(788): n is a, c, g, or t
  misc_feature (790)..(814): n is a, c, g, or t
  misc_feature (819)..(836): n is a, c, g, or t
  misc_feature (839)..(858): n is a, c, g, or t
  misc_feature (860)..(865): n is a, c, g, or t
  misc_feature (869)..(875): n is a, c, g, or t
  misc_feature (883)..(897): n is a, c, g, or t
  misc_feature (900)..(900): n is a, c, g, or t
  misc_feature (903)..(927): n is a, c, g, or t
  misc_feature (932)..(942): n is a, c, g, or t
  misc_feature (944)..(944): n is a, c, g, or t
  misc_feature (946)..(946): n is a, c, g, or t
  misc_feature (948)..(950): n is a, c, g, or t
  misc_feature (952)..(954): n is a, c, g, or t
  misc_feature (957)..(974): n is a, c, g, or t
  misc_feature (976)..(978): n is a, c, g, or t
  misc_feature (980)..(981): n is a, c, g, or t
  misc_feature (984)..(995): n is a, c, g, or t
  misc_feature (997)..(1002): n is a, c, g, or t
  misc_feature (1005)..(1030): n is a, c, g, or t
  misc_feature (1032)..(1040): n is a, c, g, or t
  misc_feature (1044)..(1047): n is a, c, g, or t
  misc_feature (1051)..(1053): n is a, c, g, or t
  misc_feature (1055)..(1064): n is a, c, g, or t
  misc_feature (1066)..(1074): n is a, c, g, or t
  misc_feature (1078)..(1080): n is a, c, g, or t
  misc_feature (1084)..(1095): n is a, c, g, or t
  misc_feature (1099)..(1101): n is a, c, g, or t
  misc_feature (1103)..(1104): n is a, c, g, or t
  misc_feature (1106)..(1114): n is a, c, g, or t
  misc_feature (1122)..(1123): n is a, c, g, or t
  misc_feature (1132)..(1133): n is a, c, g, or t
  misc_feature (1135)..(1136): n is a, c, g, or t
  misc_feature (1141)..(1150): n is a, c, g, or t
  misc_feature (1152)..(1155): n is a, c, g, or t
  misc_feature (1157)..(1160): n is a, c, g, or t
  misc_feature (1163)..(1170): n is a, c, g, or t
  misc_feature (1176)..(1183): n is a, c, g, or t
  misc_feature (1186)..(1189): n is a, c, g, or t
  misc_feature (1191)..(1196): n is a, c, g, or t
  misc_feature (1200)..(1210): n is a, c, g, or t
  misc_feature (1212)..(1223): n is a, c, g, or t
  misc_feature (1225)..(1225): n is a, c, g, or t
  misc_feature (1228)..(1228): n is a, c, g, or t
  misc_feature (1230)..(1233): n is a, c, g, or t
  misc_feature (1237)..(1237): n is a, c, g, or t
  misc_feature (1241)..(1247): n is a, c, g, or t
  misc_feature (1254)..(1256): n is a, c, g, or t
  misc_feature (1259)..(1262): n is a, c, g, or t
  misc_feature (1265)..(1267): n is a, c, g, or t
  misc_feature (1269)..(1271): n is a, c, g, or t
  misc_feature (1276)..(1277): n is a, c, g, or t
  misc_feature (1280)..(1280): n is a, c, g, or t
  misc_feature (1283)..(1288): n is a, c, g, or t
  misc_feature (1305)..(1324): n is a, c, g, or t
  misc_feature (1328)..(1332): n is a, c, g, or t
  misc_feature (1336)..(1357): n is a, c, g, or t
tgcgggaaaagaggtcagtgggttcacggattggaggcacttgggccattcaactgtggactttgggtggggtggcccagttactgttttgccccttggaaggaacttacttgggagtgttgagccttgcttttttttgccttattcaacagccacttcagagaagaaagaggggttcaaggttttggtgactttgagagaggctgcgttgcctgctttcagagaagacatgaaagtgttttgcaatagccaagagcagtggctgagccacatatagatgtggctttagagttgagccattgatttgatgtaaacaagtgaagatgttagttttgccattgaatattaaaattcccttcataatcaatggcacccactaacatcttcacttgtttacatcaaatcaatggctcaactctaaagccacatctatatgtggctcagccactgctcttggctattgcaaaacactttcatgtcttctctgaaagcaggcacctctctcaagtnnnaaaaccttgaacccttctttcttctctgaagtggctgttgaataaggcaaaaaaaagcaaggctcacctccaagtaagttcttnnaggggcaaaacnntaactggnnnnnnnnnnnntcacagttgaatggccaagtgnntncatcgtnannnannnnnnnnntnnnnnnnagnnnnnnnnnnnnnnnnnnnnnnnnnnnnannnnnnnaannnnnnntcntnnnannnnannnnnnnnnnttttnnnnnnngnnnnnnnnnnntaacccctcccntnnnnnnnnnnnnnnnnnnnnnnnnnccccnnnnnnnnnnnnnnnnnnatnnnnnnnnnnnnnnnnnnnncnnnnnncccnnnnnnnaccgcccnnnnnnnnnnnnnnnatntannnnnnnnnnnnnnnnnnnnnnnnnccccnnnnnnnnnnnananannnannncannnnnnnnnnnnnnnnnncnnntnntannnnnnnnnnnntnnnnnnttnnnnnnnnnnnnnnnnnnnnnnnnnnannnnnnnnnatgnnnntctnnncnnnnnnnnnntnnnnnnnnnaatnnnttannnnnnnnnnnnttgnnncnntnnnnnnnnntactctannctacactanntnnacttnnnnnnnnnncnnnnannnnaannnnnnnnactgcnnnnnnnntgnnnntnnnnnnctannnnnnnnnnnannnnnnnnnnnnanacnannnnacantatnnnnnnnccccatnnngtnnnnatnnntnnntcatnnatngannnnnngttaacttagtccctgnnnnnnnnnnnnnnnnnnnntacnnnnnctannnnnnnnnnnnnnnnnnnnnnacc

SEQ ID NO: 5828 - DNA, 343 bp, Glycine max
ccatcatgtccttgaactcttttgtccccctctacatcgcaaacttgttatagaaatgcaaaaacaaataccattttctcctttttctttggagggggcagtcatatggtgacttgccatttttttcctctccatattctcttcaaatcaaagcaatactatgcttcaataacatgtgcctaaccagcaaagagttatatatatatatatatatatatatatatatatgcctagttggaaaagtgccttgaggatgtccgccagaaataagcaaccaagcagctctcacataaaagcagttcgtccaccccttctgctatgcctatcatacgcaatattaaat

SEQ ID NO: 5829 - DNA, 385 bp, Glycine max
ttcaaagcctaaacaagataggtatgctcttagaacatcacctcaatggcttggaccacaaattgaagtaattaggcatgcaacaaagatgattgaaagggagataaactctgtaaatgataaccccttgattgatgtttcaaggaataaggcactacatggggggaatttccaaggtaccccaattggtgtttcaatggataacacccgtttagccattgcatcaattgggaaacttatgtttgcccaattctctgaacttgtaaatgacttctacaacaatggtttgccttcaaatctaacagctagtcgcaatccgagcttagattatggattcaaaggtgctgaaattgcaatggcatcctattgttcagaacttcaatac

SEQ ID NO: 5830 - DNA, 379 bp, Glycine max
  misc_feature (354)..(354): n is a, c, g, or t
tttccctctcaggaactactcatcaacatggattcctctcacagaacatgcacttgggaatgagatcaacaaccaataatgcgaataatgagttttgtggtgccatcaacactactccaccttctaattctcactcaggcaccagttatgagagcattgacattattcaaaacagaaagagatttgctgcgcagttgttgcgggatttcgtggcctaaaagaattgataattaactagctagcaagggtaattaatcaatgaagataccccatgaaggaattgttttttattttattttttatgttgcaatatatccacaaaacacaatgcagttcagagtgttaacttagcanggggagatgaaaggggcattaatgg

SEQ ID NO: 5831 - DNA, 658 bp, Glycine max
ttttttggatcagaaacgaaatagggttttagcggaacgatcatggcaccagctagggttttcggggcaatcgccggcagagcgttcatggcggcggcggcgaagagcgcggcgaagaagaaacccgctccgtccagcggagccgctgcgaaagccgctgtgaagaagacggccgcgcccaggaccaccaactccggcatacagaaggtggttccggtgtcttccgagctcggagacttcctcggcgctcctcaagtgtcccgaaccgaagccgtcaagaaagtctgggcctacatcaagctgcagaatcttcaggtcttgtttccgctttcgcgcaatgttgttgtctctctttgcaatcttcgcattttcatcttttttttttaacttttcgggaaaggtacttttccccccaaaaaaaaacggggttgggaaggaaatggtttccgggttattatgggggggggcctccgttgggggtttaccaccaaattggggtttggttaataaggggttggggttggtaaggtgggttttaaaaaaattggtggaaaatgggggtattcctttggttttggggtttcctggctggaagggtgaacggttttcccggttccttaaattaagggagaaaggggaagggaaaaactggtttttt

SEQ ID NO: 5832 - DNA, 545 bp, Glycine max
agccacttcgcgacacgatgcataggcaatccctgggttctccctctcccaagctccccaagctagagacgctcgtcaccgacgaagacgatgctcccaaacctcaccgtctcagcctctccccgccgcctccaccgccgcacaagttcgtccacctcattcctgtcctcactctcctctgcttcttcgtcctctacctcttctcccacactccctctccatcaggtaccactcactcaccacctctattattacacactttcagaatttctctaaatctctcgcctcgttcatttcgtttcagacttgaatcatttcaccggattcaaccgctcgccatcacaccgtctaggtaccgcaaccgcaatgcatttcggaattcttttctttttttaaattattattttttgtttgagcgtgtttttcgatctgttttttttatgttagatttggcggagaagatcggcggcgacattggacaatacatggatgtaaaaagaagcgatgttttggcgatccgaagtttgcaacagattccgaaacct

SEQ ID NO: 5833 - DNA, 582 bp, Glycine max
agtttggccaacccaagggttatgcctatgttgagttccttgaggtggaggctgttcaggaggcccttttgctgaatgaatctgaacttcatgggcgccaattaaaggttacagctagaggctcctgctgttgaaaaatagtgtgcttcctctttttttaattatctctgcttattgaacatttttcaggtaacggctaaaaggaccaacataccagggatgaaacagtatcgtccccgtcggaccatcaatccttacatgggggggtttcgaggcagaaccccatatgcacctccctttatctactctccatatggatatgggtacacgttacactctattcttcagtttctaatgtgtttcctatttatcctttgacagcaaaataataacatttttctgttaattgcagaaaggttccaaggttcagaatggcaatgcgctacagcccctactattgaaagtccaattctggtaggatggactgaatgacgcctttcttcccccctagtagtatatcatggtcggagttttggccattgaatatgagggagggaaaatccaaccagttctgtgaggata

SEQ ID NO: 5834 - DNA, 405 bp, Glycine max
acggcgaaggagatcgcggcgaaggtggacgcggcgaccacgaaccgcggcggcgggaaggcgggtatgaaggaccgaaccgggttggagaagggcgggcacgcgaaatacgagtgccctcactgcaaggtgacggcgccggacgtgaaatcgatgcagatccaccacgacgcgcgtcaccccaagatccccttcgaggaggacaaagttgtcaatcttcacgccaccaccagcgttcccgagtcctccaagcctcgccccggtgttcgcggaagcctcaagaagtgatctcaatcgatcgttggaatcgttatggcccctccttcattcgtagttctcaatctcttttttttctttctttttctttttctttttattttgttgcctaagttgacgttgttgagt

SEQ ID NO: 5835 - DNA, 255 bp, Glycine max
tgagatcctaattctttcagaaactttatgatgataatttactgtatgatcaagaagcttaggcaggtttttttggggagggtgcggcaagtgtaaaaaaaaagccttggtgcattttcagtttaggaattacaggtttgcagtcttttcctagagtcctttaggaagtgagaactattcatgtatatcactgagcccagcccccccataattagaaaggatggtggactactgtgtatgaaaaggttgtttttt

SEQ ID NO: 5836 - DNA, 402 bp, Glycine max
gtttgcctcgctttcgccagggatttaccacgcctgctcaaaccttcaatgcagaggaaaaactccctgctggccatgccaatggtttaggggtggaagttgcgccgaatagggaatcgggtttccctcagaagcaattgctggttattgatcaaacgggtgatcaaacaactcttgtttatagttcaaggtttgggggtcccgttgattgtcatgtgtcctgggattcaaagctgcatggttctatcaatttgaacaatgggaatgaattgcttaatttaaggagagatgtgaatcatgtggttggacttggacctactttggatgataaagttcatgaaaatacaggaactgatgatgacattgaaagcgagatgcatgaggacacagaggaaatcaatg

SEQ ID NO: 5837 - DNA, 1351 bp, Glycine max
  misc_feature (343)..(343): n is a, c, g, or t
  misc_feature (1336)..(1336): n is a, c, g, or t
tactgttgttctgatatgttcattggtattatactttttaatgtcatcatattagtataccttgctttgttttattttatgaccctgatcatttgagttaatttctaggtgggttatttatggtttgagcatatatacaagctggacaaggtcacatacaataaataccatccttatacctcatggattcccataacgtatgtccatgtttccttaatctttttttttgggaagggggggccggaggaaaaaaaattcaagaatttttaattattaacatggaccatttttatttggacgggtttaacataggttggggaaaggtaccccaaggtttccgaantaatccctggccctttttggggaaattggcttttgaaaaagaaaaatttttattccttccccttttggtccctttcttttccaccctggaaatggcctcctatttaatggactaatttattggtaaatggtggccaaatggactttcttccctttggtttaagggtgggaatttcttaactaattttaacaaggttccaatttcttccaaaagggttgggaaaaataccctggaaaattacatctcccagatccatatctggttaaggtactccgaagctgatgtcctgcttttagcatttattgatgctttacccgatatcacatgtttgtcctaatgagttgaggggttgtttggtgcacatgcagttagttgcccaagcatactagattcctaggcatgagatgcctggatacaagatgtttgggcatttagtatttcacatgtttggcatggtagaatagatgcctggattcatttatatgtttgtttggttacactcaatgttgatcatctaacttaacaatgagtatgctttgcactagaaatgggggcaatgatgatttaaactgttgatgattacctcgtccttgaggggtgaaagattttactaaaattcctagcttttcagttctaaatttttattcttacaatcttactgtatgtcaaaatggtaaaatgcttaacatacattcatgtccaattactttctttcatgcttgatgcaacttgtttacatgtgtaattatttttgttatttatcaaatatattaattgttcctttctattatgttggctgattttaggtcaggtattccagacgggcaacccaaattgttgctttccctgatcccagactacccaatgttgaacttcatgcttactacttccatatatgttgcagtaagttaaaagcacaagttggattgaatttttttatgttgaaagattctgattttaacattcttggcagacttcctataggctcttganctgacacatacccga

SEQ ID NO: 5838 - DNA, 557 bp, Glycine max
attgattgaggtccgaaaattgttatttgttattgatttatattttgatcgctaaatttttaatattcatttaacctgtatgcaaactacttgtttaggttggtccgcgattctgcttgaacccaattaaaatatttggtggcagttttggaggcccaactttatatgagaatccgctctatgtgtcaccaaatcaggtactgaccaatatattttcccatctatatttataatttcccaagctttccactgacaatataactctatcgttattggttgctgatccttatagattcgagctttggagaaaaagaagaagtctggaaagtttgcaaagaaggtcaaagcaaagacaaggaggaaaatgcacgagatgtccaatcctctggagcctgatgagtttgcagatatgtggaaagattgattttaaatacaaccgcagctaccacataaaagaaaaacccatatttctcctatattatcctcgcattatattccatagcattaaagggagacttttgtgattctataaatgttattttctgtaatttcatgtg

SEQ ID NO: 5839 - DNA, 389 bp, Glycine max
ctttctccgcaaagctctcaccttccgaggcacagaagcttcaatctctcgcccacgtcatcactctcatacccgaacagcttcgctcgcctcacaccacccgctcccctgagtttctcggcttaaccaccgccgacagaaccgggttgctccacgagaccgatttcggctccgatctcgtcatcggagtcatcgacaccggaatctggccggagcgacagagcttcaacgaccgcggcctcggccccgttccctccaaatggaagggcaagtgcgtcgccggagaaaattttccggcaagttcgtgcaaccggaaactcatcggcgcgaggtggttctcaggcggatacgaagccacccacgggaagatgaacgagaccactgagtta

SEQ ID NO: 5840 - DNA, 600 bp, Glycine max
  misc_feature (406)..(407): n is a, c, g, or t
  misc_feature (412)..(413): n is a, c, g, or t
atatgcacctcctgtgatgtgccctccaatccccaaggttgtgcaaaggcctgcagggaagccatgaactgcactcttctctgaaattctgtagtaaacttcaccaatagtagcaccggcttggatccaagccgtgtttcgcgcaatatcaacattcactgcacgaagtttggccaagtctaggatcatgaaaggcttctcaatgagggaaacataagagagcccttcatagtcatgccctccacttcgcactctcatgtgaataccaagcttttttgcacaaaccactgctgcttggacttgagagtcatccagtggggtgaatatgaaatcaggttttggcactgagggcaacaagtaccttagattttgagctgtggactcaaggattgaagtgaaggaaccnnttttnngaactaatatgatcatgtcactttgaggaccaatttaatggcataacaatgaaagactagtatgatgcattcataaagggaggattaacctattaacgcctaattttttaaaggaccaaaatggttattttgctgttggtaaaataaaaaaatctgaacatgtaaggaggacctgttttatgttttg

SEQ ID NO: 5841 - DNA, 413 bp, Glycine max
  misc_feature (383)..(409): n is a, c, g, or t
gcgtgtgttcacactttccaaagcatcaaacggagaagcaagtgccttcatggatttggggaaaacgtgggttacaacttacaacacaacgttttcccaacacaatcactgctgtaacgcttaagcatggctagtggcccttatcttttttagaggaccaaaaaaatgcgcagaaaatacacgagtaggagaaatgacactgcatggggttagagattgcgcaggaaaaaaaaaaacttttgcttgccactaaatttgccccccccttccgggacttgggaaaaggtccgaaagctacctcaaaaaccccccccatatttttttcttatttacacccaacaacaataaggaaaccccggttaaagaaaaaagaaaacaaaaannnnnnnnnnnnnnnnnnnnnnnnnnngggg

SEQ ID NO: 5842 - DNA, 395 bp, Glycine max
tagtcgataaactggtgtagctagcaaatgcttacttcttggcgttgtgagtccaaatatctcattcatgtctaactcatcaggagacatgtccaatggaagcacccaattaaaacaatgcaccaattgagctagaacaagcttaacagtagttagacccatatgaatcccggggcaacctcttcgaccggaaccaaatggtataactcgaaagtcacttccacgaatgtcaacattgcaattctcaaatctctttggatcaaacatcaaaggattatgccaaactttaggatctctccctattgcccatgcatttactatgatccttgattttttctttatgaaataaccatcaatagtaacatcttctcgactctcacgaggtaaaaatgtgg

SEQ ID NO: 5843 - DNA, 695 bp, Glycine max
atttctctctccgcaccatgacctctcacccgccgccagaggacgacgacgcaccgcctcgccgccggtgattcctccgccgacatgcttcgggagtccaaaaccatccacctccggcgcgccgtcgccgcctcgttcttcttcgccactgtttctctctcttgcttggtcctcctcggagacgttgattcgcaccggttcctatccagcttccattcctcttattctctgtctggctttactcgcatttttccgtccgtgtataacgatcccgtcgcggtcagtttcctagctcctcttctctctcgcgttacgcaacattttcctgctaccgttacagcgcaattgagttagttcaccgttttcgtatgtttaattactgcattgtcttattatctgttgagcacatattaatttgctatacataattagtgcgctgtcttatctatttgcattgtcttatgtatagtgtgttttgcacgtttcggatgtaattttccacatcttagatgagactttaagaagttagcagttatagaaggtgatttccttcttttcaacgagtttctaaagacgcttgtagttgctctagctttatcgtgtttgtttgcttttgctgtgttattttactgattgaaatgcaatggaagctctaatttcttttgagaatttgaatactctggacatttttttga

SEQ ID NO: 5844 - DNA, 363 bp, Glycine max
  misc_feature (223)..(223): n is a, c, g, or t
tactcaggctccttgatatcaggaagtgtcctaatctacagaggatttcacaggggcaggctcataatcatctccagactctgagtatcatagagtgcccccaattagaatcattgcctgaaggaatgcatgtcctccttccatctcttgatgatctgtggataaaggattgtccaaaagttgaaatgtttcccgaaggaggtttgccatcaaatttaaaaantatgggtctctatggtagttccaaacttatgtccttattgaaaagtgccttgggaggcaatcactctctagaaagattatctattggaggagtggatgttgagtgtcttcctgacgaaggtgtactgccacactctcttg

SEQ ID NO: 5845 - DNA, 664 bp, Glycine max
  misc_feature (633)..(635): n is a, c, g, or t
ttgcaggttattgtaggagatggttatgttacaatcacaaaaggggaaagtatcagaaggttctttgagcatgctgaagaggccgaggaagaagaggtaatccaagtttccctgagaaaataagccttgttaattatccatcattcatttgattttgataattagttatgaggtaagcttcatgttataaaatgtatgctcttaggatgatgattcagttgacaaggatggaaatgagcttgatggagaatgctcccgtccccaaaagcatgcaaaaagccctgaacttgctcgagaatttctgctagatgctgccactgttattttcaaagaacaggcatgtttagcactagtattgttttctgtgcttgtttgtgttcaaccagactaccactgactgtgtactatcctttcaggttgaaaaggctttcagagaagggacagcacgccaaaatgcacatagcatattcgtttgtcttgcactaaaactgctggaggatcgagtgcatgtagcatgcaaagaaatcattacgttggaaaagcaggtcttagttttttgcttttaggaaaaaagctgttggggacaggaaaaaaagctcttgtttctatttttaaaatgcacttctaaatccnnnattgcatgattttgtctacagatgaagct

SEQ ID NO: 5846 - DNA, 797 bp, Glycine max
  misc_feature (698)..(698): n is a, c, g, or t
  misc_feature (703)..(703): n is a, c, g, or t
  misc_feature (750)..(750): n is a, c, g, or t
  misc_feature (768)..(768): n is a, c, g, or t
  misc_feature (772)..(775): n is a, c, g, or t
  misc_feature (777)..(783): n is a, c, g, or t
  misc_feature (785)..(786): n is a, c, g, or t
ggtttgtcccctaaatgccacgcagatcaaatcaagaacaacatacagaactattccaacataaatttcaaagttcgtcacactcaacaaaataaagcgattagtcgtcaaattgaaagtgagagcagtcacaacacagagagtagttcggttaatccaccgcttttccacagttctaatttctatgcaacaaattaatcaaaataataaaaaaaatcaggcaagaatacttttccagtaaaatcagcctaaaattattttcttctaaaatcagattaacattatacttcaatttaatcggaaatcggacacctcaaatcaacactcaacacactcgtcgattgaagtaataacaataaaacaacagcaataacaatgattatgacagtgaatcaacattttgcggagacacgaaatggaatttaaaaaagcaataataataagaaaagtagagaggaaagaggaaaaacatgatttggcgagcttgaagcaattggcggctttatcaaagagatcggcggcatcttcgtacttggagccaaacaagccccaaccgctgagcttcttctcagctttcttctcgaattcctctcctttggataactgatcggccatttccctccgatcgaaaccaagcaagtgaagatggatggattgatcgaatgcagtgcgttgcaggaacaacaagaagaggattngtaancgaagcgaaggaccaaaagctgtgttgacgaccaaagtccaaatccnaaatccaaatccaaatcnaaannnnannnnnnnanntatcccccccc

SEQ ID NO: 5847 - DNA, 352 bp, Glycine max
cggggccaagagtctgctcaagcagaagcagcatgtggagtttgtgcagagatggaaccttttcaagtacaagctgaacaaggccgtgtctgcattgtcacatttggattttgacatggcgttgttttacttgaggtcctctgatcacgatctgtatgccattcactccattgtttatcacgcctcgcaggaaattgaggcgtcccttgtgtgctttagggaccctccatttccctggggttcggtctctatttctgcatcagctttccttgctgtctcttatatttatgcaagacgagacaagctttttagaaacaaaaggaagcaattttgatgctctcactagaggagg

SEQ ID NO: 5848 - DNA, 360 bp, Glycine max
actttatcatcatctccaaataaaatacagttgaattcaaaaggctcatccatcaatggtactgctcttgaatctgtggagcatttggtcgcacaggggcaacaaattggcagtaaaatggaattggagaatcttcaatccaaggatacagttattgctgtaaatggaaaagctgcagtgtataccacagtggtggatgatgtggaaaagggccaatttgtacaggaggacaatcatgaaaatcattttttcttaaaatcatctggcagagtaacagatttaaatgaaccacttgttgggaatttatctccaccagtagaaaaagagacaaagggtcttgagcattctgggagcatgatg

SEQ ID NO: 5849 - DNA, 733 bp, Glycine max
  misc_feature (145)..(145): n is a, c, g, or t
gagattgtaattctttcttcagattctcagcgtaagttctcattaaagatccatgtggtgtggaagtagtaactgatgaaatttgtctgctgcataatttttttttccttgccagctagaaaatcatattgttagtatggtcagngagtaaatgtgaaacaaaatacttgtatttatagtagaataaagttgacccgaaatttggtctaccctatttattatcgagcccaggtttaggtttttaagaaggcctattagcctaacatgccagtctatttataacttataattttttacaatttatgtaatatataacgatgcaagaattttgtttatggcttgggtttaatttgtaaaaccataataatcaactataatacccaagtccttattgcatcatgtttcagctgtactgctatgaatagaaagtaacttagcctataaaaataatcagtaagtatttactcatttttaatacgaatctttaagtttggcaaaagaaaccatcaaagatctatttataaaaatggaaattcttgtttcaaatttcaattgctgggttgctaaatgctaagttttttttccctgtatctttttgtcatgaagtgtatgggtgattctaaatatttaaaatggtaaaggtttcatgttgcaagcttctttaatatgtgattgaagatttttcaattttcaataggttctaggttttgttgaatgctaaattgtgcttcaa

SEQ ID NO: 5850 - DNA, 373 bp, Glycine max
cttgaggatgccggatgagcagctggaaatcggcgacgacgccgtccacggcgaggaagcttatgccctctggggtgatggagaaaaatatgacccaactaggcatggttccttgcaaagtggcaacacttttgtgtcaccttatgttaatggtgcaagaggggtgaccataaacttatgagtcaagaaattcggctgtgctttgctcacacatatgtataaagttatgtgatgaatccgtgagtggtgtaagtagaaatttgattttgtcatgaaagaaaattcaagttttgagatctgatgttcctctggccatccagcattcgaagacctgatcatatatttctggcacagattgtgttgacatgttaaa

SEQ ID NO: 5851 - DNA, 374 bp, Glycine max
catccaccgaattgcattcccaaagaaacctgaattttcattctaatactatatctggcgcccgatctcaatttcatccgcgttcaaatgctaatcgtgggagaaaaacatttcatggtgcaggtaggaaagggtggcgaccacccaagtgaaggttattatttattgtgtgctctactgcacactgaactaaatttgttgtgttgggccattttgctaggaatgtactacacatgtaaatttcctgtaagcctcgaattttgaaatgaattcggttggttcctgaagtagttttgttcctaatcttcaattaaaggcctcatttgtgcttgaatattatgaatttgaaatgcttggtgctgattgtttattca

SEQ ID NO: 5852 - DNA, 422 bp, Glycine max
ccgatcaacgctccgcgagctcggacggcatttttcgagaaagaggataatcggcgtgagggaagagtcgcgggttcgagaacaggacttcggaaactttcaggtggaagagaggatgaaggtgataaaggaaacacgtgaacgttttggaaggttcttctatcgctttcccgagggagagtccgccgctgacgttttcgatcgcgtttcaagtaacctcctcctccttcttctttcccattatcctttatttttggtgatgtttgtcattgttcgagtggtttgcaggtttctttgaatctctgtggagggacatagacatgaacaggcttcgtcatgatccttccaatgatctgaatttcgtaattgtttctcacggtctgacatcgcgtattttccttatgaagtggttcaagtggaca

SEQ ID NO: 5853 - DNA, 335 bp, Glycine max
cactcattgctcattcaagttgtattcagctgagtctgcttggaattgcttgaaaaacagatgggttttcttctggggtgattcaaaccatgttgacaccataagaaatttgctcaactttgttttagacttgcctgaaatatcttctgtccccagaagattcgacatgaacttttccaacccaagagacccttctcaaacagttaggattacaagcatcttcaatgggcattggaatgagacacaaaactatctggggttggattctctgaaagatgaagggtttcaagatttgctaaagaagtacttctcagaagacacaattcctgacactg

SEQ ID NO: 5854 - DNA, 411 bp, Glycine max
ttttacgcttctgcctcgcagagtgagattggtcttcttatggctatgaattttgctttcactgaagggaagtacaatggcagcaccatcaccatattggggaggaattgcgtcttccacaaggtgagggagatgcctgtgattggagggagtggactcttcaggtttgctagagggtatgctgaggctaggactcattggtttgatctcaaggctggggatgctattgttgagtacaatgtttatgttatgcattattaattgatgatttaataattatgttataaaagagattattatatatacttttagcttttgctttagcaattggcaattgacactttttgttgcttttgatgctttgctttgccttatctagagaggtggggcttgttcttgtaaaccccatct

SEQ ID NO: 5855 - DNA, 331 bp, Glycine max
gaaatccctgaagtttctagaaacagtttagatagccgtctcgagaagtctaaaaaaccagacaaaccggaaaaatctcgtatgagcacagaccatgttgataggtttaggagaagaaaggggttagtttggtagtgtctctcacaggaactgtatccagaataatttatctgctaggattcacttggcaggtaatctaattccacttttcaggtaatgatgccacttctaaatgaatatattgagtgagttttctgtttcctttcctccttcttaggtccagaattcagctgtatgttaaattattgagagcaatatgcatttgtatgcc

SEQ ID NO: 5856 - DNA, 339 bp, Glycine max
tgtcagaggacgctgcaggggacaacaagacatacagtgctccgacacggtcatacgttcgagacgccaaagcaatggctgcaacacctgcggatgtgaaggaatatcccaactcctacgtattcgagattgacatgccagggttgaaatctggggacataaaggttcaggttgaagacgacaacgtgcttctgattagtggggagagaaagagggatgaagaaatagaaggggtgaagtatctgagaatggagagaaggattgggaagttcatgcgcaagtttgtgttacctgagaatgccaacactgatgcaatctctgctgtgtgccaagatgggg

SEQ ID NO: 5857 - DNA, 1167 bp, Glycine max
agggcagtcatgggttttaatttatttatttttaaagtgttgaatttgaagggtcagaatgatatgtttcatatatatcttggatctgtctccttgaatgccattatgtttgtagccttcatttgaggtaaaggaaaatcttgggagagttgattaagcagctagatatggcaagatttggtctttccctttgggcagctatataagcgtttgtttgctaccgtgattaaagggaattcaagcaacaacctttcttatacaggttattacatgcttttcgattcagagttttttctttaactttatttcctttaatttttagttgagagaacattttctttttcagtgcttaatttgtaacatagattccatcagcacagaactttgtcgatgttacgaataactgctcactgaagatcttgaagcactactataatcactcaggtaattaaccattttgtatggtatgagttttattttaagtgtagcatcttagtgctaactgctaaatatatctatggcacacgtgcataacatatgtagaaaaatcaccattcattacatgaaaaaatatgaatattgttttgtttttgttgcaatatcatgttgtaacactgaaaaatgcaaacctgagagggaaactaattaagatgatatcttcaattcatgctgatttctgacttgaaattgaattaattatattttggtttcattttttgcctgaaatactagataagtagtcactttgaacggtcttgcaacagaaggcttttggtttaaaagtgattttgctgatttattaactagttgtcatgcatgaacttgaaaatcagtaaccaagaaatgaagcagtctatagatagttagctaggcagaataaaatttatgcttgctttgaatttgatgggtaaattatgttccgagtcccaagtttcttttttagaattctttatatttgttgtgttgtttattagcccactaaagactaggcaatggcagtatgagggaattctgttctttcattgtatcagaaatcaaaattataatggaggtgtaaatgttgatgctttatgatcttctaaggttggggaaaagatgaaataaacaaaaaacgattaaattatttattaatcaaagttcaatttgaaacccttataattaatctct

SEQ ID NO: 5858 - DNA, 166 bp, Glycine max
tgcgtctttgacccactgcttcttcatttccatctttttggacaccctctattgctcttcctcccttggtgtagtttgtgcaaaagggtatctctatttatagagtttccattgtctctggaggcaattttcgaccttaggtgtgttttggagagttttttttttt

SEQ ID NO: 5859 - DNA, 331 bp, Glycine max
ccaagaggacaatatgtgaattaccgggatcttgatttgggaataaacaccaagaacaacacaggcaacattcaggaaagtgcctggggctataggtatttcaagaacaacttcgacaggttggtaaagattaagaccaaagtggatcctcagaacgtcttcaggcatgagcagagtatcccaccacttccaaagtaaacacaacaggcaagaaatcttaaataaagcactgactgtgctgctacaatcattagactgtgccactgtggtatccataaatttgtgaaaaaaggttgatttgctagtttagagcaataaggaaacgcaaagg

SEQ ID NO: 5860 - DNA, 1335 bp, Glycine max
  misc_feature (803)..(804): n is a, c, g, or t
  misc_feature (808)..(811): n is a, c, g, or t
  misc_feature (821)..(821): n is a, c, g, or t
  misc_feature (854)..(854): n is a, c, g, or t
  misc_feature (866)..(869): n is a, c, g, or t
  misc_feature (873)..(875): n is a, c, g, or t
  misc_feature (891)..(894): n is a, c, g, or t
  misc_feature (896)..(896): n is a, c, g, or t
  misc_feature (903)..(910): n is a, c, g, or t
  misc_feature (916)..(919): n is a, c, g, or t
  misc_feature (922)..(923): n is a, c, g, or t
  misc_feature (931)..(937): n is a, c, g, or t
  misc_feature (945)..(958): n is a, c, g, or t
  misc_feature (962)..(962): n is a, c, g, or t
  misc_feature (974)..(975): n is a, c, g, or t
  misc_feature (977)..(992): n is a, c, g, or t
  misc_feature (994)..(994): n is a, c, g, or t
  misc_feature (998)..(1000): n is a, c, g, or t
  misc_feature (1002)..(1005): n is a, c, g, or t
  misc_feature (1007)..(1009): n is a, c, g, or t
  misc_feature (1012)..(1016): n is a, c, g, or t
  misc_feature (1018)..(1019): n is a, c, g, or t
  misc_feature (1022)..(1031): n is a, c, g, or t
  misc_feature (1036)..(1036): n is a, c, g, or t
  misc_feature (1038)..(1045): n is a, c, g, or t
  misc_feature (1054)..(1060): n is a, c, g, or t
  misc_feature (1064)..(1065): n is a, c, g, or t
  misc_feature (1068)..(1102): n is a, c, g, or t
  misc_feature (1104)..(1126): n is a, c, g, or t
  misc_feature (1128)..(1137): n is a, c, g, or t
  misc_feature (1139)..(1139): n is a, c, g, or t
  misc_feature (1145)..(1146): n is a, c, g, or t
  misc_feature (1163)..(1167): n is a, c, g, or t
  misc_feature (1171)..(1172): n is a, c, g, or t
  misc_feature (1174)..(1186): n is a, c, g, or t
  misc_feature (1192)..(1201): n is a, c, g, or t
  misc_feature (1203)..(1208): n is a, c, g, or t
  misc_feature (1214)..(1214): n is a, c, g, or t
  misc_feature (1218)..(1223): n is a, c, g, or t
  misc_feature (1230)..(1237): n is a, c, g, or t
  misc_feature (1242)..(1263): n is a, c, g, or t
  misc_feature (1265)..(1267): n is a, c, g, or t
  misc_feature (1269)..(1281): n is a, c, g, or t
  misc_feature (1286)..(1288): n is a, c, g, or t
  misc_feature (1293)..(1293): n is a, c, g, or t
  misc_feature (1295)..(1302): n is a, c, g, or t
  misc_feature (1304)..(1306): n is a, c, g, or t
  misc_feature (1314)..(1318): n is a, c, g, or t
  misc_feature (1324)..(1332): n is a, c, g, or t
tctgtgggggaagctttttgaataaagaaagaaagaaagaaagaatcgttgtgaggggaaaaaaagtgaaatggagccactgaatcataagtcttttgagagagtggtttcccagaaagccttgcaaatgggaaactcgtttccttgtcaaatttgtgtggtgggatttctctgcggtgtatgcctcacctctctgttcatggctgctctcacttcctttggctcctttcagtttagtcccattttgttttcaaccatgtcgatggctagtaattcatcagggaattctacttttcctaatgatatcagtgagtcaatttctttctcctttgtttgaaccatttcttgtttattcttttattttttatattttgttttatggtaatgaggttgtggatgcagtgtgcatcttcctctgttttcatatgacttttacttctttgatagaacttagctaattcaagaaagaaactttgaaactgggttatacagaattactgtatttaattttaaaatcttaataagtgggggaaccaattttatttctccttttcttcttcgtgtttttattttatttttcttcttttcttgaagaaaaagaaccgggtttattatgagttccaacttttttaaaagtttgatgtattcaaggacgtttatctgcgaagcgaacttgatagaacttgttaggcttggtcatgaagcaacttttaaaggatactttaattagtaattgctggctttacgttaagcatactctaataaccattctttttgactttggactgcatattccagagagnntatnnnntatacattgntttgcctaatcagcattacaattatgacatgcntataataattannnntttnnntccgctcaaaaaaatnnnnangagtttnnnnnnnntcgggnnnnttnntccacttnnnnnnnaccccccnnnnnnnnnnnnnnctantttttgcccaannannnnnnnnnnnnnnnncntatnnntnnnnannnatnnnnntnntcnnnnnnnnnntttanannnnnnnngaattaaannnnnnngggnnttnnnnnnnnnnnnnnnnnnnnnnnnnnnnnnnnnnncnnnnnnnnnnnnnnnnnnnnnnnannnnnnnnnnanaaaaannaaaaaaaaaaaaaatcnnnnncacnncnnnnnnnnnnnnncctgcnnnnnnnnnntnnnnnnctcttnaccnnnnnncacaccnnnnnnnncctcnnnnnnnnnnnnnnnnnnnnnncnnnannnnnnnnnnnnnctccnnntatantnnnnnnnntnnnctcacctnnnnnctgtcnnnnnnnnntct

SEQ ID NO: 5861 - DNA, 375 bp, Glycine max
tcttagctctatcaaacaaaggaagaaaaaaacagccacaactgagattactggagatggtgatcacagtttttctcctcgtgttagccattccttcacctcttaaaacagcagaatcactaaatttcaacataacaaacttcgcaaactccgagagtgcaaaaaacatgttatacgtgggtgacggcgctgtgaacaagaacgggtccatagagctcaacatagtggactatgatttccgcgttgggagagccttgtacggacaacctctgcgcctttgggactcatcttctggtgttgtaaccgacttctccacgcgcttcactttcactattgacagaggaaacaacaaaagtgcttcttatgctgacggtt

SEQ ID NO: 5862 - DNA, 437 bp, Glycine max
ccttgtgataatacatgccaccatcttgtcttcagatgagccaaatctcgtcaatctccaccatttccctcatctcattcatttggatctattattacttgcgattaggaaatatgctattcaattgggaggaatgctagtaatacatttttttgacacatttttcttaacacattttattattaggtgaaattcatgcaaaagacttactaaattatgcaggtctcattccatctttggtgggactagtatgaaattcaccaaatgacagtgtgtcaagaagaaaacgttaaaaagtgtgagcattttctcgtttagtttatgatcagacaataaatggttgtttgaagtgcaaaattaataagccttttccattatttagtaaattggtgggagtgattttcatgtatagattacttagttgggaaagctgaggc

SEQ ID NO: 5863 - DNA, 389 bp, Glycine max
aagcagagagtgataatagtgggagcagggccctcggggatctcggcggcagcatgcttcacgaaacagtcgattccgtacataatcctggagagggaagactgttccgcttccctgtggaagaaatattcatacgagcgcctccacctccacctcaggaaacagtactgccagcttccccacaaacccttcccagcatcttttcctccctacgttcccaagaagcagttcttgcagtacctggacgactacgtctcccacttcggaatcacgccgctgtaccgaagaaccgtggagctggccgagtacgaccagggctgccacaactggagggtcatggccctcaacggggactccggtcagctcgaggagtaccgtgggaggtttct

SEQ ID NO: 5864 - DNA, 404 bp, Glycine max
gtgggctttgcctttgataagggaaacgagttttagtgaacttttggatcctaggttggtgattccttctgacatgaagcctttggttagattagccaaagttgcttcagcatgtgttggtaattcacgcaaatgtaggccttcgatggctcaagtggcaaccattttgaacaacttagaaacggaagtgtgtctctgatcttcatgatgatgcagtcaaaagtcaatttgattgaacaaattgccttccaattttgtaccaaaaaaatggggtctgaccaattaccaataattggtataaaaaaggcatgtgtttctagtcagaaaaaaaaacttggtcttatgactcttatcatatgattagttaccaaattgattgaaatgaagatcgaggacaatattag

SEQ ID NO: 5865 - DNA, 577 bp, Glycine max
aactatcttctctattaatctataagctgcaaataaaaccccagctccttgcaacaaaaaaagtggggaaaaaatgacccagtggggcagattctttgcactggatggtgttccctaaaatttaaatgaaaaaaagagaggaaagaaaataaaaaattgaggaaacctacaaactccgagaacataaatgacaagatttttgctagcaattatcatacctctaaatgcataaaaagaagtatttggaaaccaatgaatggaattttcataatatgcccaccgatatcctgtagattgcagaacccattttgctgtctatcttcatctgtgtaaacaactaagcctcctgtcctaaagtctaggtatcttatggtatttgacgatgagcatggttctgtaatatgacagcctccatgaatagttggattgtgccactttgtacaaacaagaaacgcaaagcactgtgcaatgctgcaaaagaatacaaggattctatgaaggaaaaggcacaagattaaggtcaaatacataacaatctaccagaagatattgatcatacccgaagttaataaacaag

SEQ ID NO: 5866 - DNA, 361 bp, Glycine max
  misc_feature (299)..(299): n is a, c, g, or t
  misc_feature (305)..(306): n is a, c, g, or t
  misc_feature (310)..(310): n is a, c, g, or t
  misc_feature (313)..(313): n is a, c, g, or t
actctgtggacttcacagcgtcaaactgttaacaacgatcaaagagaagatgagaaactgattctgctcggcaaaggcatggagaagaaaaggtccttcggtgcctccgttgtgagaagtgcttccattcggatccaacaagtgtctcaggagctgaagcgcttggcttccttgtcgaagcaaactgcatctgctgcaatggaccactatgacaggaactcctcggcttctcatgctctcgagggactcaagatcatcaacatcgatactactgatgctggtgctgggggggttgaggntgaaanngagntcnatgctctcactgctcccactgctgcctaccttgatcactctctcttca

SEQ ID NO: 5867 - DNA, 373 bp, Glycine max
gactgattgttgcttgtacaaccgtgaatcactctcttcttagggattgtttttctgatgtctcgatgagaatgtgtaatgttagaagaacaactttatgttttggagggagttattctactaaaacctgagcattagacatataagtcggctgtgtagattttcaggggaaaaatgccggattgcatagacagcgttctgatttgagtgtaggacaagacccccctatatcatttgggttaatattacataattatgactttgctaatgtttctggatcattttattttttatttatctgcagttatttgggctttgtttttcttagtgtgtaataactacatttattttggagacgcaaatgtactaggaa

SEQ ID NO: 5868 - DNA, 601 bp, Glycine max
  misc_feature (59)..(63): n is a, c, g, or t
ttcagctaggtttcactctgtgaacaggtgaggatttgttcatttcgttactacaacannnnncatggaattggattgtgctaactgatatttactcagtgcaggacttctcaaataaaatgtttattttgttttacttcacaaaaaaggtatgttgctggttgtgatttgatttgattttgctcatttattatcaatagtcaatagtattataaaaactgtccacccacagggctggacagtttttcaagtttttttttactcattttatttttatttatttagtattatttcttgtttttcttaaaaactgtgcaatgcacgggttctgaatcttctgatgctagtttatattaacaatatatgatcctctctgctaagtactgattaaacttactcttgtgtgtgtaggaaaagcaaatttctaagcagaaggaaattgaatggccaatgcttaaaccttgtttgtacaagcgtcgatgagattatattttttttcctttttggtgtattcaatgtcatttgactaagttaattaaatcttcgcaacattagtaaatcacaaaagttttgtagtaattgatttctcgacctcgcactc

SEQ ID NO: 5869 - DNA, 368 bp, Glycine max
ttcttggttataacagttagtgtggtggtcatgacacttatgcatatagtcaggcaaccatctcggcccagccactaaaaagagattccagagcttttacacggtgatttgatctttatttcattgaaatacaattggattgacctcttgcttcattgccttgttttaagattttaggcttgagaaagagaggcctgtaaattttagtctgattgccccaaatttattcatctcacccccagtcatattatgttcaaatatgttgttgtgctcctgttatagatacacaagcaaaggggagtgcacaatgtctgtctgtaatcgtttcatattgtgaagatacaaattccggggggggaaattatggg

SEQ ID NO: 5870 - DNA, 792 bp, Glycine max
ttgaaggatctaatgtttatttgcactgatatggataatctaactaatgttgtgattattggttccttttcccaattcttttgcatattcgttgtgtttccctcgagttcagtaccttttggaagatgttgcattagaccacactcgattgaacaaaattcctttccaggtcagattaaccctatatagtttttggcattattttttctggtaatgtcattctaaaattgtctacttttcattgtattatcaggctcagcgggatacatatcttatgctctcaaggttcattctattttacaacaaaggtagacagactgttgggggagtgcactaacctatgaatgatggtgtactagacttttaaaatattacattttctttgcagctgacaaaatagatggcttcttgaagcaatgtcctgctttcccaactgctttcttagttggcggtccagcagatatacttgttactgaactcactgatcaggtacatttgaattacctcttcataattaagtgccttatcctctgtttggtatgaagagttgaatatgtcacccttaacgtatggtgttgaattttttgttgtcacatatcagcttcaaaagctaaaggtggaaccagtgctgcttcattacctttccgaaattaagatccttcagggtactgtatcaaccatacaggtgcaatatttggacagggactattaatatctcatgacttaactataccattctcgtgtttatgttaacggcacaggcatggaattgagaatgactactagtacgag

SEQ ID NO: 5871 - DNA, 389 bp, Glycine max
tttcccttcaattaggtttaaggaaaactattgttatttcctcacctaaattggccaaagaggtactgaaaaaccatgacctagagtttagtggacgacctaaactacttccccaacagaaattgtcctataatgggtcagagattgtgttttccccgtacaacgaatattggagagaaatgagaaaaatttgtgttgcccatatctttagttccaagcgtgtctctagcttttcatctataagaaagtttgaggtgaagcaaatgatcaaaacaatatctgggcatgcctcgtcttcgggtgttacaaacttgagtgagttactcatatctctctcaagcactataatatgtagagttgcttttgggagaaggtatgaagatgaagga

SEQ ID NO: 5872 - DNA, 409 bp, Glycine max
cttgaaaccaataagaccaaccacaaagtgaagattgaggagtgcagatttcatggtgctgctaatggagatcagaacaaaaatgcagggtggaatccttgataaataagagagaaccgctagcaacacactcttttaaacacatacttcattgttaactttattggaaattacaaaattttgtgggtttggcttcttatttactgagtcgcactcataattttgcagtttttaatgaattttaacagatgataataagtgtgttagaaagaatgtgtcaaaaggtgtggtgaatcatcaatgcaatcttgatttgagaatgactatgatcatcccttagctttagttagcttgtaataatttggtgtttttgaagagagttggttatatttctctaccagcacaaggc

SEQ ID NO: 5873 - DNA, 379 bp, Glycine max
ccttcagttattcacatcattccttacaggaaagcctcttccaaagtcctagaaaaccaaatagaagatggtgttaagaaaaaggaaaactgaggtgaaaaaaaaagaatgacaaaggaaattaaaaaagagggaaacaagtgtaaaagcctagaggtggtgctaatttctattgccttgttattgttccgaacaaattttatgacatttttcgttgtcaacaaattaacaaaacgggttggtggaaaaagaaagtgtccattctaaaatctcaaatgtgcattttttttcctctccttttttcctttttattgcatcttttggttaatattttttattatattcattaataagacgggaagatcaaatatcttgtgca

SEQ ID NO: 5874 - DNA, 819 bp, Glycine max
  misc_feature (658)..(659): n is a, c, g, or t
  misc_feature (661)..(672): n is a, c, g, or t
  misc_feature (676)..(680): n is a, c, g, or t
  misc_feature (683)..(683): n is a, c, g, or t
  misc_feature (690)..(694): n is a, c, g, or t
  misc_feature (697)..(698): n is a, c, g, or t
  misc_feature (701)..(701): n is a, c, g, or t
  misc_feature (739)..(739): n is a, c, g, or t
  misc_feature (741)..(743): n is a, c, g, or t
  misc_feature (745)..(765): n is a, c, g, or t
  misc_feature (781)..(785): n is a, c, g, or t
  misc_feature (787)..(799): n is a, c, g, or t
gagaaaaaaaaagagagtccgttagttaatttcagtttatttattttatatttttaaaaagaagagaaaaagcaatggtgacagaggaagaaatatctgaagcggttcagtctctgctgcgggaatcaaaccctagtagattcacgacgctaaaccaggtggtggaggagctccaggccaagctcggccacgacctcactcacaaaatcgatttcatcaccgcgcagatcaacctcctcttcggatcccgacaaccgcaacaaccgccgcaaaacccgcataggcagttacaacagcctaaggaccattttgcccctccgccaaaccctaattttcactctgcccctgtcagtgttggctttcagttgcagaatttctcttcttctaacgctgttgtcgctgctgctactgagaaagccaacactgacaggggcagagtgaaaattagggtttggcggaggggcaaaatggtccttaggctgttgtaactgcctatgcgggttttgcggcggttgttgcggttgtcgggatccgaagaggaggttgatctgcgcggtgatgaaatcgattttgtgagtgaggtcgtggccgagcttggcctggagctcctccaccacctggtttagcgtcgtgaatctactagggtttgattcccgannannnnnnnnnnnnttannnnnttntttcccnnnnngannctntgttttttttctttttttttaaaaaataaaaaaaaaanannngnnnnnnnnnnnnnnnnnnnnntttttttttttttttnnnnncnnnnnnnnnnnnngggggggggggggggggggg

SEQ ID NO: 5875 - DNA, 967 bp, Glycine max
  misc_feature (959)..(959): n is a, c, g, or t
aaaagtagcagcatgccctttattagcagtaaccctgcagttcctcttcccactgatgaagttgactctgcttcttctatacaccctcttcccacctctagtggtcatgaactacaggtctttctctctctctctctcatttttttaatacattcttttcttattctctcctccatttatttaataaaattcatgtttccatctaaataataaatgaatagaagaaaatataggactccaatctgttagtagaattaacatgagttctatcaaaaaggttttaatcaataatttgcaactataattatgatagcaacctgaaggtttttggagtatttaagaacataattgaggtagcatcaatcatatttattcataatttttcataaagatcatgataaaatgtcaagtacgaccataatttaaaatgatttttgaatgaaaaaataaataatagtaaaacaaatatgattatcagtatttatcatctcactctatttatatatatttgtcagtgtacagttctctaacttgattatagaaactggacaatattatagaatatttgttggttttctgtttatgttagtatacttgcacattaatgttctttgtgcatgataaatgtgttaattattatcaaaactataagtattatagttacaatggcattcacttttgatccccattgaccattgtctatctgtcttcatattttggtggattactgattggggtgtcatattctattgtgggtggctgcaggtgatgattggatcttttggacttctgatagttgtgcacaccattactttactgctgctataagatgtgcgagataggaagtgaatagggtgtgggaccagagattctgattaagtctaaagtagcttttaagacattattataccttgtattaagaaactttaagacatgattataccttgatgctcttacanttcttcag

SEQ ID NO: 5876 - DNA, 380 bp, Glycine max
aattacaactttcaacaactctcctaattcgatcaataaccatagggatctcctctaatgttatagtggtaaaacaaatccgaaaccatcctggttctatgcaatgacaggctgacccaggagttatattgatcttggcaacactcaaaaacttctcccataattcaatttctcctttctcactataaggtcggattaatccactcatatcaacccaacagtacataccagcactgctcttggcacacttgattcctagtttacttaaacaacccacaaattcatcatgcatttgtcgtattcttttccggttggtttcaaagtactcctgaataaatcttttatctgaaagcattgaagtaactaacctctgggttgga

SEQ ID NO: 5877 - DNA, 389 bp, Glycine max
ttttttgttttgttttggcagagtgttaaagtctgcaagaagaaatcttgaagatagacataaaacctggttggagaaagggcacaaaaatcacttttcctgggaaatgcaacaaagaacaatggtatgctccagctgatctaattttttatgttggatgagaggcctcatgctattttcaagagggaaagaaatgatcttgtagtgatccagaagatattacttgtagatgctctcaaaggaaagactctcaacttgactaccttggatggaagagatctcacaatccaagtcacagatattgtaaaatcaggctatgagctggtggtcccaaatgagggtgcatgcccatcccaaagaaacctggcaagaaaggaaatctcagaatc

SEQ ID NO: 5878 - DNA, 403 bp, Glycine max
tcgtcgtcatcatcatcatcatcaccacccttgttgcttgcaccatcatctgctgttgaccctttcttgcaactcttaccataaatctttgaccagtcagggatgtccataggtgctgatgaggatcctttaaccaatggagcatcagaagctgcaggtaggggattagcattattattagcccttggaatctttcttggagcagcaggtaaacgccatgcagaagaagaagaagaagaagaaccacaagattccttgcatgcccttgtggtttctttgccactatcatcatttgctacactccacacatcttcttcatcaaaatctctgtccttcatttctcttccaccaacaccccagcttttgttcaaaaaaacacctcgatctgatgccattgttgtta

SEQ ID NO: 5879 - DNA, 409 bp, Glycine max
agcttggctgacttgcttgttctagaatgctggtgtgtgttgctgagaaggatggcttaagggacagaggggtttggtactatgaggctgtcaagaaaagtgggtggaaaggggaaatacaactctttgaagagaaggatgaggatcatgtttatcatttgctcaaacctgcactcaatcaagattctcataaggctgatgcattgatcaagctcatggcttcttttctcgtcaattagattgacttttcctagccctggaatggaacggtttttaacaataagctctgttgttttgcttttaataatgtggagggataaaatttggttctagtttttttattttctttgtcaaatgtttgtggtttaactaaatgtgatgcttttaggatcgcagacaatgttcttga

SEQ ID NO: 5880 - DNA, 393 bp, Glycine max
tattttctgacttaaccgctttcaattggcaccaaacttataattaagaatagaagcagacattctattataatatgtcagtcagtacaagttggatagcgtactaggtaaccaaacatatatgtagcttatgctgctggagcatagtcataaccaccgtcgtcatcgtcgtcgccctccatgtatgcaatagggacaaaacttacaaaatctccatgccaattgcaaacatttcctccaatgaaagttgtggcagcaggagcatcgacaacatcatcattcccatgtttcttgcaccacggggcaatgaccttggaagtgaatgacatttttttagactagtgtgatggattggaattttgaactaggggctaggatagaagaaatggaagg

SEQ ID NO: 5881 - DNA, 318 bp, Glycine max
attgttagttgtatagcttccaatgaagtggagaaagttgtggctcacatacgagaattaaaagtgccatctgccatagtggtttgtttttgtcaaaatttccatgcttctcttataatatattacttgataatttccttgctatgaacttaggatttgtcaaatttttaagtgttttatatgtttactatcaggtttttatggaaattagatgtcctgatggcagagatggtggaagaaaaagttcatcttctacaaatcatgaaaaaattcatccaacagtgatgcttagtgtagttgctaatctcacaccatggt

SEQ ID NO: 5882 - DNA, 454 bp, Glycine max
acctgcttgggctccattacgagataactatatgctgacaagttcaaaactaaaggattgggacaaaatgcctgtaagtaacctttgaagttgtatctacttttatgctacgcaggtagcttgcactaatcattttgcattcctacaggataaaaatgtatcagatgacatgggaaaaacttctgaagatagtagttcagatgaagattagtattttagaactcaagcaagcagaattgagatattcatggttggacaatctgtcagatttttaatattggtactgttctagttattggcataggagtatcttatacatacattttactgccaatggtgtactaatacgagcaatgaatcattggtatgaaatttaaaatattagagatctgtttttcctattccatttctcttcaataggttagaaaagaatggactagtgacgaagttgcac

SEQ ID NO: 5883 - DNA, 385 bp, Glycine max
attgctcatcttttttgatagcactgcacatcgagttgttggtggtttaccaccgcctgctccttcgtcatcaccaggaactgttcatggaagtgaaaaacaataccaaaatatggcacctagagtatcctctagccaatcaacaatgtctttggctccatctgcttcgatggaacccataagtgagtggacagctgacaataatagaatgggaaagcctaataggagtgtttctgagccagattttggtagaaccccaagacaggtgtgtgagtactatgaaaggtgtactgtgaagattttcaccttgctctgcatgtctttggtttacttgaaagttttaatggaaaagttctggttgatgtatcacaagaaacgacacaac

SEQ ID NO: 5884 - DNA, 597 bp, Glycine max
ttagagctgcaatatctttaccaggtaattaaaatggataaggaaaattttctgcaactcattttactgattggttattttgcaaatctcctgttattaactctaattctacaggtgtttctgttgtcctttttgaaactgcatcaaacatgcaatgtaagcagatatcgccattcatgaatacactatgtagtcgtcatccatctattaacttccttaaggtagctcccttcacattgtacttttgacttgcctccatcatattttgataattagagataaaaacaaagctttgtggtagttttcttatgctttcaattttgtgtttgatttgatcaaaggtggatattcaaacaagccccgcagtcgccgctgctgagaatgttagggttgtaccaaccttcaagatctacaaaaatggcagtcgagtgaaggaaattatatgtcctagtcatgatatgttggaacactccattaggcattacagcttgtagaacttttgaccttgtactgcttctgatgtatactgcatttctatcctgccacctgaacatgccgcaaaactctccacatttcatccagtcttatgttccctca

SEQ ID NO: 5885 - DNA, 370 bp, Glycine max
gatcggtgccctgaatgcgactcctcaatcatagaagtggacttcaacaagaaaacaactcctctggaagacggagctaccttgcaccatggttgcattctatgtgatgagttgctacattcccttgtggaaatgaaacatggtagaagtttcaggcatatgagttcacgaggaagaggtagaggagcaagaaaaggtggaaggggcagaggacgcgggggtggaaaaatgatggatccaaaaatgagcttccgagatttctgagtaatgctcagttgttcgtcatgtctgtagctgtaacttgtatatgtttctaaaaaaaaagagttatcctttggtttttcagttacattaaatttgttcttggcgt

SEQ ID NO: 5886 - DNA, 804 bp, Glycine max
  misc_feature (698)..(698): n is a, c, g, or t
  misc_feature (700)..(705): n is a, c, g, or t
  misc_feature (710)..(714): n is a, c, g, or t
  misc_feature (716)..(716): n is a, c, g, or t
  misc_feature (719)..(720): n is a, c, g, or t
  misc_feature (722)..(723): n is a, c, g, or t
  misc_feature (728)..(729): n is a, c, g, or t
  misc_feature (735)..(739): n is a, c, g, or t
  misc_feature (741)..(743): n is a, c, g, or t
  misc_feature (745)..(747): n is a, c, g, or t
  misc_feature (749)..(760): n is a, c, g, or t
  misc_feature (763)..(764): n is a, c, g, or t
  misc_feature (768)..(770): n is a, c, g, or t
  misc_feature (772)..(773): n is a, c, g, or t
  misc_feature (793)..(793): n is a, c, g, or t
  misc_feature (795)..(796): n is a, c, g, or t
tttggggaccagcttctcacccattccaatgccctctcattgctcccaaggactggcttcagagataccgctgtcatcctcatgctcattcatcaggttaattatatcatatattcaataaatacatatattaacttttaaaagtaacttatgttgtatacgctcttgtcatcttatttcagtaagttttacacttaaagttatgaataagctattatctgataagagattattgggtaaatacttaatttccttatgtactaacctatttgcagttcataacttttggatttgcttgcactcctttatacttcgtgtgggagaaattcattggggtgcatgagaccaagagtttgttcaaaagagctttggctagacttcctgttgtgattccaatatggttcctggcaatcatattccctttctttggtcccattaactcaactgttggatctctccttgtcagcttcactgtttacatcattcctgctttggctcacatggttacctttgcttcagcaccggctagagaggtaattagatcatgcacctagctacaactgattattttttaaattcatatacacatatgctgcaccatccaatgcttcacttggtgcttattatttaattaccagcacatgcatacattcaattgccgccacttcatttttcttttatttctcttttttttttancnnnnnnaaaannnnntnacnncnnttttnntttctnnnnntnnntnnnannnnnnnnnnnntcnncatnnnannattttcttttcttttttgcncnntttaattt

SEQ ID NO: 5887 - DNA, 403 bp, Glycine max
gccatcaacgttgtgttaacttccgctgacgtggcagttgaaggtttctgcacgagccgatgtgggacccacggttcttcctcagcgggccatgcaaagaacaagaactacaagttcgcatacatatgggttgggaattcagaggcccaatgcccgggccaatgcgcgtggccgtttcaccagcccatatatgggcctcaaagcccacctcttgttgcgccgaacaacgacgtgggcattgacggaatggtaataaacctggcgagcctcttggctgggaccgttacgaacccgtttggcaacgggttctatcagggcccagccgaggctccactcgaagcggctacggcttgccctggggtttatggcaaaggggcttaccctggctacgctgggaatttga

SEQ ID NO: 5888 - DNA, 359 bp, Glycine max
cctgctgtagccatggcaattgctgtggtgagtttcttttcaggcactaggttgtataggaatcagaagcctggaggcagtgccatcactagaatctgtcaggtggtaatggcatccataagaaaatacaatgttgaagtacctgctgacgagtcacttttatatgagactgctgaaactgaatctgctataaaaggaagccgaaagcttgaccacacaaatgagctaaggtaaatgaagaaatggcaacagatttctagatgacaaagtagtggattttgcttactcaataagaagcaattttgatgtcacacttgcattatatagtatagaatgcaagaggcagggatttagtctac

SEQ ID NO: 5889 - DNA, 696 bp, Glycine max
tggtcggggggagctgcgatgtattggtgcaacaacattagatgagtatcgaaagtatattgagaaggaccctgcacttgagcgtcgtttccagcaagtttatgttgaccaaccttcagttgaggataccatttcaatactaaggggactgcgggaaagatatgagctgcatcatggagttcgcatttctgacagtgctcttgtggatgctgcaattctctcagatcgatacataagtgggaggtttttgcctgataaaggtattaataccagccaaagactcttggcaagttatatatattgcacaaagattgagaaatttcgttagtatgtttcgtggtaaataatttgttatagtattatgataccttgttttaaaagaatgatgtttgggttctgggttagaatattttgtcttttgaataacattgagtcaatatctattttgcatagtcaataccaaccaccgattttccttctgtttgataaaaaattccaatagttttaagcaaaaatgttaaactgttactgttacatttttgtatgtgtggattaacatcaataatgctcattaagcgctaattgtgagctacttctaaattgcagctattgatctggttgatgaagcagctgctaaactaaaaatggaaattacttcaaaacccactgcacttgatgagattaatcggtcagtct

SEQ ID NO: 5890 - DNA, 385 bp, Glycine max
ccctacatcccaagcagcttatggcaatcaaccacagcctggttatggaacccctcaatctcaaaagccgactggcaatccacctgtttatggagagtcacaatttcctagtgctggaggaggctatgatcagtcagcatatcctgtgcagccccctccttctgggtatgctcaaccagagtcaggttctcagagagcaccagcatctggttatggtggtgcagtgcaaccagggtacggtcatcaaatatatggtgctcctcagggtggccagcctggttatggtcaggcatcgccttcttacagcaacagttcttttggtgctggttatacacacactctggaatatactggtgatggtgatggtaatgctcaggcaccccat

SEQ ID NO: 5891 - DNA, 376 bp, Glycine max
actcttgtaaagtttctttgaaacttcatgattcgaatcccaccgtagacttgttctttgacttaaaaaattgcacgcaacttgtgtttaccatatactcttggtgcttgcttttattttttcaagtcgctgtgttatattctctattataataataattaagatcaaaccggttaaattagtagaccgctgtgtgatgaatttcatgtgcatgacgtcaattctttgtagttaataaggtgtatattcttttacttatacatggaataaaataattaataatactaagttggtttatacgtgaattacgtgcaggccaaatcgattttaatgcttgcaaatagaaaattggaggaaagagtgaggacaccaacta

SEQ ID NO: 5892 - DNA, 324 bp, Glycine max
  misc_feature (282)..(282): n is a, c, g, or t
  misc_feature (297)..(297): n is a, c, g, or t
  misc_feature (304)..(304): n is a, c, g, or t
  misc_feature (314)..(314): n is a, c, g, or t
  misc_feature (319)..(319): n is a, c, g, or t
tccttcctgcgacgagtcactcttcgaagagcttcttcgggtcgtgtcccgacccgtacccgtacccggattctccacgctcgaggatttccagagacgctgccacatggatgtttccactggctttgacgtcgtaggagaatcgtggccgttgcttcgtgacgagccaatttgctgaaaatacattaatcgttaatcactaactactttttttgggtttgtattttttaccctaattattgatttccggggtgttttttttttagttattagggaaatgangaaaagaaaggagcncgggttngattattatnattantattt

SEQ ID NO: 5893 - DNA, 778 bp, Glycine max
  misc_feature (737)..(738): n is a, c, g, or t
ggcctatggcatgaatatatttaatctcgatgcttggaggcgtgaaaagtgtacagataattaccactattggcagaacttggtaaatttcttcttcttatacttgtcttttctatgctaatgattatgtactagtttactatgacccagtttgtagaaactttttaataagtacttttaggagaaaaaaaaataagaaagcaagataaattaagtttctctcataagttaaaatcagctttggataagctagtttgcagaaactctctcatttagtttctccctccaaaagcttatttaacttacgcataagctaattttgactaatgggagaaacttaattcattttaccttcttatcttcttctcctataattgattattgagaagcttatcccaacatgacctatgtaattgctttctctaaaactattattttgttagaaaaagtttcttgaataatgctcaagctattcctttgtactattgctaaatgggttattctgttatcagaatgaagaccaaactttgtggaaagcagggaccctatcacctggtttgatcaccttctactccacaaccaagtcactggacaaatcctggcacgtgcttgggctaggatacaatcccagcattagcatggatgagatcagcaatgctgcagtcattcattacaatggagacatgaaaccctggcttgatattgctttgaaccagtacaaaaatctttggaccaanntacgtggacaacgatatggagtttgtgcagatgtgcaatt

SEQ ID NO: 5894 - DNA, 354 bp, Glycine max
ggtgcaacacctaataaatgccggctggctatcattccaagaggagggccccaacgttaaaaccaatccactagccagtcatggaggggctagcgtaaacgccatcgaaaaggataggccgtcagggtcaaagagattaaaagatgtggctacgtctagacgattcatctaccagtcgctgcaggcagcatgcatggtctctcgtggcggaggcgaaagtgacgaatgtctgtttcatctcggggaatcacacgacatggaaacctgccccgcggtggaagagttacttcaacggctcatggactgggggcagctcgaagtgtccgagggagatagggaagaatcgcaaatttg

SEQ ID NO: 5895 - DNA, 569 bp, Glycine max
tccggaactgtaaccaagctccaacacagaaacaattaattaattacgcaattaaaaggaagaaattaacagaaatctgtatgttaaatacttattagtaattaccactcatcaacgcctcctcaagattgcggctttcaaatctcttcggaaacacgtatttcgcagtctcggcagccacgtccgctagaactgcggcacgaaagttaattaggaaaattgcagagagaatagaatagaacaagagagaaaatcaccaagagttggaattcagtggagggaaacatttacgtcgctgggagagagagttggcttgagaagcgagggcgaagatgagtgagattcgggattcgaagggtgaaatggttcttcgcctggtgctactgctgattctctcgccggaagaggcggagttggtgacagagagattcgaagagtgtttgataggttttaccggaatcggagccacgatacccggttgcagagaaagagaagaggggttgcaaatagtaaacatgtttccttctgggaattgaatttgtttcactgtacgacacgagcttcttctt

SEQ ID NO: 5896 - DNA, 303 bp, Glycine max
ttatgtcagttctttggtctggacctcttcttgtcatttctatgataatcttggttagtattttcttacacataaccttttcagtgctagtattatttttacatcgaatattgacttgaagtatctttctctatgtgcagatcaatacactcttctccttatgttacttgattgttaggtggaaaagagctgaactgagacatcgtgcaagggctgctcgcaataagcaggactagttgttttgtgatgggaatgtgggattttgatggattaaactctgaaggagttcatatcaatggcaag

SEQ ID NO: 5897 - DNA, 1278 bp, Glycine max
  misc_feature (733)..(733): n is a, c, g, or t
  misc_feature (735)..(736): n is a, c, g, or t
  misc_feature (740)..(742): n is a, c, g, or t
  misc_feature (744)..(752): n is a, c, g, or t
  misc_feature (767)..(772): n is a, c, g, or t
  misc_feature (783)..(793): n is a, c, g, or t
  misc_feature (795)..(798): n is a, c, g, or t
  misc_feature (804)..(808): n is a, c, g, or t
  misc_feature (817)..(819): n is a, c, g, or t
  misc_feature (821)..(825): n is a, c, g, or t
  misc_feature (845)..(849): n is a, c, g, or t
  misc_feature (858)..(859): n is a, c, g, or t
  misc_feature (879)..(883): n is a, c, g, or t
  misc_feature (893)..(893): n is a, c, g, or t
  misc_feature (913)..(916): n is a, c, g, or t
  misc_feature (918)..(924): n is a, c, g, or t
  misc_feature (926)..(929): n is a, c, g, or t
  misc_feature (932)..(932): n is a, c, g, or t
  misc_feature (934)..(939): n is a, c, g, or t
  misc_feature (954)..(955): n is a, c, g, or t
  misc_feature (958)..(964): n is a, c, g, or t
  misc_feature (966)..(969): n is a, c, g, or t
  misc_feature (975)..(978): n is a, c, g, or t
  misc_feature (983)..(989): n is a, c, g, or t
  misc_feature (991)..(991): n is a, c, g, or t
  misc_feature (998)..(998): n is a, c, g, or t
  misc_feature (1001)..(1002): n is a, c, g, or t
  misc_feature (1004)..(1007): n is a, c, g, or t
  misc_feature (1019)..(1021): n is a, c, g, or t
  misc_feature (1024)..(1026): n is a, c, g, or t
  misc_feature (1028)..(1038): n is a, c, g, or t
  misc_feature (1040)..(1046): n is a, c, g, or t
  misc_feature (1051)..(1053): n is a, c, g, or t
  misc_feature (1059)..(1069): n is a, c, g, or t
  misc_feature (1072)..(1075): n is a, c, g, or t
  misc_feature (1077)..(1078): n is a, c, g, or t
  misc_feature (1081)..(1084): n is a, c, g, or t
  misc_feature (1086)..(1094): n is a, c, g, or t
  misc_feature (1103)..(1115): n is a, c, g, or t
  misc_feature (1117)..(1118): n is a, c, g, or t
  misc_feature (1121)..(1122): n is a, c, g, or t
  misc_feature (1140)..(1149): n is a, c, g, or t
  misc_feature (1154)..(1155): n is a, c, g, or t
  misc_feature (1157)..(1157): n is a, c, g, or t
  misc_feature (1159)..(1162): n is a, c, g, or t
  misc_feature (1167)..(1180): n is a, c, g, or t
  misc_feature (1185)..(1188): n is a, c, g, or t
  misc_feature (1197)..(1206): n is a, c, g, or t
  misc_feature (1208)..(1210): n is a, c, g, or t
  misc_feature (1212)..(1213): n is a, c, g, or t
  misc_feature (1216)..(1218): n is a, c, g, or t
  misc_feature (1220)..(1231): n is a, c, g, or t
  misc_feature (1239)..(1249): n is a, c, g, or t
  misc_feature (1251)..(1256): n is a, c, g, or t
  misc_feature (1259)..(1262): n is a, c, g, or t
  misc_feature (1268)..(1269): n is a, c, g, or t
  misc_feature (1272)..(1273): n is a, c, g, or t
gaaagaaagatcatctgcatcgccgacgcttccaacaataacaatggccgataatgcaataacgcaaggaagcaacaccctattttctccttacaagatggccaaattcaacctctctcataggtcgtcacagtcacacgcacttttcatttaattctcttgatctttacaattttcttaaatctattcatttttacccacaaacacatgagcgatctgacttggattttgtgcagggtggtgttggctcctatgacaagatgcagagcgttgaactggattccacaggcagcgcttgctgaatactacgctcaaagatcaacaccaggtggatttctcatcagcgaaggcaccttgatctcccccactgctcctgggtactttaccaatctctttccattattattcttttcaacaatatcataataatatattattcataatttcatgtgtctatatgtttttttttccatctcatttactttaactgttggggggaatattatttgttttatgatttttaattattaaataaaaaaaatcacttcatgatttataatgttaaatatgtaattcacttttatttaaatattaaaatattattgattgcaagactgtgtaaacattagtcaattgataaaacatttattccttgtgcttcaacgcaaaactgtttgtttttgtactaagtctaaaatgctcctctttttttttttcctttaaagaaaataangnngaannnannnnnnnnntacggggaaaagagnnnnnnggggggggtgnnnnnnnnnnnannnnaaaaannnnnaaaattaannntnnnnntttttttttttaaaaaaaannnnnggccccacnncttttttttatatttttttnnnnnccccaaaaanccttttattttcctcgggannnntnnnnnnngnnnnatncnnnnnntttttttttttgggnnaannnnnnnannnntccaannnnaaaannnnnnnangtctccnctnncnnnnaaaaacaaaagnnnacnnnannnnnnnnnnngnnnnnnnattcnnntttacnnnnnnnnnnngannnncnntcnnnncnnnnnnnnntttttttannnnnnnnnnnnnannaanncccctcttttttttttcnnnnnnnnnnatctnntncnnnncatannnnnnnnnnnnnnttttnnnnttttttatnnnnnnnnnnannntnnaannntnnnnnnnnnnnncaaaaacnnnnnnnnnnnannnnnnacnnnncttctnnctnnacttt

SEQ ID NO: 5898 - DNA, 228 bp, Glycine max
tcatgcatggaaagggaaaggtggtaagaagaaaaatagtaacaagggtggtggtaagaagcaccgttgagcacgtccttgtgaataacgtgttttaggaatattcaggagtcattttttaatatgtatgacctttataaatctagtatgacccttgggtaagcttttcattttgacagtgaaatggatagaatagaaaacaggacaattatgtcttgtgctttctga

SEQ ID NO: 5899 - DNA, 380 bp, Glycine max
ttcttctcttcgttcagatcatgatctgtgccttgcaccatggaaaaattgaattagcttaatttcactgaatttatgcatgattaacgggaatctaatgttgattcttttttatggccagatttcgtttgaaattttgtttgttttattttgttctgtttttggtttgcttgattggctttaatttattgagatgtaaaaaaagtgttcacaaggaagaggcaattcagctacgtgtacggaggaattcattcttggatatttatgattaaaaataaattttggattttgtactgctatgacagagatttgcatgttttagcatattaggatgtgtagcattgatgcgttccctgtttggcgtcttttgtgcttggatg

SEQ ID NO: 5900 - DNA, 265 bp, Glycine max
atttgcgggacaatgtggctgttatggctcgccagtatgtgcgtaatgttgtgcgatctgttcagagggttgctatggcaattgctccctctaggatcagtacacagttggggccaaagtcacttcctggtccaccagaggctcttaccttagcaagatggatctgcaaaagctacaggtttgcattcttctattaatcttgtctgtaagtttatttttgttatggttaatgtactttcctaaatcatttgatttccttgtcttg

SEQ ID NO: 5901 - DNA, 397 bp, Glycine max
atcacagatgaagtacttaaaggaaggtctgttccatttagctcatctgacggtgccagtggtgtggttgactttcctgggctacaaaatgatattgaagtcatggaacgtaacctgttaagtggtctcagtcatttcttcgacgcagcgaatgggttttttgatgttttttccaagtctccaagcatctttgatgcagagtcatcctcaccctctgtgaggagagggatacctattgaagaatatcgtcggccagaagcttatcctaaatccaaggagaaggaatcaggagatactgattttgttgcaatggctaaagatgtttaaaccttaaatatgccctgggtataaaataagttttcttagttttgtattagattgtggacatctggaccaa

SEQ ID NO: 5902 - DNA, 362 bp, Glycine max
gaggcttcacgcaggttcgtatcttctctgattcgatcctcccttcgtagatctcaatcgaaaccctcgatttccgcatccgcatcgaggctcacgtcatccaaccgtgcctctccgcacggttacttgctgaaccgcgtcgccgaatacgctaccgcggcggcggctgctaccgctcctccctctgctccgcctccgggcaagaaggaggttagcggcggcgggaagatcaccgatgagttcaccgggaagggctcgatcgggcaggtctgccaggtcatcggtgccgtcgtcgatgtcagattcgacgagggtttgcctccgatcatgaccgcgctggaggttctggatcactcctcgag

SEQ ID NO: 5903 - DNA, 383 bp, Glycine max
tctttcatcctttccttttttactacttttttcctattccttctttacaataattccatttgtatacatttatggatcagactctgctagaaaaatgaaaaatgtacttctctgctatggagcagccaactggacaggtgcagcagaaatcatttcaaaattggacgcatcctcacaatttccctcatactggagccccccactgaaagcaaataatcctacaaattctgcttaaacaaaaaccagcatctgagttagcaggtcagttttacctatatgtacaagcatgcaagagacaccagctggggctgccccatggcccaatcataccaggggatgatcacatcacaccacataaaatgatcacatcacaccacataaaa

SEQ ID NO: 5904 - DNA, 310 bp, Glycine max
cattttcaaaaggaaaaacaaaacttctgatgcattaggaaaacaggtatcatattgagtctgcaacagcactaggaaagcaattcccagtgacaagcacagcaacaacaaaaagtttcatcctcaaaatcaatgtgaatatatatcttagttaatacaagtgataacattaagtaatacaatttcccaaaccacaactatcaataacaaacaacccacacagcaaggaacaaggaaatcataagaacaagaaaaacaaaaataaataatatcatctcagccgccaacacaatcagaccctcttccttca

SEQ ID NO: 5905 - DNA, 647 bp, Glycine max
  misc_feature (639)..(640): n is a, c, g, or t
gtttcctttttaggagctctgggacttttattatcttcaaggcttcacttctttggtgttcctatgaaggatcactgtgctcatgcattaccatccaaagaggtttgttcctcaaaggctccccatttcagaatttatcagtcttgcatgtcacatgcacaagataattgacaattcgtttatatccaactctaattccatcagcacatagttgagaataaggaatttcgttttgttttatttcattttttacatgccaataactcagtaaggaaaaattgtttctttgaagaatgatagattggggaaaactttgtttcatcacttcatttttgcttataggatttgtaattgtaatttagtttgttgttggatgttccaggctcggcccaatgggaagttcactgtggtggagtttaatgcagattggtgtgaagtacgtggggaattagctcctgatgtgtacgaagtagagtagcagtataacaccaccgagtgtgtgtgaatcaactgacctgacttaacaagtggtctcgagttgaactcctaagtatgcagttgtattaaatatttgaaagaaaagtttaaccttctataataattcaatccgacttaaacaagattgtttcgactgaaggnntacatgt

SEQ ID NO: 5906 - DNA, 350 bp, Glycine max
ctacttctccagcacctcctatgaaaggtgtttcacatggaacttctaattgttcctttcatttctcagaggactcaatctgttgagcaagcatgcaactcctagagaacgtatgattcataacatgtgcatacaaatggaatgtcagctagagctggccagaagaattactagagatgttcaaatgtaatccaagatatgtaatgcatatttcacgaatccatgtattcaatttaaataataataataaaaaacattctagaatctagagactagagcctttcacccaacaaattaattaagtttcagactagttggttcctcaatcggatgtgaaggtcaccttggcc

SEQ ID NO: 5907 - DNA, 547 bp, Glycine max
  misc_feature (49)..(51): n is a, c, g, or t
  misc_feature (53)..(55): n is a, c, g, or t
atttgtcttgtccaccattccactgtagccacttgaaatccccaagccnnntnnngatgaacgtaaaccctgaatttgcatatcaagcaccattatattttaacattgatttaatgcattgaaaacttgcactattgaaaagctcacttgtgccattttgccaaacaaagaggcgggcgagtttcgattacgtgacactgccttagttgtattgctggccttcattgtacattgtagataaaacagaagtgttgatgttgttgaaagccagtaggctagatcatggattccttcttgactctgccagaacataaaatccaagttactttcacacaataatatgagtgattacatttaggttgaaatgatgatgttttatttagaattccttaatctttgtcaatgtactaaagttcttgcagaatactacctctatagatgatcggatagcatgtgtaattttatcaaaaatatgagtcttttctgcttcaagggatctccaatgaagaagtgatttatatacaatacaagcaacagctggtctgtt

SEQ ID NO: 5908 - DNA, 533 bp, Glycine max
tgagagtctttatgacagcattaaagatagaaagcagcatatcacagagcacaaactttaatctgactgcaaggatgtagatgtaagttctatatttctaacaaaatcagggcaaagaaatttatggaagctttgagatcctatgagaaacaatacaaatattttagtccctccttttatgtgcttggtcgattacttttgtgactagtgagcaaaatttctgtttctttctgtctactcattcattttctatctacccatcttttacagatgctttgagtatatatgccaaaggtgggagagaagcacaacctgaattatatggacacaaatcaaaggagggatatagtatgaaggaaattcttgcttatctgaatcctgtttctctcagatattatagagttcaattattcattaggtcatatcattctgattatgctagcttggctatgaaatcaaaaagtcacattgaaatttatactatagtacttcaatattacctttgtactatcgaagattgtacagctgctttc

SEQ ID NO: 5909 - DNA, 350 bp, Glycine max
gaaggcaggttctgctgtcactgcagagaatacagaacaagaatctgctcctatcccagaaactctaacaagaagcgtggaagagtttgaacagactgagaaaacagctgaggtaacaaaaaagccacagaaaacatctcaattcacgaggcagaccaaggtaaaatctgtacccgcagctcttcgcaaccggggtaagaggcgaattcaaccatgggtatgtgttctaattgcgcttgtcgttgctgttgccttgttttatgttggccataactgctctttgagatcttcgctcgaaggctttggttactgaggacactcggaagcaatcactgggcgtttgttgggaa

SEQ ID NO: 5910 - DNA, 407 bp, Glycine max
tctctttttggtagaaaagctaaaaagtgagctaagtgattacaaagaatccgaatccagggtcatggaagtagttggtaaaatgcaaatgcaattggaaacagcaaatcagactgtggaaacacttaggtcagatggcatgaaagcagcagaagcttacaaatctttggctttagagttggagcaatcaagaactcaagcaaaatcattggaagcacttgtgagtaaacttcaggctgatttgcttagcagtgcaaacaaaagtatatcaggttcaactccaaccaatgaaaatggaccttctcaggaaaatggagaaaatgaggaaataaaccagctcaaagctgagcttatctctgcaaaagttgaagtggggaagttgaagtctgcattggatatttctgagg

SEQ ID NO: 5911 - DNA, 383 bp, Glycine max
tatagtgataagaaccaatcattcagacaaagcacatgtttggtttaaattaagtttaagagagtttatatccaaatgttctctatgcagtattttaattataagcttttttttatcacaaaataagctattccaaacatgtactaaaatgtttatcacaaaattaacttttctggtaatttcaaatggtgatattgatgtagatgcatgacttattttggaacttggaagcaacaagtctaggaaattatgacaaatatcttttgttgcagctccctttaatttcacagcataattctaaactttagtataatttgtatgcaggtatgactgggatagttgattataccaattatgatgatatgaaatatgctgtaagtgtt

SEQ ID NO: 5912 - DNA, 255 bp, Glycine max
tgttctcttcatgtcaagcatgtggaggaatgatgccttcccgcactggttttggcattcctcagtattgtaagttgtcatgtttgatttagtcaatggcactgtcaaatttatgtttctgttttttgatgaatggcttttgagttttgattatggtcaagatattttatgctagcttgtagcaatgtggtaccttgtatgttattcaaattcatgcagatgaactgaagtattttatttatggtgggttttttt

SEQ ID NO: 5913 - DNA, 793 bp, Glycine max
  misc_feature (755)..(756): n is a, c, g, or t
agtgccgccgtgatgcttctcacgcaggggttctacggctggaaatgagggtgtgagtggtcttaaggctctgggagtcagagacctcaactatcgtctagcttttatcgccaactctgttcaggttggttatttgtgtctcattaatggcatgttcatgtgatgtgatattgattttgtaatggatgtggtttttgaataatttctttcagatttgtgatggtagaagagaaatagacatcaggaacagaaagaaggatgctgatgatgacaatcaacagtttactgtaagtttcatggtgcactccatctatatccattataatgttattcatatggtttagattttatattgtcagctgttgtggctggtgttaactcttatgaagcgtgttgaatatttatcttgatgtgaagagcagtagttttgctttaatcattaggttaattgctattctgtatatcttttcccaatatttatcaatctatgttcaatatgcaaaactggttggattttttggttcatttccttttcaatgtctgctgtagttctagatcttgtcatttttctccacttcacatagttctcttggttagttttccatcatatatttgaaaaaggataattaaccccattatttgcctgggtgattcgacaggatcaggaactggaagaaattaaacgaatgaggagcactccagattttttcaccaaacttgtcgaaagcattgctccaactgtttttggtcatccnngatattaagagagctatccttcttatgcttttgggtg

SEQ ID NO: 5914 - DNA, 371 bp, Glycine max
  misc_feature (346)..(348): n is a, c, g, or t
aattttttcataattctcgcttttgcatctagtcaaaaactgttcctcttcaattgttgtctatgcaatgtaatatttgtcaattcgtcactcacttgaggcaaaagagatcgtgctttgactatggatgaaaaaccatattgaatgtttacattaacgacgtataaataattgaacaaattccaaacgcaaaataccatctaattttttgaatccaaattccaagtgcatatttttgcttcaaaatttgatcctaagtctcgttgttatttttaaattatacaccaattccaattggctcttgtagctcactgaatagaactgagttgctgaggaatatcggctnnntatgtccccaacacattgcatag

SEQ ID NO: 5915 - DNA, 378 bp, Glycine max
agatctaacaaggtaatttttcccttaactatttgaaactcattatcacaacttggtaaaagttacctttcaattgtcaaatttaaaacccatcacataaaatgccacaaatacatgccacaccaaaatttgcaagagaattcaaccacactgcagatctgcttcaggtagcagttcatcgtgatactttcaccatactcaagcagaaaggtatatacaaagtactcatttttttttgttaagaatgtgagggtaaagaccaatttctgacccaatctgtaagagttgccacatttctactaacgtcttctatattatcactcttcattgcaatcactttctcctccgagtaactttctttagcctcctcaagcaaaa

SEQ ID NO: 5916 - DNA, 756 bp, Glycine max
  misc_feature (752)..(752): n is a, c, g, or t
tttggtattgccgcaagaaacttttggatcgaagttgtagtcaccccctccgtatccacaacacgcttttgtaccatattgaagccctatttcgtgaaaagaaaataaataacaaacataataaaaatattttagtcatatataatagccaaaagtgcgtcataaaaatatcgttctaatatctcaattaagtttctaaataatatcaaattagaaatttctctaataagtgagaatcaactttgcagtcttaaaagtattaattaaaatatccaattaacgaattagataaaaataaaccttggaaaaccaaattgagagataatgtattttgggatcataattcttattattaaacaaggacagatattagtgtttgaaccatgagaagtgggatgttggaaaagctccaacaagacagaatgggtgtccacatagatgacagaagcatcagaaagactttctctggtttgcttcaatgtctctttcaacatgttattatagttcagtaccgcattgttgtaagaaatcaaacatccaaaatcatcaatgtttgaactatcatgaggaaactccaccaagaatgcagggtaacacccaactggtgcaagattaagaaccataaatgtacgtcctccaagattatatagctcctacaaatttcattaaccacaaaccaaattaataacatttttttttgtttatgtaattatcaatactatatttgagttgatgttaactgttaaggtaanctca

SEQ ID NO: 5917 - DNA, 311 bp, Glycine max
catactatgtaaaaggtggagaatatcctgagcaatccatttgttcagatgtgaatactccagtaaataatgctaatgacacatatgaagcacgtggaaaatgcttaagcagaaaatctggaatttttttccttccgcaaagaccgtatatggttttgggtacccttcgtgaacaattaatgtatccaacttggacagatgacgtagttcctatgtcagacagtactaaagaaaaaagtatgtgatttctagtttcttttcaccccaacacctattgtttttagttcttacgcagattccatacttttttt

SEQ ID NO: 5918 - DNA, 381 bp, Glycine max
tcgagaatgggttctgcagcattgcagccaggttgtgttatgctgaatgctttctttgtctggccaactacttaagaagttgttcttgagtttcaatgactacttacaagaattgtgttcaacacaagaagttttagggttgtcggctctagaccagaacccatttagtagtgggccacttcctgatttttctaggctttcatacttaaagacattgagacttcaaaataccaacattgttgggccattatcatttgaccacttgccccatcttgatgttttggatctaagtttaaaccatttgagtggaccaattcctatgttcaaggtcactaaatttgcctcattatactatttggacctttccaacaatgaattgag

SEQ ID NO: 5919 - DNA, 347 bp, Glycine max
gattgctactggtggcatgccctgataatgagtggttgtgtgttgggcttgtgcgtgggcataggaggttgtgtatgtgtggtggagaacgagaatggaagaatcatcattgatattagtcacaggtaccatcctgatatgcctgcctgggaatccaaggatagccttgggcagtttttgtggcttacaagaagcatggccaatggttctctggctaacttctcccaattcaagctccccgctcacagcggcacccatgtcgatgctcccggacatgttttcgatcactatttccattctggctttgatgtcgactctctcgatttactactccttaatggccctgc

SEQ ID NO: 5920 - DNA, 712 bp, Glycine max
caggttcaggaaagaccattttgtttgtatgcattgcatgctttcttgcgggaaccctcttcaatggccagatgtggacacgcccctccaaccatgaaaatgaaaatacactactacgtctaccacccagacctgattgtgatcataagcgagtgagtacatacaaactgtagtgctttgttattacaaagtatttgaaattaaatttctattctttcaaacagaaactgattgaaggcaaacctggtgatgtaatggaggaagtcgtaaagactcatcaagctatcaagtaagatatataatttaattgtactatattgattcatatgttaagctaatatgcgatatttaatagaaataataatgcgacagtatagtagagtatcatgttagcatgaatgatctaaggtaactgtgcataagaatgttatgttaaatatttaatgaaacaaaattgcataattaagcctcgttttaatttgctttgatattgtattagtatatgtgtgaaatgaattgtttgtgcacaaattaaaacaggtcactggataaggcagtttcgacactggaaatggaactgacagcaagccaaactggtgggcggcaacggtcttctaaccacagtgtacagaaggcttttgtggtgattggtattaacacagcatttagcagcaaaaggcgaagagactcgatacgccaaacatggttatct

SEQ ID NO: 5921 - DNA, 380 bp, Glycine max
gattatcgattaacagtggtcgatgatcgatgccaaagatgaagcacctgctgagaaagcttcacatcggtggtggcgctgccaccatcaaccccagtcccaatcacaacgcattgtcgtcgcacgctcacaatcacactccccctccctccacttccacgctcccttctccctccgtcgtttcggatcggagccccgtcgtcgtcgaggcgcaaaacgaggtcgccgatttcaatttgttgcaggaggaggagtttcagatgcaactcgcgctcgcaatcagcgcctccgattccgatcgccgcgacaccgccgaatcggcccagatcgacgccgccaaacagatcagcctcggttactctgcttccctcactgacaca

SEQ ID NO: 5922 - DNA, 617 bp, Glycine max
  misc_feature (235)..(236): n is a, c, g, or t
  misc_feature (270)..(270): n is a, c, g, or t
  misc_feature (296)..(296): n is a, c, g, or t
  misc_feature (300)..(300): n is a, c, g, or t
  misc_feature (312)..(312): n is a, c, g, or t
  misc_feature (314)..(314): n is a, c, g, or t
  misc_feature (334)..(334): n is a, c, g, or t
  misc_feature (337)..(337): n is a, c, g, or t
  misc_feature (339)..(339): n is a, c, g, or t
  misc_feature (344)..(344): n is a, c, g, or t
  misc_feature (412)..(412): n is a, c, g, or t
  misc_feature (433)..(433): n is a, c, g, or t
  misc_feature (452)..(453): n is a, c, g, or t
  misc_feature (458)..(458): n is a, c, g, or t
  misc_feature (460)..(460): n is a, c, g, or t
  misc_feature (553)..(556): n is a, c, g, or t
  misc_feature (563)..(564): n is a, c, g, or t
  misc_feature (583)..(585): n is a, c, g, or t
  misc_feature (608)..(608): n is a, c, g, or t
  misc_feature (610)..(611): n is a, c, g, or t
ttgaggacatggacatagcagttcgagctcacttgaatggatggaagttcatcttccttaatgatgtcaaagttctatgtgaattaccagagtcttatgaagcttataagaaacaacaacatcgttggcactctggcccaatgcagcttttcaggctatgccttcctgctatactaacttccaaggtattattacttttcacttctctttcaacttattctacatctttctgggnntaatttctatgcacttttactctcaaccaatcanaaattattgttggtataatttttaanatanttattggaaaantnaataaacttaccatataacnatnanattgnataacaatgcaaaaaccatttacactataagtgcatacactatttattatttactatttactcaatcnagtttaatttctatgcacagncaatgtaaaaattttacanngtcanancaatcataaattatggtttgcgcttttaagataattattatagaagtctttcaaacttatcatactatcaaaacgcatacactacttacccannnnttgcatnnttaaatgcatagtttgctnnnttcttatttgcttttatcccatncnnatatca

SEQ ID NO: 5923 - DNA, 567 bp, Glycine max
tacattgttacttgatgctcaaaaacaatggcgtcagggctgagagggctgcacttggtgctattctctttctgttcgcttttctctatgccttttggcgcatgggcattcactttccaatgccatctccagataaaggtattggaagcactgctagtggaattgaattgggcgcaaacaactgatttttgtttatttatttagttagtaaagtgtaaattgtgtaatcaactcactgctgattgattgtttgcattaatagacactgcaattaattgaaggaatatggttgatcctcgtgtttatttcttgtttcaggtttcttcaccatgcctcaactggtgagtcgaattggggttattggtgttactgtcatggctgtgctatctggttttggtgctgtaaacctcccatacagttacttatcacttttcatcagagagattgaggaaacagaaatcaaggccttggaaagacagctaatgcaatcgattgagacctgtgtatcaaagaaaaagaaaattattctttgccaaatggagatggataacaagcaaggatctgaag

SEQ ID NO: 5924 - DNA, 831 bp, Glycine max
  misc_feature (54)..(56): n is a, c, g, or t
tagtaaagccaccaactccaacaccaacttccccagtggtgtaccctcctcctnnntttccatctccaccagctcctgtagtgaaatcaaacaagggtaagtgtgtaccacatctatctctttagtaactcctttccgatctctaatgtaattaaatgaaatgattctgtcacatttttctgctaatttaacttttacgttatttagaaaaaaaatataaaagaaatttgtatcactttttctttaaaaataggaaaaatatgtgtgataaaatagataatgttttacaatttcattacagaaatactttatattttataatgttaatattttttatttttcacaatttttttcttctttcttattagtttttggacttaaattaaataatatttttaatcctgtcatgtgggttttagtattcttaatattattttcttgatttgattactgtaaaatgttttagtaaggcttaactaaaacagacaaagaaaaatatttcaagaagattaaaatggaaaaaaagaatcttataatacatggattaaaaaattagtgaagccttacttttgtttttcttttctctttgttacacgtcttcaccttgttgtctttgttatcctttttcacatctaatgatggatgtgagagaagaaccatgcatggtcttaattgtttatgtgattaatggctttaaagtatagaacttttaagtaagatcagttgagttaattaatgaaacatggtcttttgttttccaaatttttttgtgggcagattgcattccactaagggattataggtgctcattacactcaaggaagaaattgt

SEQ ID NO: 5925 - DNA, 642 bp, Glycine max
gaaaagcaattgatacgcgagatcaaacaattgaagcagaaccgtgaggagttgtcttctaatatgaaaaagcaggatcaatcacaacaatctgtagacaacaaggatgacaatattgaagagcactttaaggtaccatatgaaagcttctctttgctagatttcctgaattaaatacctgattgcatttcctaggcactattgatatcaagtatgggtacttatttttaggggatttctaatatctttgacaatgcattaatcaatatttcactgttttcagcatttacagcttttgaagaaggaaatggaagtgcttagaaataatgttctgaagtcagatacagaaactaaagccgcaaagaagaaatataatgatgaatgtgataaactgaatgagttgctagctcgatttagggccgctgatgattctcgtcaagaggcatatgctaagttactggctttgaaaaaacaattgcatgagaaggtttgagttttccattctttccactttattcgttttctttttggttttttctcttcgataaaacaattgcaaatgccatgtacaaatattgatcctattttggtactgataatacagagcaaaaatttctgggaatacagagatgctgccaataa

SEQ ID NO: 5926 - DNA, 371 bp, Glycine max
attcgctcttgacgctttcgcttgctcatctttgtaggatctgccactttgaagtatcttggagccaattcaacaagccatttggggtctatgacagtgacctcacgcatatattccttagttgtcatcacaagctcatggtagatgacccagtctggttgtctctggaacagagctgaacttggatggatatacacaggctggttctcaacaagggttctgtaaccttcctgggggtcctttctagaagcatggaaaaagaaccctgcagtgatagccttcctgactttggtgaagttttttcccgcacttacacctccaattgtactatgtgtgccaagatggggtgcttagtgtcatagtgcaaaatt

SEQ ID NO: 5927 - DNA, 1028 bp, Glycine max
  misc_feature (10)..(10): n is a, c, g, or t
  misc_feature (52)..(54): n is a, c, g, or t
taaacactcnactgatactcgggttgaggatcttgttagcaggatgactctnnnaggagaaaattggccaaatgttgcaggttgagcgcaagtatgtatctgctgatttacttaagaagtattttattggtaatcaccagacccttttcttagtttttttctttccccttttgtttgtggtatgttcactcaattggctaaaaatggaacttatttgtcttttgagtaggggctgtattgagtgagggagggagtattccagctccacaggcttctgctgaaacctggattgacatggtgaatgaatttcagaagggtgccttatcaacccggctcggaattccaatgttttatgggattgatgccgttcatggccacaacacggttcacaacgcaactatttttcctcacaatattggccttggagctaccaggtatattgataatttgatatcagtaatgtttgtctcataagggtgtgagacgcgatgggtgaaaaggaagagtgataggaagagaagaaaaatgttaagagagaaagagtgagaaatgataaataaaaaataaaaaatggaagagatggtaagagagaagggatgcacaatgaatataaaagaaagtgagtgaacaaataaaagtccattgactttagcagcattccatatgtcttagccttttgtttttaaaaattatattctgtagacctatacttgattctaatatttgaagtttgaaccatgatcaattgatcatgaaccaattcaggcattaattacaacagattctaaagcaactcagacatgcataggataggtttgtgtcagacttgcacattctagtctggaacctgaatttaattattttatctggtttgtatccaataaatgctttactctggtatgttatggtcttaaacttaatatatgttttgcctggtttcctttcgcacaaattatctattgttattctaaatacacttactggtacaaaaggtaatattggatattttcattttgctggttagggac

SEQ ID NO: 5928 - DNA, 438 bp, Glycine max
  misc_feature (356)..(357): n is a, c, g, or t
ctcacacctgtttatcattacaattcaccgccgccaccgtcatttccaccacctacacctgtatatgaagggcctttgccacctgtcatcggagtctcatatgcatctcctcctccaccacccttttattgattcttttgagaacttttctcctctaacccttcccctctaccctagcaaagacgaaaaaacaaaaacacccattcaagttcagttcatacttttattattattggtggccatttcttctgtgccctcttcttcctgtgccagccaggtcatgtacgcgactctcgtcgcgaaaaataaaacctgagaaatcgagaagggtttgtgtaagggtgcatacatgtttnngaggtcatgtacgcgactctcgtcgcgaaaaataaaacctgagaaatcgagaagggtttgtgtaaggctgcatacatgttt

SEQ ID NO: 5929 - DNA, 561 bp, Glycine max
cttttcttctgattccttctctttctgcccatctcatctcatctcattttgttttggtccaccctcatcatattgaagactccgccatatagggggcatctttgtttctctttcattcttcttgtgtgtttgtgattattgccctgtcctctgcattcctttaattcccccattcatttcccacctttctctcacaaaccaaactcatcatggccgttcaagctcaatacccttccaatgtactactcttcctaaacaggtttgcatcttcttcctgcttcatttcaatacttgtcaatccatcctccttcttcttacacatatttatgcatttccaacagcaaaaccgggcaagaagcacatgattattcattgcaatctccgccaggacaacaactccttgatcaatcccatatgctattcaacaacggaggtatgtttcatattgtttcatacattagttttttgcatgacattaaactaatcgaaaatcctaaatttcattatttgtgatcaaacaggtactaattctcgaaagagaggaagagaaacaactgcagc

SEQ ID NO: 5930 - DNA, 400 bp, Glycine max
aaaagcaacggcagttaccaaactgacggcggcgccggtggagcacagggaagcagggagtccggcatgacggcggtgaagccactggatttgatgccggtgaaacggagctccggcgaggacgcggcggatacggtgccgaaggagataaatctaattccgaatccgaagctgtttggcgtggcgattggagcgaagcgagcgagagagggaggaggaggaagtggaagtggtcgagattgcggaggaggaggaggaggaggaggaggaggaggagaggaagataccctgctgcgcctgcatcacgtgggttctgcagacgtgaaatctgagccgttggattgccagaaccatcgcgagaatcaggaaacgccgtggttgagtccgtgtcacaggacaa

SEQ ID NO: 5931 - DNA, 332 bp, Glycine max
agggttgatcagccaaggagatgttgttctagtggtctcagatgttgctccaacacgtgccactcctatggctttccagtctattcaggtgaagactattatctaaaacgcaaggctgcaaaaatattgaaggacacgtgtctgtgtattttataggcttgggataggatagtattgtattattggtttcttgtctttttttttgattggtttcttgtccttatgtaaaacaacaaaatttataaattccaaatggtggaactctagcaagttttgaaacctctttcaagagattcttatgaattacacttcgtgaattgcccattgtaagt

SEQ ID NO: 5932 - DNA, 724 bp, Glycine max
taaatttgattttgttgcttgcatgggtgccttctttggggttgtttttgtctcggttgagatacgacttctaattgctgtaagtactactataattaatgcttagttatttatgctctaaatgtcaaagctagtcttgttcatttcgtatattaattgctaattaatactttatggcaggtctctatttcctttgcaaagatcctattacaagtcacaaggccccgaactgctattctagggaagattcctaggactactgtctatagaaacattcaacaatatccagaagctagtaagattccaggtgtactgattgtaagagtcgattctgcaatatatttttccaactccaattatgttaaacaaaggtaaagacgtcttcctccttcatttgtacatttattgtacatttataggtacatgagaaattgttctatatatccagactcgagtttaagtgaaaccaatccagtatgtacagtgatttaatttattattttggaaacaactaaaattaagcccaagtactaaggaggacaggtgtgtcattcaaaacatgttaggtaacactatatatgatacttaccacaagactaaatttagatatgcatgtaaaaatgcaagcaattgttactcatgagaagaaaaatacccaatttctatccaatatcttatgggaactattcgtgatgcttaagaattattctcttgcaggacatta

SEQ ID NO: 5933 - DNA, 494 bp, Glycine max
gaatcaccctctccaacgtcactctcaccctctctctgttttctgtctcttctttcttttatcacacaacaacatacacacgccctcttcttcttccttgcatggactaactcagagactaaaccataccaaaaaaaacaacatgtgttccgcagagaaggacgggatcatgctcttcggcgtgcgcctctccgtcgtggataaccaccccacctccttcagaaagagcgctagcatgaccaacctttctcagtacgagtctccaccaccgcacgatcccaacgcagggtatgcctcagacgacgtcgttcacccctcccgtcacacccgcgaacgcaagcgaggtatgaaccgtatattactaattaactgattaattaattgattaaattttttgttaaggtgttgataatggttacgaataaattaggggttccgtggacggaggaagagcacaggttgttcctgctgggattacagaacatcggtaaagg

SEQ ID NO: 5934 - DNA, 529 bp, Glycine max
tagatcatcacagtcaggtaacttaggatgcacatgccgagcttccagtgatctaacaggctcaaatgtagcagcacgagtaaatactttcttcttaatttccgctctttctctcttcctcgtgaacaacacagagaagcggaaattaagaagaaagtatttactcgtgctgctacatttgagcctgttagatcactggaagctcggcatgtgcatcctaagttacctgactgtgatgatctagcagctaggattgcggccttaagagcatgataaaggatagcataagtataatgctcctcttttatcggcatgattgcactcgttatgatcatcacgctttaatcttgttacaatgttaagtgcctggtattactgaagaatgaagattgcatggtggtgcttttatagcaaaatgctgactacttcggtgctgtgctaaatcattatagatggtcccgtctgtgttggttgacaatagtaactttgccattattttacagatgcggctataggtcataatacggag

SEQ ID NO: 5935 - DNA, 407 bp, Glycine max
  misc_feature (398)..(401): n is a, c, g, or t
cttcttgtgagcgtactcactcctttgcatcctcctccactgccaccgtccactcggcggtggcggccacatcgagcaatcgcaaactgttcggcacaaacatccggctgcctgtgtccttcaacactcggccatttgaaggcccaattcctcggccataattggttgaggcctgaggacaatgtgatatttataatgatgtctagacatttttaattactagacatgtatgcatggaaaaaaaatcaaattgcaacggaacaccaatttgtggtttttgttaggaatcaaggatatgagtttggacttggttaagtcttcagtgaagggttgttctattttgtgtatgctataagttatagctagtcaacttcaagatttgtgtagggtagatatgnnnnccggag

SEQ ID NO: 5936 - DNA, 900 bp, Glycine max
  misc_feature (12)..(13): n is a, c, g, or t
atgatgcatgannagtccatggcaagtctcctaatcaagtacataaatcaaaactgagatcccatgtttaatcatctggcatttctcatgttcctgaaaccattaaaaagaaaaaaggaacttaaactccacaaaaagatagattttaagtcataaacaagattatcaaaatcaaacactaatcaataccaacaggaagcattgacattatacaagtagatatgaattaacacctgaactctggataatcaagtaataacataatttttctagactcgttttcattaaaaataaaaatgaacagagccaaataatcatttatcaattgtggttgagcagcttacagaaataccaaaacctacttgcagagtgttagagttatgtggaatatacatttgacggtttgaggcagagcatacctgtgtaagtgtgtctgatgattttactgctatgagatttaaacatagctttgactgaaggctcagtcttgaggtttcatggcagggaagagaagaacctcctgtcaccaaaaggacaaaagatagtaagaaattgtgaaaacaaagtaagcatgtcaccaaaatgacaaaagagtaagaaatcatgaaaacaaagtaagcatgcagatagagagagcaaaaaccttgatattctgtgaatctgtcagtaacatggtcaaccgatcaatacccaaaccccaaccaccagtaggtggcaaaccatactccagagccgtacaaaatgtttcatcgaaggccattgcttcatcatcacctgattgtcgatcctgacatgtaaaacaaataacaaacagctactaatattttctatataaaaagcccaacaattagagcatagtacatattaccattgtatcaattttcattaccttgagttgtc

SEQ ID NO: 5937 - DNA, 400 bp, Glycine max
tacggagggtccttctgctgcggataatgactctgctgctatcagcttgaaacacatgaatagaatgtgggtgatgacccttgcagtggctactattgcagcagtgttttcgttgtgacaattatgatagcttgaacgagttactggtacatgaagtatgctacttggggtccgatgttgttgtgctttgttaaaattttctacatgctttttttggggggattggttggattaaaggggaatcatgaactttttctagcactttttaattattcttttgcttctttttgtattgattaattcagtctgtggtgaaatatgtattggattttgaaggtttttctttactcgttcgcatcttatattgagaattttgtgtattgttagttgccaaacgaag

SEQ ID NO: 5938 - DNA, 345 bp, Glycine max
tcgtacgcaatgcgacgccgtctccgtgcaagccgcgtgccgttaaacccttaacggcacttccgagcgcggggcggaggcagttgctgttttttctgacggcgacgacggcgttgacggcgagggaagcggcgtccgtggcgcaggacattcccttgttcgggatacggaagagtctgaagaaggtggaggaggaagcggaggagattgtgagagagggatttgaggctgcggataagggattggtggcggcggagaaggggctggagacggcggagaaggggttggtggcggcggagaaggggatagaggaagcggagagggagatagaggagacggtgagtt

SEQ ID NO: 5939 - DNA, 687 bp, Glycine max
  misc_feature (659)..(663): n is a, c, g, or t
  misc_feature (667)..(675): n is a, c, g, or t
  misc_feature (677)..(682): n is a, c, g, or t
tgatgttttttgatctgaacaaaaccattgttacttactttgttccaatttttaggtaatcgccaagaagaaaaccattgaagaactcatcaaaacagcacgtgccgaaaaagaccacctcgctcctttccccgactttcgacgtttccacgtaaacggtaaccgttttggatttgtttcatgtttttagaccagttaggttagtttcctcactcagcagttagttacaaaagatacaaataaaaaattatgagttatgttataggagaacactattttggtcaatgactgtgtaatatgctgtaacttaagttcatgaaactatggaaattcaaaataaaagttcttaattttaacttctttctcttactttagtccttaaacatacgttaatattatcgtttaagtcagatgactttctgaaaaaagtgatttataaattgcactttcagttatttttttgaaatcttcttacttctaggactaatgtcactgcactatacactttcagaactataattgtgtgtgttttacccttatgttattcatactacatttttaaaacaaaaagcgatatgtcaataccaaaagattttagtttatctctttctcagtcgtatgatttgttgcatgagttttgtataaataacattttctannnnntatnnnnnnnnntnnnnnnctaaa

SEQ ID NO: 5940 - DNA, 546 bp, Glycine max
cttccaatctgccaccgggacgtctgactgaccttcgggctgctgctgtaaacaatgaaaattttgcgcgtgttgcagttaaacacaaccttcatgtgcatctccggcatggatccagtgccctagaaaaacaggtcttgtttctttctgataactttttactattacttggagatgaatcataggaactatcctaatatcctaatttttaaccaatttgattttttggggtcatcctgatattgtgcttttggttgtctgtagattaaagaatttgttaaggaagttcaagatgaattgtcaaagccaggttttaattcctttggtctgggagactgcaaagcccccaaggtccttggtgacattcttgaatctattgcaggtgccatttttcttgacagtgggagggatactactgttgtttggaaggttagtgtctagcttttaagcatagaccatttcctatattcttttacaaaatggagggaaaaaagagaaactgatggagaatattctcggtctcaattttgccaggtttttcagcct

SEQ ID NO: 5941 - DNA, 625 bp, Glycine max
ctactttagtctatgttgatatttataccattaagtatgacctcatcacaaatgccgcgaaatatggtaaatccaagcaaccactttcttctcatttaagtatccattattatttgactcactcttatgttgctaaactgaatcaagttttcctactttcactccatatattatgatgacataattggcacatttagatgactatatatatctgaacagtttgaatacatttgttattggctgaaatttgttagatatcacaaaattttgtaggtctcacttcttatttaacatgtcacacttataattttgtaatttctaataaattttaaccaatactggaaggtatatttgaaggaatgtgttgctactggtgagcaagcattcctcaatggggttaacttgcaaatggttcaagttattggattactcttattattatcataattttgatgatgtttgtgaatgcattattgattaggtttctcgaatccgttgatggtatgttgcggctatggagggcctccttacaattttgacgtaagggtgacatgtggtcaacctggttatcgggtttgtgatgaaggggctcggtatgtgagttgggatggaattcaaaaaaaaa

SEQ ID NO: 5942 - DNA, 325 bp, Glycine max
acaaagtcaagtgattcaggaagtcaatttgctcaaggatcatcaaataaggctccaatcaccgagccatatcctcgttagatattttttaagcgaattgggcaaaaaggaaatgattttgaaaacaagatatcaacttttgaaacttcatcctttggagttgacaagcccgtaccctccctggttattttgtaatataatgcttgttctagattccttgcactttgccacatccagtttctttttcattcttgtattttttgtggttttttcttttctttttggaaaccagtggtgtttgttttcagattccgcgcgtgcctcc

SEQ ID NO: 5943 - DNA, 205 bp, Glycine max
aagggaaaatggccatgcatatgcaagcacccacaatcagtcttaacactgcaaggtccccatcttcattagctccagctgccaatgctggcctgcgaccacacctcaaccctttggctttaaagtcatctttcttctctggttcccttaacctcttacttcatccaatgcaacagtatcttacttctggagctcccaggattaa

SEQ ID NO: 5944 - DNA, 360 bp, Glycine max
ctcaaaacttacttaccttgtcatttccagcttggaaaaatttcacaaacatactctcaaccctagtacctttcaatttgttgattgcaaacctagctagctaataggccacctacatttcttggatgatttttagaaggcacttcgttttgcatggctggtgatgcagcttttccctctaccacttgcatgatgaccctcttcttctctttgcttttagcccttcacttcgccatggctgtcccagaacgaagtttgtcctctttagcttctataaaagaaagtggtacaaagaagaggaacaccatggtagctgcttcggctagagaagcaggaagcacacaaaacatcaaggctgaa

SEQ ID NO: 5945 - DNA, 340 bp, Glycine max
tgggtgaggcactttccagaggaaggggaattgatgaaagagctgcacgtgcagctgccgaagtcaggaaaaaggctgcagcaaggggcctgtcggttcgtccccacggtgtaccagtccaatccttgccaccccttacccaacttctgaatattataaattcaggtgtgactccagatgcagtggacaatgggaatgcagacggagcaaagaaggaagcaaatgacattcctccaagtgattcaattgatgccaagaaaggccaaacaatgcctgtgcaagaacaggaacatgctccagttggatcacattctccggttggactaggcaagggcttgtc

SEQ ID NO: 5946 - DNA, 406 bp, Glycine max
acaaaaagaccaggatttggctggggacttttcccacgccggagatggcggcacgggcccacgacgtggcggcaatggccctgaggggccggtatgcctgtctcaacttcgctgactcgacgtggcggttaccaattcccgccactgctaacgcaaaggatatacagaaagcagcagcagaggctgccgaggctttcagaccaagtcagaccttagaaaatacgaatacaaagcaagagtgtgtaaaagtggtgacgacaacaacgatcacagaacaaaaacgaggaatgttttatacggaggaagaagagcaagtgttagatatgcctgagttgcttaggaatatggtgcttatgtccccaacacattgcatagggtatgagtatgaagatgctgacttggatgc

SEQ ID NO: 5947 - DNA, 529 bp, Glycine max
caccccatccactttccccaaataaacaggtaccgattaactgcaatgcttctactttgatttgaatgttaaattcctcaatattgagtaacaacctcaaagtgttgttgatgtcttgggtatatttctaattcgtgctgcttcattttccggaaattatcccatgttatcatctgcaggggaaaaaatgggatttttcttttgcttcagtctggaacactgttgtgtggctcatgcttatgaacttctttgtcaagatagtgaatgcaacttcccagaggtatctgaagaaacagcaggagacacagcttgctgcattaacggaaaagtctaccccaacagactcagacgcacaatgaattgtttatgttctgcttgtattgcccttttttatgcggtttcttctgcaagcagaaagttgaaattcaaattacagcaattccttatgtccccatagtagttaccccaaaaatctgcgttagaggtcctactaggaacttctataggaatggatatacacagtaggcaa

SEQ ID NO: 5948 - DNA, 931 bp, Glycine max
cttttgtttgttcttcgtactttagtgtgtgatttaattccaagattttgagaatgtctagctgtgggtgtggaagtagctgcaactgtggcagcaactgcgggtatagatgcttcttcttttctaatatgcttgcttgattaacctttaaaactattgattagtattggaaattaattttaacatgactttcaaatctgttaatgggattttcgtgtgaatcttattaatttttcttattgcacaagtttctaagggataggatttgctatgactattttgattggattttttagtatcctttattttatgaaattagatgctttgttttccgccgaccaaaaaaaaagatgcttttgtcttcctacctagatacatgggtttctagggatatacaattttcctatattttttgggtacgtagtttgattcgctttgtgggtgcctattttggttgaaatttatgaaattcgaggctttattcttttttcaacatcagtaattaagagggtagaactattctctttgttattttgattactttttctttggaatgttcttcataaaattgttcaaaaaacaaaattgctactttcagtttttttttatatatatttcttggataccttttttgttttcccacatgttttcacgaaccttacgtttgttgatttttcttgtgtttcagttgcaacaagtactcttttgacttgagctatgttgagaagacaaccacagagactcttgttttgggtgttgggtctgtgaaggcccaattggagggtgctgaaatgggtgttgcagctgagaacggtggctgcaactgtggatcaagctgcacctgcgacccatgcaactgcaagtgaggtcaagatttataaccttgaagcagagataactgtaatatatgtatcaacaaataataagaatt

SEQ ID NO: 5949 - DNA, 382 bp, Glycine max
tgtttgatgatggcagggttcaaactgctagcagagtaatgaagagtatggtggagaagggggtgaaggagaatatggacttggtttcgaaggtattggaggcccttctcatgaggggtcatgtggaagaagctctgggacgaattcatttgcttatgcttaatgggtgtgagcctgattttgaccatcttttatctgttctttgtgagaaagaaaagacaattgctgctctcaaactgttagattttgttcttgaaagagactgtatcatagatttttcaatctatgataaggttttagatgctctcttagcagcagggaagacactcaatgcttattccattttatgtaaaattctggagaaaggaggatcaacagataa

SEQ ID NO: 5950 - DNA, 631 bp, Glycine max
  misc_feature (549)..(551): n is a, c, g, or t
  misc_feature (573)..(573): n is a, c, g, or t
  misc_feature (575)..(582): n is a, c, g, or t
  misc_feature (607)..(608): n is a, c, g, or t
  misc_feature (610)..(610): n is a, c, g, or t
  misc_feature (620)..(620): n is a, c, g, or t
  misc_feature (622)..(622): n is a, c, g, or t
gacagaattgctgaagcattacttccacaaaattccagcgggaaaagaatggctaaaaacaatatgaatcctaggttcactgtctttgactattggggtttcttttgtttgttgcggttttcctcagtaattgtttgaaactctttctcactagctgcaattaggcgtttgacaatgtcatatgtagtaagcctgatgctgtatagagataaccaagggctgaatcaggtatctaatcataatcaacttcaaattaaaatacaatgtcatatatttatcatagctttgtatgcttaacgacatggaggcagtagcaatatcaaataaacacactaattttaatggaatttatgctccggcaaacgtactaaatgttacaactcacaataatgaaaataagaacaaaattgtaatttcactaggcacagtgcaaagattgaaatcttaataaccagaaatagaagatcacaagtacctgctgtttggtaagtttttcaaagcattgggcacaaatccccgatacaagccaataactccatcccgtgccannntacctgcatcaataaaataatntnnnnnnnnagtattacataactactgaaacaannangcttaaacantnacatcattt

SEQ ID NO: 5951 - DNA, 615 bp, Glycine max
atgttgtagcagcctgcactagacaattgtacagatcaattgataataagtatgatgtctagtaaaacaaaggtatattttgtcaagaaagaaaatttatatacaaaggtatattttcaattgtttctttcttcttattttgttttcccttgttggtaatgtgaaataaataaattatttggttatgttcctggtctgaggttcccaagaagaaaaatttgaagaaaatataaaccttccaaaagttcaaaacattcttaagtttgagagtagctatcttccgtttgagactttgagtaaagcaatgtttgaagaaaattatccgagaactcgtaaataccgagaattttcttctaactaaagaataaataaaattaaataaaatagcgaactaccttgtgaaacaaggctagcctcctgagagaaccctggggaattccgtatgctaaatatgcctgtcaacaggagatcaattaagttatgtatgctttaaaattggtaacacaaaattattgttggtcatatgaatattacatgcatcacaagagcattgtgcacattgatccagaatgcaatttgtgcatcgctatccatttgactgacattcaccctttc

SEQ ID NO: 5952 - DNA, 338 bp, Glycine max
atacaagtgttttcactttaaaaagaattccaaagggtaagtaagagtatatcagaagagaaacagtcaataaaaagtagaatacatcctgtaagaatataaaatttcgcagcagatagaagcaacataacttcttctgataaatatgtacaggttttgatgctaaaagcatcgctgtcttgatatgtctgtaaaggccgttggtttttagaattgctcacagacaaagcatgcaaaaaatatctaattcaccaatttgttgctcctggattcttaagcacaattcctcattgcatgtgactttttttttggtggattaccatgtatgctcaacactc

SEQ ID NO: 5953 - DNA, 335 bp, Glycine max
  misc_feature (323)..(327): n is a, c, g, or t
cccacggtggtgctgcatttccgaggtgccgacgtgtcattgccggcgacgaattacttgattccggtggataacagtgggagcttctgcttcgcgtttgcgggaactatgagcggtttgtccataattggtaacatccaacaacaagggttccgggtctccttcgaccttgcgggttctcgggtcgggtttgcccctagaggttgcgtttgagacttgggaaatgggaacaactctttccctgttgttttctaattatgattatcaattattgttgccatcttttttttttttttagggttaaaaaaaagggaaaaataaannnnngaaggggg

SEQ ID NO: 5954 - DNA, 727 bp, Glycine max
  misc_feature (676)..(677): n is a, c, g, or t
cttgtctatgagcggcgtgagactatggaagatggcaccttggttagtactaaatatgctatcaggcataaattaagcacagcttggattgctttaattcatcaaaacttaggtcctgcataagcacttattgaaaaaataaatgcattgagttcttccagctaaaatcaacttatgcactataagttgattttagtttacgggaaaaacccatttatttttatatatcttgttattttattttatttacctataagtatttattgagaaaattatctaaacaagctgttgtgtctttcaaatcattgaacaaaatgttaatcgggtgttataggtggtagcagttgcttcactgccaaaggaaatagctgcagggttacatccgaagcaaagtaatgcaatcagaggactgttgctacagtcagggtgggtggtagagaagcttgaagatgattcatgtgtggtcacttatgttgttcaggtacatagaataaaaatgttcacgtttcttctccacaaacaaaagaaggtgatcttcaatgctttcttcctcatggctttgttttctttcagttggatcctgcaggatggctgcccaagtgctttgtcaatcgatttaacacaaaactggttatgatcattgaaaaccttaaaaaattagcccaagcatgtcctnntgaaggtgaaatttgattactttgtaaagtttgagagaaagcgatcgagt

SEQ ID NO: 5955 - DNA, 690 bp, Glycine max
atagatctgaaaactcaactaagttatttcaagaaagtcagcaagatattgagtcaggaactaggagatgcggaaaccacaactctgctggccaaggcagtgtacttgattaacattggaagcaatgattatttagtctctctgacagaaaattcgagtgtctttactgctgagaaatatgtcgacatggtagttggtaaccttacaactgtgatcaaggtatatatttagaagttacttgtttgggtaaacttatccaaaatcacttccggaagaaaataagaaaaaatacatgaatttctttataaattaaaattaatttatacataagttaatttataaaagttttctcatacaacttttttaaaagatgagaaagtatttataaattaaccaatacataagtcaatttgaatttatgaaaaaactcatttcatttttttcccttcttatataatttattctcttacaagtgtttctgaataaacttactcaaacatgctctaaacttctacatttaagcatcatagttcaacttgctataaatcgtataccattctaattgatatatgtaatctgaaacattaattacattaggggattcacaagacaggagggaggaaatttggggttcttaaccagtcagctttgggttgtattccattggtcaaggcactattaaatggatct

SEQ ID NO: 5956 - DNA, 347 bp, Glycine max
tttgccttaagaagatcgtgtaacaaatattttgaagttaagaaggtcgtgtaatattttgaagttgctattaaattgctgaggtttagtggttccttccagttacttgctgcttgctacggttttgtaattgtgcagtgagtgtttttacaccacgccttgcatgtatttgttctttctaccaattttcatattatgtaagtagtaagaaacccaactcgtggggaaaattagtttcaatcctgtgccatgtcaattttgttggtgggcaacttgctacaaagtatttatccatttatgcccttttcccgttggaatatattgagtgtgtttggaatagctgcaaa

SEQ ID NO: 5957 - DNA, 375 bp, Glycine max
ggcggtggtggcaacggcggtgctcaacttctaagtgaaagtaacttaggcatgcttgcagcccttaatgcctacaggcagattccggcgaacggcgtctcggagcctccgggcagtgccgggcaacatcacggcggagacgatggacgtgattccaccagtcaacattcctgagggtcaaaataatcacaagtgtatgatctgatgctagcttcttaatttttcttttaattactatattattcctagtgctattattactactattagctctactactaattagtgatttgcataatatatattaaatacgtaattatatatgttatgtccatttgcaaaaatatgcaagaagcgcaagtttgattgctttgg

SEQ ID NO: 5958 - DNA, 661 bp, Glycine max
gaagtcatcagagaacaatggcaacaaatcaaagtccagttcaaaaggggtaagaaaacatcttgttacatctgcacatccttgtatttttctgggtttttttaaaatcatttttaatatcataattgtactatttattgctcatgctcttgtcactattgaaggtccatatatttggtctgagtagaagtgggaaatgtcttattatcataatatgctaaatagggttgacatgctgtttacttgttaatttatttccttcatgaaatgtcatttttacataattgtctgctctatggaacaaaataaaaatagcgaggatctgaacccccaaagtattcaaagcaagtgaaggatgaggaggagggattggacgaagaagacgatgacgagcatggggagaccttgtgtggagcatgtggggagaactatgcatctgatgagttctggatttgttgcgacatatgtgagaagtggtttcatggcaagtgtgtgaagatcactcctgcccgggctgagcacatcaaacactacaagtgcccctcatgcagcaataagagaccaaggccttgatatcatagggatgtggggttagttatcacggccctgtaaatcatgctggactgctaactagttagtggcttaggcattctggtattgt

SEQ ID NO: 5959 - DNA, 761 bp, Glycine max
attctcctaacctttcctcaaaggcacacattaaaaacaaggcctatatatagaaatgaaaatatcctatcatgaatgacatgttagagatcaaatgttgactaggcatatgatgaaaataatatatacaagtggaaggctacttacctcattagctattttagaattcattaggtttgaatctgatttaatttcaaaagttaacttacaagatgaaagttaactctatttataagaattattattttgattatatcaccggttaaattatctgacctcaagttattttagaattttaatttgagtttgatgaatttaattctaaaagttaatttatagagtaagagttgtcattatttatattgcattattttgatcatataagtagttaacacaacatctttatacttatgatagctaacatgatattgaatattttttatatatttaatgttccaattaaaatgaaacaggatgtgaaaatagagaaggtaggggcaggaacttttatggtgagggtcacgtgcgagaaaggaggtgacaatctggtgtctattttagaggcatttgatgagatgcgtctgaatgttcaacaagcgagagtttcatgtgaaaatggtttttctctggaagccattgctgtggctgagaaccaaacgctggatgtaagagacattactgaagcgcttctaaaagctattggaaagcagagcggtgaaaaggactcgcagaagtttgacaaatgctgtgatttgtaactt

SEQ ID NO: 5960 - DNA, 376 bp, Glycine max
atgggatctagagtctattcacagcttggaggttttggatatcataaggaaacatgtcagtactgtgacaggtttgagatcaaatcctagtgtaagggagagttgggaaacaactcctattcgacaagtctggcttgcccaagtctatgttgcctccatattatatggttactttttgaagtcagtttcattgaggtacaacctagagcgaagtctgtctttgtctgaccatgattttcatcatggtcataagattagcccttcatttcatgacatgtatcattccggggcaaaagatgtgatgtttggcaacaagagtgacatacaatctgtatggcatggcttaattgggcaggaagaggaaatcgaggattta

SEQ ID NO: 5961 - DNA, 947 bp, Glycine max
  misc_feature (397)..(397): n is a, c, g, or t
  misc_feature (434)..(434): n is a, c, g, or t
ctcttatgagcgttacctccgtagtgcggtattagctattttttggttcttattggcatgttggatttgtaggcaactaggatgtatttacttgtgtgtgtttaggatacgatagagatatggttgtgtgaatttttaatgcttaaactgacggataacaaaaacataaaaattttgtttcagctccaaatttctcatggggagatttagagggatttggggggaattaaattttttttttcttcttaaatgatgagggatatgttattgtgtcctactattatgtaaggaacacaaaattgtgaactatcttgggctagtatcctatccactatccagttacagaaagcatgtgatggaagaatttatttcactgggttgcacatcttattcaatntggttttatcacaagatacatctggtgtgtcaaatanacctgtgtgtttaaggataaaaaatttacatttttcagcaagtttcatcatatggttcgggacagtctactagaaccattggtgggcgaattcccaatcgtgctattgatgattcacatgttgccaatattgggggagtcgacaggggaacaaatgcaaaagacaaaatgtcgggattaagtagtggaagggctgaccattctcttccaccagatgctaccagtacactgtttgtggagggtttgccttccaactgtacaagacgggaagtagctcgtatcctttcatctgtcctctggttccccttagtttaatgcttttcatcggtatttaactcttttaaagtgaggagatgtacgttgatttgaaataaagcattttgtaaacatagcccactttaaaacaaaagtagataggctctcactttacacacctcaccttagaggagtcaaatccttttcattttagctacctcctccttaacttggagatacagatattttcgtcctttgt

SEQ ID NO: 5962 - DNA, 355 bp, Glycine max
tggttggagaattgcctgagtctttgggaagaatgaagaggttggagcagctgaatgtggcgcataacatgttgtctggtgagattcctgagagtgtttgcatgttgccgaggttggagaatttcacgtactcttataactacttctgcagtgagtctccagtatgtctcaagttgaaggagaaggatgataccaagaattgtattccttataggccgttgcaaaagtcacctgatgagtgtaaggctttttatgcacatcctgttcattgtagtgcctttggttgtgcatcgccgccgccaccaccagcatcttaccaccactatcaaccaccagcatcttaccaccactatca

SEQ ID NO: 5963 - DNA, 396 bp, Glycine max
atataacaacaggaagaaaccaatacaaggttcaccgagttccgctatgcttccaaaggttcatggatcacattattgagccaaaaaaagaaaataaacacttggcttaggttcggacttaggaagtgtcccagggcctaggttcggggagggcaacgaccataccttcgaggtcgtggtcgaggagaacttggcatccgagcctggagtgtttgttgaggacccttgctcgggaattgcgaacgaggacgtactcctcgtcgtaggagcgagggggtagcttgtcgagccactcctgcgcgatgttgacctcgcagtgggccgcgcaggcgtcgatctcctccaggcggtgggactccgggtcgaccaggcccgtgtttatcagcgccttcagca

SEQ ID NO: 5964 - DNA, 345 bp, Glycine max
  misc_feature (48)..(49): n is a, c, g, or t
  misc_feature (237)..(237): n is a, c, g, or t
catgtgcttttggcttcattgaaaatatgcagtatgctgttactgttnntttcctccacacggtgagaatttgcatttttctgcttaatgtccaaacctgtaagtgatttataatctcacatcaccggtctatctttacaggtgttctctgcatttggtactgtccagaaaattgctatatttgaaaagaacggtcaaactcaggcactgattcagtaccctggtattaatcatatncaactgttagttcttgaactagtagactgtgccccctttttatatatatttctaaaatgtatacttcttgatggttccatattaattctattatacatttcattcttt

SEQ ID NO: 5965 - DNA, 362 bp, Glycine max
agtatggagtgttgcacatatcagaaatgctatctgggtcccctaagaatgtgtagatcatcgttcatcaggtatttaggggtacattgtgtcatggcgtggttttgttttggtacattgttaatagattgaaaagtgtaccaattttatcacaagtagtaaagattaaaatgaaagtccaagtgtcgaatccacatggactttggttgtacttaagtgatacaaatccaattattaagcaatgagaaaaagtagaagaaaagataaaaaaattggaagtgtgaaatttagagtaaggcaaagaaaaagataacatgaaaaataaagaataatttaatgcaaaaaaatgaaatctatcagaa

SEQ ID NO: 5966 - DNA, 1111 bp, Glycine max
atgtatgctctggctcttccaagtcttcctcaattgcaaacacaccaggggctacattggcacaatttttgcagcctgtagaaggatttgcagcaccgctatataacatgctttgtaatttctcaatgcaaaactttctagatgtataattggtgtccacaatgaagcatcacttaagacacaaaagagtaaagcatatattatgttaagtacttaacacacagaaatttagatgtcagtgtttgtctatattccatgattttactgaatcctgatagattgaaaaaggtttattctattctcaaatttttttctgtttatctcagtgcatcacatcactaattttatcacacatttttatctcttctcttcctactcctaattgcagaaaacatgagtacaagtagaatttcttgttgaaaaattgtttttatctcagaataattaaggtaacaatgaatgactgagcaaagtaagtacctatgcagctgaattcatcaacaaaggcatgatcccttgggcttgaatcatccaagaaaggattgattgaagttaaagagtagccatgaatttcatcataaatcatgcgttggacgggatcgctgagcacctgcactgcaatagtcaatttccaataatagcacaggacaaaacttcaacaacatttaccccaaagcttaaactctaagaaatttaaaatagaaccaaccgtgtagacttcattgatgaacatgcagaaatttgtggtctcaggatcatttccactcaaatccgggtggcaagatttcatgcaattgtagtatgccttcttgatctgctctggtgtcgcatctggaagctgataaatcagaccaaccaaatattaattattatacatgctatataatatatattacatatatgcatgtattagtatatatctcattatcatacataagatttagcaaaattcacccgactttactaaagggtaaaaaaaactatacttccctttatcaaaaatatcagatcatagctaatgattacaataagctcaagcctcttagttttttttccttctcaaaaagacttcttaaagtaaaggggaaggaagtgatagtttgatgcatca

SEQ ID NO: 5967 - DNA, 391 bp, Glycine max
catgaattgtgtggtaagattccacggggtggtaggttgcaaaaaattgatgtttcttcctattctcataacaagtgcttgtgcggatctccgcttccaaagtgcaagcacttatagagctcaacactacatagttcacttgcccttacgagaaagggtataagaataagagaaattcttacgagaaattctttgtcctcttaagcttaatgttaagctactttgctatcaatttaacgcgtcacgtaattgtgtatgtgacactatgtaattgtatcgcacttttattttatcataaattaatcttgaaagttttttttatacataatacttgtatatcttaaaagttgtagacgttttctttcatttgaaagagacgaaagaatcccac

SEQ ID NO: 5968 - DNA, 858 bp, Glycine max
caaagagcattacaagaagactatggagcaaaggttcaaagaaatggtgaccagcaaaggtcttgagtcagttcagtcagaaatcaatgacttggactgggaaagcacctttttcctgcgccatcttccactctccaacgtttcagacaacgcagatcttgatcaagattacaggtcacacttaattacattaatagacacgtttggattaaaatttacaaatatgtaaaaacaacccttttttcttttatttcaaactggacttcaatgtaaaattgagttataactttgattacaatcagacctaactaaaaataaaataaaaggattttttagtctcccaacatatatatatatatatatatatatatgtatgtatatatatatggctatttaattagtttactctctagctataacttcaatttaagtttctccaaaaaactcggtttgatgataacttggtttctctcaaaagttagtttttcttttcaaactcagttcgcaaaataggaaatctttcaaatttatgtttgcaaactttaacccaattcatgcactaattagttaaatcatatcttgcgcatattttaagtttaatttcttggtacaaaaaaagctgtatctcacggggacacatgtatacgtcctttgtgttttgttcttttttctttcaggaagacaatgaagaaatttgctctggaactggagaaacttgcagagcagcttctagacttgctatgcgagaatctgggcctggagaaagggtacctgaagaaggtgttctacggatccaagggtccaaattttgggacaaaagtgagcaactaccctccttgtcccacccctgatctgatc

SEQ ID NO: 5969 - DNA, 400 bp, Glycine max
ggtagggtaagagttgtgtcgtgtccacgagacactgggagaaagaaagtgtgtgtgagttgttgtaaactgaattttcatttttctttagccatgagcacacttgttcgcaacaccaccctcaccttcagccgcagaaacagatacgagcttcttggtttgcagggcaaagacaagatggtcaagtccatcagctacagacgcagaagggcaaagcaaaggcaaatctttctcacaacctacaagttatcttctttgaatagtaacacttttggggagccgacacaaaagcctaagctgaagctgaagaaggttgctgttaaggttaagaagattgtggcctcggttttgatgttcatgcgagttggttcttttaggtcatgcagttctaggtctcaga

SEQ ID NO: 5970 - DNA, 737 bp, Glycine max
ctacttttggtgactcagccgtggatgtagggaataatgactatcttcccacccttttcaaggctgattaccctccttatgggagggactttgctaaccaccaacctactgggaggttttgcaatggcaaattagctactgattttactggtaagataaagttaattaaaccatcaaattatatagaacttgtacctacttagattagatatgaatatatatgtattttttgttgtataacggtagtaaggagattttaacctaagaccttagaataattactcaaactccccccactagaccgaccctggtggatttatagagtagtagtatatgttgcactgctcacatatatattcttatgcttttaagtttcatttttgttggaatgtttccttttgcagctgacactttgggttttaagacctatgctccagcatatcttagcccacaggcatcagggaaaaacctccttattggagcaaactttgcttctgctgcatctggttatgatgaaaatgctgctactttgaatgtaagtttggaatgaataacctcacgtatggttttacaagagttctgattttaacaatttcttttattccttttgttggcagcatgcgattccgttgtcccaacagttaagttatttcaaggaataccaaggcaagctggccaaggtagctggcagcaaaaaagcagcctcaattatcaaggatgcactgtatgtgctcagt

SEQ ID NO: 5971 - DNA, 1282 bp, Glycine max
  misc_feature (45)..(45): n is a, c, g, or t
ctgcccatccgtccgacttcaatttattcatcggttcaaactggngtaaattaagtcctctttgttaaatatgtttatttagtttccacaagcttggctgcattgtgcagagtttataacatcctgatttttcaagttcttgtctgtcgtcttgtcttgagccttgcatgttggtttcagggaaaattaattatgttcatttgaaagcagtagtataagatatggtctgaaagtttgaaccctagatgaaattgcttgcattatttctttgtttgataaagtttaataaaactattctcatagcttatttgtcagtcagtgcactttatggaaatgagagcaaaaaggattgtgtttgatttccccaacctgaaattcccacaccactgaatgtggttcacaaccaccattccgtgatattttgcctttttatctctcttaattggaggcaatgaaatctttatgaaagacagaaatattgttacataatgtggggaaggtttttgtggtttgtgatgctcatccttggcctatggacttggttctattcatgaaatatgcttgaaatattaggatgaagtaaacttcaatgcaccagtcagacatttaggcctgtcttctgctttgtgaacaaggatagaaaattaagataattaccaataattcggcaggtgcatctctcagactttttaatctggaaaatgataaatccactcaaggttgaatgtgaggatgagtgcacattttaactgttctagttaagagctggaaattcccttctgccattcatattcttggttgaaatgttgtgaagtcataagctattaacttgacaaatagttttgattgatatcttgtacattaaattcagtacaagaatctgccttcaagatgggaacataataatactatgtttccgtttgaggcaaaaaaatttcttctattactgttccttggctgcatgttcgtctatagtatattaactacttttcattctatcaggacccacgagaggcagcttcggttgtttgatatcagattgaggaatacagaacttcatgcttttggatggaagcaagaaagcagtgattctcaatcagctctgataaatcaggcttggtctcctgatggactttatataacatctgggtctgctgatcctgtgattcacatatttgatataaggtatactgctcacaagccttcccaatctataagagtgcatcagaaacgagtcttcagagccatgtggcttcagtctattcctcttgttatttccata

SEQ ID NO: 5972 - DNA, 657 bp, Glycine max
  misc_feature (629)..(630): n is a, c, g, or t
tgagaaatataatgcattcttcatataggctaaaaaattctacgagtctgcactaagactggaacctggttaccttggagctgcactagctttggctgagctccatgttatcgagggccgaaatggagatgctgtgtctctgcttgagcgatatcttaaagactgggctgatgattctcttcatgtaaaacttgcacaagtttttgcagccactaacatgctgcaggaggctttgtcacattatcaggctgcattaaggttgatctctatccttattgttgaggatatccatgtgatgtatgtctgtgttcatgattttactatgcctctaacattttgcataaatggcaggttaaacccccagaatgaagcagcaaaacggggtttagagcgattagagaagcaaatgaaggtttactcttttgatttttttatatttaatatatatttccctaaataatttgatgcttgagtatatatctgtctactaatcacacacattactcaccattcctgctggattatgttttctcaaatagatgcatggtatagtccaaaattataatctgattgatgagggtcatattagaggatatagccttgaaaagttgagtgaagttaaaataagnnattctgcatcctttgtagggagtggat

SEQ ID NO: 5973 - DNA, 439 bp, Glycine max
catcagggaaattatatctgaagttgacacagataatgtaagcctatttttcttttggcttgctacaattttggattctagttccatccatagttgacactcaattttgtggtttctcaggatggtagaatcaactatgaagaattttgtacaatgatgaggagtggaacccaacaacaaggcaagctattctgatgtctctagattgagtgtcctgcagccaagacggggtgcttgcttcagagaaaggcttccaagagttaatatttatcttaggcatgtaaagcttgtagtttcgatttgttttgagttacatgctccgcgtgacttgttgtcaactcttatttctctttttggtttccttttcactttgaagtttattattgagtccaaatgtaatttattaggcacactaataataaatggacttgcctaggga

SEQ ID NO: 5974 - DNA, 349 bp, Glycine max
cagggattgttctcttgagctagactgtaatgccagcaagcattctgatggtgaaacttctgttaccaatgctcagatggatggttcccctgaaaataacactgatgtgacaagcatgagacgaattgattttgaagtacgatatgcttctgaactcgcaagcattcatgaagactgtagtaccagtggatcacagcaacatgaagatgcaagtgttttgcagcgaagcagattgcctgggaatggagaaaggagcaagcgcaagcggtggagaggacgatatgatgacaatagttacatgcccaatgcttctttggaagagaacagcaagcaagagcatagcattggt

SEQ ID NO: 5975 - DNA, 604 bp, Glycine max
  misc_feature (565)..(587): n is a, c, g, or t
  misc_feature (590)..(591): n is a, c, g, or t
tatgcatgaagttgccgttagtttttaaagttaataattaattgtgacaatcatatatatacttggctagctgttttcttaactgtaatttcctaacttggaacgtcagattcatgatttcatcctagcttccttataatttattcaccttaattatgtacggtgcagggcgaaaattactacaacaaggttatggcgggccagttcccgactatggccatcgagatccagttcccgtccgcccaacaggtcgttatcgccggccagatccatttcccgcctatggccatcgagatccagttcccgtccgcccaatacattatggaccaccatgaaaccaataccatcgatccaacggggtgataatggtgtgatttcataggtgtggtaaaaactactagtacttaataaaaatgcatgcgtgtcactactagagtaataatatatatgtcaattgtcatgtattactgttattaattagtcacaaccacttagtggccagacctgtattaattgcagccaataaaattcccattatcgcttgtccctttaatttcttcagaannnnnnnnnnnnnnnnnnnnnnnccnncctccacttcccc

SEQ ID NO: 5976 - DNA, 413 bp, Glycine max
ctgggccccgggaaattctacggcaccagccttccccgccctcgcatctacaccgacgtcaagttcaacgaccaccgcgtcgacccacccgttcccgtcaacgacccactcatgtcatgggccgaagaggcccactggtccatgggcggcctcagtttcaagcgcctccgcctccagggcaaaatcgaaggcaacgtcgaaaggctccgctcccagcgcgagaagatccagacccgaagcccaagcccaccggcccgctccgatcttcgcagatccaaaagagctgcctcccctctgactccaccggctccggtcatgacaaagcgtcgaaggtacatggatctgatccaagaggaagaaaaggaagaggaacaagagattgtggttcggaggagccgtttagtgaagaagct

SEQ ID NO: 5977 - DNA, 410 bp, Glycine max
agcagcggttgcaggaaaagccgtgtcagcgagcgtcgcattcacggcgatggcggagacggtgagacttcgcgtggtgttcgaggatcgtggcatgttgagcaagtcaaagaagaagcaagggctcaagcgttgctggtttctgcttaaaccccaacacaccaccatttccgatgttgcctctcatctactcaacactttccgcctccaccgcacctgtccccatggcatcgtcctatcggtgtgtatgcttatgcatgttattcgattactcttttccatcatcaattttaaaaaatcacgattcaaattcgcatatcttgattttatgattcgattggtttattgagctgctgagtatattgctttgacgattgaaattttggataactgtgttgactctgtttttt

SEQ ID NO: 5978 - DNA, 339 bp, Glycine max
tcttttctttttcctcaaaaagttgaaaaagaataaagggggagcaatcgagtgaagttgttgctcttcaatagtaaacttacctatggaagagggaagggttgtgagtgagtacacaaaagatggaactgtggatcttaaagggaaacccattctcaaatccaaaagtggtggttggaaagcatgctcctttgttgttggtatctctctctctcactataaattttatatggtcattttcatcttgttttggacattaatttcaaaagcaatttcccaaaacattggaagcttcatgatgttttgctaacaaaaatcttaatttcctctgatcgagag

SEQ ID NO: 5979 - DNA, 409 bp, Glycine max
ttttctctcctagtctcatgtcttgtatcttgggagtgaaaggaagtaaaattaactctcatgcaaaaagttctgatatcaacatactgttttcatatggatcttggaatccaactcaaactgagaatgacgctaatttgccaatttgaacaataaactattcaaagtattatagaaattggtatttgattgtaattacgctacaccaatcttatgtttaagctttcaaggggtccatatacttacagcatgttcaaatgagcataaaggtttttcttggaatgccaagagaacaggtaggtcgttcaaaacctacaagtaacatctaaagataaatgtgaaactaattattgtattacagattataactgaagtagcttaaagatggcctacatttaacaagcttgca

SEQ ID NO: 5980 - DNA, 519 bp, Glycine max
  misc_feature (503)..(503): n is a, c, g, or t
  misc_feature (505)..(511): n is a, c, g, or t
catcttgcgtgatcgcaagcttcctggtcctgcgtggaagcgccacaacgtgcgctacagagaaattccagggaaactttgctccctcactattaaaattcaggaacttaaacagaggttggcttctggtgaaactggaaatgttgattactatgctttgattggtgtccgacgaggttgttcccggtcggagttggagagggcacacttgttgctttccttgaggcataagcctgataaggcaactgggttcatcgaaaggtgcgagcttgcagatgagcgtgatgttgagtctgttaaagaaagggtgaaaatgtcttcgttgttgttatatagattggttcagaagggttacactaatgtgatgggtaatattatggatgaggaagctgctgaaccaatctatataacaacaacgaagacattttcaccctttctttaacagactcaacatcacgctcatctgcaagctcgcacctttcgatgaacccagttgccttttnannnnnnngcctaaag

SEQ ID NO: 5981 - DNA, 402 bp, Glycine max
  misc_feature (30)..(30): n is a, c, g, or t
  misc_feature (114)..(114): n is a, c, g, or t
  misc_feature (338)..(338): n is a, c, g, or t
taaagtgcatcaccgacaactgccatctgnccttggagccacacgcattcctcgacggtccacccgggccctgcattgtctaaaacttgcactgttgacatatccttgtgcagnacatgcacctttccaccaatcactacccccgaacaggctgaattatgagtgcgatgaagatcaggcattggaatccaaacatccttgtcaggatcatacatttctgattgagatattgattttctgcagctagtgaagcccccagccacaacaatttttccattcaaaacgcagcatgcaaacatagaacggggaacaagcattgatgcacgagaggcccactnccgggctacagggtcatatgaccaaacttcatctgttgcaaaacaaccatcttggtcaccagta

SEQ ID NO: 5982 - DNA, 918 bp, Glycine max
  misc_feature (14)..(14): n is a, c, g, or t
  misc_feature (907)..(912): n is a, c, g, or t
gactataatccacnagaaaggatatcaaccaaagcgaacttatataacaatacaagtcactacaatgatgtgaccaaaagccaagctatttaaagatcacaattcccctcccaccactctgaactttcactagcatcagcctcttccttatgcagcattattacaaaatccaactgcgacaatgtgacgcacaccactacttcccacaataaaaattataaaagcaaaaagtaaaagtggttgcttacctgcttccggttcttcccatcattaaacgtgatcaagacattacatgcaggcttgaaagctccaagaaggtaattctatttaagaaaaaaaaaattggttccccaaagaggtaaataagcatagagggtcaccaacatcaccaaatcaagtgaatcgacgttagaacaacaaaacaacactcaccatgctgtttacaattcaatcttcttctttctacctcagtgcacacaccagcacctgtgaaacacaaatctagcatcacaatccccaaattaacagcattcacacaaaaacaacattcctgatttcacagatcttcacccccaaaaaaaatcaaaatgactcaacgacctattgggtccaagatcacactcaaaacccctttttcataaattatcaaaccctatagttatccccctcccaaaccctaaaaaccgaaatccatacaaaattcaagtggtaccgtgtgcgcgattccgcgtatcaacaaaaggaaataatcaaggaattgcgatgatctgcgacgtcgtttgatgtgatgaggaaccgatcagcgaaacgcataatttgaagtgaatcttgcaactcagtaagccctaacagtaacacggtagaggtagaagaagtagcagagtcgcatcttcttattcttctgcannnnnnaagcta

SEQ ID NO: 5983 - DNA, 1128 bp, Glycine max
  misc_feature (94)..(94): n is a, c, g, or t
  misc_feature (739)..(739): n is a, c, g, or t
  misc_feature (742)..(742): n is a, c, g, or t
  misc_feature (753)..(753): n is a, c, g, or t
  misc_feature (1092)..(1097): n is a, c, g, or t
  misc_feature (1100)..(1123): n is a, c, g, or t
gacttgcattttgtcaaggttgaattttgtagatcaattatttccctttaacgggtgtaggaggccttttatttcaacacctattggtccagtnttttataaaattgttctacttcagttataaatgttacattgaatatgctatttagagaattgggattagcttgttttgtgttcagaaaaaacttaatcaaaatgctgaagatacagctttttggctaaaatgcaattgtgaattaagcataaccaaacatgtgatcttagcctcaagaaaaaaaaattgatattgctttgaagtgatagataacatgatcatatttgataatgcaggctgacttcatgaaaatgccattaccagacaacagttttgatgcattgtatgcgattgaagccacttgccatgcaccagatgctgtatgtgccagtattttatactctaattggtttcacattcttctttccccctgcaataactttctatctacccattcacccataaattgtaaagtattatgaagcaacttcaatgtggcctgcataatagcatgaagtacatgtgttaattgtgattctataaaatggtgtctataatttgtattgtctgacacttatttttcctgccatggaattatggatagtatggatgctataaagagatttttagagtgttaaagcctggtcaatgttttgctggttatgaatggtgcatgaccgattcttttgatccccaaaacccagngcnccaaaaaatcnaggtatgatacagtggcgtagattgaatttagttggaggtttatttattaattttgttgaaacctctttctttgtaattcaatagataaaattccttgttacaggcagaaattgagattggtgatgggctacctgacattcgattgactgctaagtgtcttgaagctttgaagccagcaggttttgaggtgaacatcaatttcttattagtcttacctttcactagtattggtttttgtaaattcaaaagttgaacctacctaattggctaaggggggattctttcctttttctatgtaaaggtaatatgggagaaagatctagcagtggactctcctnnnnnnagnnnnnnnnnnnnnnnnnnnnnnnnaaaaa

SEQ ID NO: 5984 - DNA, 890 bp, Glycine max
ctcttactggatgctgttagagtttatcttggtagtaacacattgaactctttctcatgtgcttctacaatcattctagctaaacatagatatatactttaaatgaactacaataacaacaactgtaatgtctaattgtattttttgttattcaggttataaaaggacatgtgtagctggcttccttcaatttttgactttgtatgggactagtattgcttatgtactaaccacagcaaccagtctgaggtactttccttatgagaatacccttagagagtctggcttattgattttccttatgaactatgattattcattctactatacagtgcaattctgagatcaaattgctatcacaagaaagggcatgaggctccttgcaaatatgggggcaatctgtatatggcactgtttggacttgttcagattgtaatgtcattcataccggatctccataacatggcatgggtttcagttgttgccgcacttatgtcctttacatactcattcattggactaggacttggcatagcaacagtcataagtaaggctaatcttcaatcatattttcttattttaatcaaaagagatttttaatttcacaagacttctcaactccgacaaggacaaaacttaggaggtacagtttcttaagagctattggtgctgttttctaattaaatgcgtaatcctttaatgtatatctttattatatggattactgaggtgaaacttcaattcagattgaataacgataccaaaaacatttaaggaactgtatgtaagttttgtccttttgagaattaaagcaacaccgtgaagaaagaaaaatccacatcatgctactacaacattggtccttaggactttggttgcatttgcagaaa

SEQ ID NO: 5985 - DNA, 404 bp, Glycine max
actctttcactttcttaaactccatatctctagctcagttggttgagattggtgagttattaaaaagaaaaaaaccctctcttctcacacttagttcttccttaaacaagaacactttccatggattctaagagctccaaactccacgggctgagcggctccatagctcaacgcgttttcttccgcgcgttattcctcgcctccgctgtttccctcgttgccctgattcgcttcctccccgccgtcgatttggaatctttgactcccaagaccaacgttgactgcgtcatcgacgactcagattcgctctccgaaaacaccaccttaaccgccggctcctacttgttccagagccgcatcctcaacaccttctggggctccttcgactccatgaactgcaaaaa

SEQ ID NO: 5986 - DNA, 805 bp, Glycine max
tgctcatgattctcaaattgcttgcttcactctgacattggatgggctccttcttgcaactgctagtgtaaagggcactttgattagaatcttcaatacaatggatgggtctcgtttacaagaagtacgttactacaaagtggattttatcatttaactattaatttattatgtctaacttcctgctttgtatttttcttttttgggaattttaattttcatgtctgcatagtatagtacggattgactaaaaaattactttcttcttttgtaacgccattttattgaaaggtttccatattcctcttatgattgatgaaagtaggaaaacaaaacaaactatcttactctagaattaaacatcttgtatattaggtacattcattattgtgaaccatttattgttttgtttgcacactccatacgataataatgttttagcatgttttgtagttactcttatttgtgttgcttataaaaagaagcttttacgcctttatagtcttcggttgtgcacaaaaattccaaaagttcttttttcataggaattggtttgattttctcaatcaaaattccttctttattttcatgttctatgatccatttactcttgcttgtaggtaagaagaggggtagatagagctgaaatcaacagtatagctttgtctccaaatgtccagtggttagcagcatcaagtgacaaaggcactgttcatgtattcagcttgagagtgagagtgtttggggaggatagtgtgactcagccaaatgctgttcaagggcctgcactgttcatcagaatctc

SEQ ID NO: 5987 - DNA, 560 bp, Glycine max
  misc_feature (548)..(550): n is a, c, g, or t
tctctctctcgtagttcaattcaattcaattcaatatgatgcagagactctcttctaccactactactactactactcgctctgccttgctgcgctacggtggcggcgcacttcgccgggacgtgcttgctcccatttcctcttctcacttagcagctaaggtgctcatttctttctctctggctttacaaattactcttcatatcataatccctactattcattcgccgctaccaatccatttccttttcagttagataacattaattaattatgtagtgtaacttactgatgttctggaattacaatcgcagtcacaggtgggtgaaagtgacaccaaagcagctagatggttttctattatgagctctgatagatccacatttgattcctcaaacttgaaaagggatttgttctttggcaaacgatatgaatcaactgctgcagaatcttcttcctcagcagccgccgagagatatgagtaccaagctgaggtattatatttcatgtctagtctagtgtcatgagcatagcttaactttcgatannnatatatgcat

SEQ ID NO: 5988 - DNA, 471 bp, Glycine max
ttcaatggcttttgtattgtataattgggagactgtgagggaaaaaaaaaataggtgtctcagagaattcaatagaaagctggatttggtttacccctttggtttaccccccccatattgtttcttctccccagtactcaagtctccatatacaggttcttcaataagtctttttttgttgttgatttttttagttttgatctgtggtttgcaagtttttcttgggttataattgtgtgttgttttgatggtgttaacttgcaggtggaattgcatggccagatggcttggctgctttggtctggccttaaaaaactattgtttaattcagaggtgtgttgattattttgttcttctctaggtcagggtggagtgctgatcggtttgttttgtgaatttgaagatatagtttcataatcatatttgttaaatttcatattggatatggtatttagtacttttatgtcatct

SEQ ID NO: 5989 - DNA, 1259 bp, Glycine max
  misc_feature (17)..(19): n is a, c, g, or t
  misc_feature (53)..(54): n is a, c, g, or t
  misc_feature (286)..(286): n is a, c, g, or t
  misc_feature (288)..(290): n is a, c, g, or t
  misc_feature (301)..(302): n is a, c, g, or t
  misc_feature (305)..(306): n is a, c, g, or t
  misc_feature (315)..(320): n is a, c, g, or t
  misc_feature (323)..(323): n is a, c, g, or t
  misc_feature (337)..(339): n is a, c, g, or t
  misc_feature (347)..(351): n is a, c, g, or t
  misc_feature (354)..(354): n is a, c, g, or t
  misc_feature (356)..(358): n is a, c, g, or t
  misc_feature (360)..(362): n is a, c, g, or t
  misc_feature (377)..(383): n is a, c, g, or t
  misc_feature (385)..(387): n is a, c, g, or t
  misc_feature (389)..(389): n is a, c, g, or t
  misc_feature (399)..(402): n is a, c, g, or t
  misc_feature (406)..(414): n is a, c, g, or t
  misc_feature (420)..(423): n is a, c, g, or t
  misc_feature (425)..(432): n is a, c, g, or t
  misc_feature (434)..(461): n is a, c, g, or t
  misc_feature (464)..(472): n is a, c, g, or t
  misc_feature (477)..(477): n is a, c, g, or t
  misc_feature (479)..(495): n is a, c, g, or t
  misc_feature (497)..(506): n is a, c, g, or t
  misc_feature (509)..(510): n is a, c, g, or t
  misc_feature (512)..(514): n is a, c, g, or t
  misc_feature (516)..(523): n is a, c, g, or t
  misc_feature (525)..(525): n is a, c, g, or t
  misc_feature (528)..(538): n is a, c, g, or t
  misc_feature (541)..(547): n is a, c, g, or t
  misc_feature (550)..(572): n is a, c, g, or t
  misc_feature (574)..(584): n is a, c, g, or t
  misc_feature (586)..(587): n is a, c, g, or t
  misc_feature (589)..(595): n is a, c, g, or t
  misc_feature (605)..(610): n is a, c, g, or t
  misc_feature (612)..(612): n is a, c, g, or t
  misc_feature (615)..(621): n is a, c, g, or t
  misc_feature (623)..(625): n is a, c, g, or t
  misc_feature (630)..(646): n is a, c, g, or t
  misc_feature (648)..(651): n is a, c, g, or t
  misc_feature (655)..(655): n is a, c, g, or t
  misc_feature (658)..(658): n is a, c, g, or t
  misc_feature (660)..(667): n is a, c, g, or t
  misc_feature (669)..(670): n is a, c, g, or t
  misc_feature (673)..(680): n is a, c, g, or t
  misc_feature (682)..(683): n is a, c, g, or t
  misc_feature (685)..(692): n is a, c, g, or t
  misc_feature (694)..(700): n is a, c, g, or t
  misc_feature (703)..(711): n is a, c, g, or t
  misc_feature (716)..(723): n is a, c, g, or t
  misc_feature (727)..(732): n is a, c, g, or t
  misc_feature (734)..(734): n is a, c, g, or t
  misc_feature (740)..(745): n is a, c, g, or t
  misc_feature (758)..(762): n is a, c, g, or t
  misc_feature (764)..(775): n is a, c, g, or t
  misc_feature (781)..(789): n is a, c, g, or t
  misc_feature (795)..(799): n is a, c, g, or t
  misc_feature (801)..(801): n is a, c, g, or t
  misc_feature (804)..(807): n is a, c, g, or t
  misc_feature (809)..(812): n is a, c, g, or t
  misc_feature (814)..(823): n is a, c, g, or t
  misc_feature (831)..(836): n is a, c, g, or t
  misc_feature (839)..(846): n is a, c, g, or t
  misc_feature (848)..(850): n is a, c, g, or t
  misc_feature (857)..(862): n is a, c, g, or t
  misc_feature (864)..(866): n is a, c, g, or t
  misc_feature (869)..(884): n is a, c, g, or t
  misc_feature (886)..(888): n is a, c, g, or t
  misc_feature (897)..(902): n is a, c, g, or t
  misc_feature (908)..(911): n is a, c, g, or t
  misc_feature (915)..(916): n is a, c, g, or t
  misc_feature (919)..(922): n is a, c, g, or t
  misc_feature (925)..(931): n is a, c, g, or t
  misc_feature (935)..(937): n is a, c, g, or t
  misc_feature (939)..(950): n is a, c, g, or t
  misc_feature (958)..(959): n is a, c, g, or t
  misc_feature (963)..(963): n is a, c, g, or t
  misc_feature (971)..(978): n is a, c, g, or t
  misc_feature (984)..(984): n is a, c, g, or t
  misc_feature (988)..(993): n is a, c, g, or t
  misc_feature (997)..(1009): n is a, c, g, or t
  misc_feature (1012)..(1017): n is a, c, g, or t
  misc_feature (1020)..(1023): n is a, c, g, or t
  misc_feature (1026)..(1026): n is a, c, g, or t
  misc_feature (1030)..(1031): n is a, c, g, or t
  misc_feature (1043)..(1059): n is a, c, g, or t
  misc_feature (1063)..(1063): n is a, c, g, or t
  misc_feature (1065)..(1073): n is a, c, g, or t
  misc_feature (1080)..(1082): n is a, c, g, or t
  misc_feature (1084)..(1085): n is a, c, g, or t
  misc_feature (1087)..(1091): n is a, c, g, or t
  misc_feature (1096)..(1098): n is a, c, g, or t
  misc_feature (1105)..(1109): n is a, c, g, or t
  misc_feature (1113)..(1118): n is a, c, g, or t
  misc_feature (1122)..(1132): n is a, c, g, or t
  misc_feature (1135)..(1137): n is a, c, g, or t
  misc_feature (1145)..(1153): n is a, c, g, or t
  misc_feature (1156)..(1159): n is a, c, g, or t
  misc_feature (1162)..(1164): n is a, c, g, or t
  misc_feature (1171)..(1173): n is a, c, g, or t
  misc_feature (1178)..(1182): n is a, c, g, or t
  misc_feature (1188)..(1191): n is a, c, g, or t
  misc_feature (1195)..(1203): n is a, c, g, or t
  misc_feature (1208)..(1211): n is a, c, g, or t
  misc_feature (1213)..(1214): n is a, c, g, or t
  misc_feature (1217)..(1217): n is a, c, g, or t
  misc_feature (1220)..(1225): n is a, c, g, or t
  misc_feature (1232)..(1233): n is a, c, g, or t
  misc_feature (1235)..(1255): n is a, c, g, or t
acattaaattaaaccannngtgaagaagtaactaaaccaaactgcgaaacgcnnaacatttgaagcaaattaaaaaagaagaaatcatcgttgttgtggacattgtgtttgtttcctaagaagaatggaaactatgtgtttaaaatctgggatagttcccacgatctctattagtgggtcgctggacgcacgtgccaatccttcccaggtgagcacggtggggcgctccgcagcggataaaccgccgcagagataaaaaacgggtctgacgccgaccgaattgggnannntgggtcctctnngtnngctgagtgnnnnnnagncaaacttgtggggnnntgagaaannnnngantnnngnnnagagagtttggaaannnnnnncnnngntgcggggttnnnntctnnnnnnnnnggatannnncnnnnnnnngnnnnnnnnnnnnnnnnnnnnnnnnnnnnacnnnnnnnnntattngnnnnnnnnnnnnnnnnnannnnnnnnnngtnnannntnnnnnnnnanctnnnnnnnnnnnttnnnnnnnttnnnnnnnnnnnnnnnnnnnnnnncnnnnnnnnnnntnntnnnnnnncccttgcctnnnnnnanccnnnnnnncnnnctttnnnnnnnnnnnnnnnnntnnnntttntcnannnnnnnngnntcnnnnnnnntnncnnnnnnnntnnnnnnnttnnnnnnnnnataannnnnnnntttnnnnnncncttttnnnnnnttttattctttcnnnnnannnnnnnnnnnnttttannnnnnnnnttctannnnntnccnnnntnnnntnnnnnnnnnntttcgctnnnnnnctnnnnnnnncnnntccccgnnnnnncnnnttnnnnnnnnnnnnnnnncnnntttttttcnnnnnnatcatnnnntttnnttnnnnacnnnnnnnattnnntnnnnnnnnnnnntatgtccnnttcnctattgcnnnnnnnntttttnatannnnnncatnnnnnnnnnnnnnatnnnnnnacnnnnatnaatnntttttttctcannnnnnnnnnnnnnnnntctntnnnnnnnnnttttatnnntnntnnnnntttcnnnattaatnnnnntaannnnnnttcnnnnnnnnnnntcnnnattcttannnnnnnnnttnnnntcnnncataatnnnttaannnnncttttnnnnatcnnnnnnnnntcttnnnncnnccngtnnnnnncttcccnntnnnnnnnnnnnnnnnnnnnnnccct

SEQ ID NO: 5990 - DNA, 657 bp, Glycine max
gatttggtgacaagctctggcttgaaaccaggaagttatggctcattgtggggccctctatattcagccgcctcgcgtcgttcaccatgaatgttgtcacccaagccttcgccggtcacttgggtgatgtcgaactcgctgccatttctatcgccaacaacgttcttgttggcttcaatttcggcctccttgtaagtctctttcttttccctcactaacaaaaactccatctcatgctaattcatggttagaattggtttagtttaaatatataattgcgataaataataaaagagaaaatgtttgtctcttataacaacatatttttatgagcgttaaggaatatattttctgatactctcttaaaatttatcaaaaaatacaacttgaagaaaggctaatcgacatttttattattaaaaataaataatttgtaattcttgaatgcaaaaagaaaagtaatcttgtgtggtaatagttggggatggcgagcgcgttggagacactgtgcgggcaagcgtttggggcgaagagataccacttgttggggatatacatgcagaggtcatggattgttctgttcatgtgctgtttcctgctgttgccgttttatgtttttgcaacgccgcttctgaaattcctaggacagccagatga

SEQ ID NO: 5991 - DNA, 1163 bp, Glycine max
gagatgaaaatatagttctccattggacctcgtatctacaatactctgtacgatagtaaaccatcaatcgtctcaacaaccaatcggttcatgcgcactagaagcagcaaatatgatcttgttttaggacctgaataaagagacagcatcaataagtatttggtgatacatgaagcattgttggtctggtaaaaaaatattaggtgttcttatgaaatgttataaaataatattggctttggtggagtgatcttgttatgggaaaaattactattttgcaatggattcgaataagaaaaaggataagaactacctaattcaaatgaaggaatttcatcttggtggaagtagctgcatccattggtcttcttgcttaggcttgaattaatcttatcaacagccacgactagatcctatgaggtcgagttggacaaagaaccccaaaaaaatgtcaagcaggttaccaaatttcttacacgcaagtgattgtcaagtgaaattatctttgactttcacattttgaagcttaaccaagggcaataataccataagttcggtaaataactgaatatcttgtaaaaataaataaatctacaagccatatatgctttagaaatgaaaactatattatacagtaaaataaaccagcagcttgttcttctcagaaaagcaccaattcatttcacttataataataaaagtgtcacgttattttacttaatttttgtttttaaatatttatcaaaaatcatgaaaacaataaaaatgtcattatttcttgtacagatctattgaaataaaaaaaaaaattaaaaaaaggccccatttttttatttttccctttccagtaaaaacaaaaggcattttcttcccttgccaaaaacccttttaattaccctccccccggggaaaaattacccttccgggaaaataccatccaaattttgaatccccaaaaaacccccccccccccaaatgttagtcccttcaattgggccggaaacccttcaaattcccttttcaaattttttaaaagggggcggggggctccaccggcctttttattttctttttctttttttaaatttccttttggcaaaaaaaaaaaatttgaattaaaaatctccatgtgctcaaggttaagctgaaacaggcaatatcaa

SEQ ID NO: 5992 - DNA, 805 bp, Glycine max
ctctgctcttctccagtctttcagtttgcagaaatgtgctgggaaatgatatctccgggcagcattgtgctcccagtgaatctagcatactacagcagctagaagaagtggttgtcatgcccaactaccatagattatttcctggtggtgctaggaaactatttaatatatttggaagctcctactgtgatgaggcagctaaaaggcttgcatgctgggtaaattctatctttcatgccttctttagatccttccttttcctttagtaatgtattttatttagtaatgctcagctttgaaatttttcttttcaaagtgattattttaattttccctttactacttatttcacacattttgatgcattgcgtgcgactttccatctgataaaactagcacataccaatttagttggttttgatatgatatattgacaatggctattccgttagtcacaaggtaaacctgttttctgactaaccaagatgctgatcctaacatgtgcattttgaggatggttgaaacataaactataattcttttctaaatcgtataatgtttggtgatcctgtttctagaactttgagcattagttggtaatgtttcttatttggctgaagatcttggtacttcatttccagatctcaatccaaaagtgtgagaaggatggagacaacaggctacgagtatgtcattccgcttgtcaggcttataacctagcatgtggagcttcactggactgtggtgaccaaacccttttcagcagcgaggggggggatgagggtctgtgcactggctctggtga

SEQ ID NO: 5993 - DNA, 407 bp, Glycine max
tgaagagtactcattctcacgagggtctaatggtaactggaattcaaatccacagtgaaaaccagaatgaagatgggagtgaaatactaaatagcactgctgccagaggtgctgaaagctggccagaatctgagattgcaaggcttcaacagttgagagctgagatggagacaaggtatatgcaaagtgggttttcagaagaggttatgtgggaggaaatagctaccaaaatggcttgttttggttacgaaaggagtgctttggtattcaaagagaaatgggaaagtataagcagcaactatgcaaggagtgccaaggatggaagcaagaagcgcaaggaagactcaagaagttgtttttacttcgataacagtgaccaatcttctctgtataaccaaggaggtgcc

SEQ ID NO: 5994 - DNA, 415 bp, Glycine max
aataaaaaagctttttttttatcagtggagaaataaataagaccaaacagaatcaaaacaaagacaaattccgaattagcatatctctattatttcaacttaggcagtaaacttgatagtaatccagcatatagcgtatgatatttttattttaaaattttgaaaggaaagaagcaaagacatatgatcactgtattgttgtagcgtatgatatttctattttaaaatttagaaaagaaagaagcaaagacatatgatcactgtattgttgtaagttgaacgtagtgaaattattatgcagcataactggtagaaagcatataatggcaatattaagagagaaggcttttaatgctttactcacttggttggactcccagccttttgcacaccgtgtgatcctttcattaccggt

SEQ ID NO: 5995 - DNA, 975 bp, Glycine max
  misc_feature (60)..(61): n is a, c, g, or t
  misc_feature (926)..(926): n is a, c, g, or t
  misc_feature (928)..(928): n is a, c, g, or t
  misc_feature (930)..(930): n is a, c, g, or t
  misc_feature (965)..(969): n is a, c, g, or t
tatagttagttgctttacctagaaataacctatccttattgtttttatatgtataaaaanntatattttcatgattacaaaattgttaatagatttcatggttgaaactgtcggatttgttgcctctgaaaatcaacaaatgatgtatacaactgaatagtgatcctacaaggagataatttaacatagaaaaatgatactaacatactttttgacacgctctatacaacacactttctattattatgtgagatttatgtaggttcaactaaaagagagtgagcttagattcttcagtgacacccatataatttatcttgttaatagagaatgtgttaaaagactgtgttgttagtatttctcttaaacttaatgatgatctaaaacacatcacatggaaagctttttttaaggtgttttgaatttaaggactaatcagagagatgcttctgcattaagcattcaagtggaaatgtgccactgctatgctcttcaatacattctcccaagtcctaaactccaagcaaaactatggttgtgactgtcttattgtgtatgtgttgtcttatgtgcatgtatgcagtcatgtgccgcagagtgtgcatttctctgtgatctgatctcaagttttcctccatacaattgcagacccatgttcaggcaaaatacctggagccaacagaattgggattggaatttgtgaagtccatgagtgagcaagatttctatgtttaccctgaggcagatatgttgcttgcaaggaaaactaacaaaccattttcctcattctcggaatggggaaaaggttgggctgatcctgagatccggcgtgagcgcttagaaagaatgcgagtcaatagaaagccagggatgctgccaagtcccaagaagcaacgtaagagaaaagctagaaaaggttgggctgnangnggacttctcgtggtagactggcagcaaaactctcnnnnnacaagc

SEQ ID NO: 5996 - DNA, 320 bp, Glycine max
ggttgagtcagaaccagaaccatcaactcctccaagaaaatctagcagaatttcagtaccaccagataggtattccccttcattgcattatttgttgttaactgatgctggtgagccagaatgtttcagtgaggctacacaggggaatgacactattgagtgggagctagcgatgaaagatgagatgacatcccttcagaagaataagacgtggtctttaactaaattgccagaaggaaagaaagcgttacagaataggtgggtctataggctaaaggaagaatctgacggtagaagaagatacaaggcgagacttgtgg

SEQ ID NO: 5997 - DNA, 1126 bp, Glycine max
  misc_feature (1114)..(1123): n is a, c, g, or t
tgtttcttttgttgcaatgaggtattgacttttattttggtgtaatcctccaacatattttggcattcctagttttactaattttgtgggaatatctttcaattaccactcaggattggtgtcaattggaagaggctgtgcaatctggccctattcctggatttgggaaaaagctcagttcacttcttgatatttgtttttcagagtgagtatagttcaatttatatgacatctgtatttgtactttgtagtggctcagttatagaataccacattaccttatactatgttataaactttttgtgactcttatctttttacaatatttagtttcagtactgttgagtagagcagcaggattccctcatccccgtgctgtttttaatttctttttcttccttttttgatttgaaagttttagttaactaggtgccatgacttgactccatgagtgaacttgtaggtttagagaaaattacttaacctggtagttacgtgtgttacacagtaataccatctaatgttttctggtttctattccattaccatatcattattttgtatattaaggactagttttatagctgtgatgttatgtgtaatcttcaagtaaaatgtagcttgaatttgaatcttagaagtttgttgtcttaatgttgcatgctgttggctgttacatcatggaagaatgagttgatgtggagtgaagttatattgagctattgcattttcttttaaaggtatgatgctgaagccacctattttgacgaaggtgtgagatcttccaaacaaaagcaactacaagaaaaattgttccaagtaatccttctcaactgggctcaaccgttttccttcttataaaatgaattgataactattgaaattttttattaattgatgagttttgaatcaatatgactattttagatactggatattggccttacttctttctctttagtagcatttatagaattgtgaggtttgtagtggtgctaacaccttttcaattggttagcttgtccaaccagcattccaatctgcgctgggacatataagatctggaactttggataaattcaaggaggcattgacaagacttgaaaggagggannnnnnnnnngtt

SEQ ID NO: 5998 - DNA, 818 bp, Glycine max
catttccactaattttcactttatcatttttgtttttgttttttgtgacctagaattgggatccaaggtggtgtggggaaattggcatatgagagctcaaaatacccacccaattgcaaaccctgacctaaaaggccaaggaatgtactatgtggagaaattattacatgatcccagtctattatgcttccagataatctccacatgacacgagttttattaactcattttggttacatgtcatgtggggattaactgagattataggtacatggtggttctagaacatatgataatttctcataccatgaggtaaagctcaccagtcattagttttcacctttatgtcctaatcaattggttttctaaatatattctaaccataatgccatatatcttttggtaggtttcaaactgaaatgactaacaaagatatcattgttggtaatgccttcaatgcaggtaataagatcaaacacttgaagcatagaattgatgcaatagaccaagagaaattgacatacagctatgcagtgattgagggggatgctgcactggaaaaagtggattcaattgcacatgagattaagtttgaggccaccaaagagggaggttgcaagatcaagaatgtcagcaagtatcatcccaaagcaggggttgatgtcaaagtggaggatttcaaggctgcaagggaggaaggtttggccctcctcaaggtagtggatgcctatcttgtggccaaccctgaggcgtatgcttgaagcattgaagtgatcttatagggcacctttgcattacattatattttgatgttctct

SEQ ID NO: 5999 - DNA, 386 bp, Glycine max
atattgatgtatcgcagcgaaaccaccaacagccagaacacatggcagaggatacaacaaatggtgctgccaatggtagttctctaaaatcaaaccaactttgtagtcctcctgcttctagtgcaagttctgttatgaggcagttttcagctcccccttcatctgggccttcaaatgttcgataagtacagtcacctaagataatgccaggttatccggatcactgaagaacaatgaaatctaaatggttggggaaataccggttccttgtgccaacacctaacctagcacggataaaattacttcgcctcttttaagtatactattgtgtatatatatgtatgcattatgtcatttgatttgtttctgatgtgtgaactttgctg

SEQ ID NO: 6000 - DNA, 345 bp, Glycine max
accaattcgatgcattctgatcaaatgatcaaatgatggggtcaaacctggttttcaattgcacggtatgattatattacgagaatgggtcatattgtttctgtgcataattatccttatccttattaagtcaaaatactgatgctaaaggatgaacctgccacaagaagcaacgtagccacgaatacaattagtggtgtccataagaagcagtttgatgcaaattgcaagctaagctgatagtagtatgttgaattactcttagtttacgtccttgggttggaaagtactgaattattgtgattaaacttcagttgcggactagggggtccacctgtattaact

SEQ ID NO: 6001 - DNA, 410 bp, Glycine max
gaaaatgtaaatggaagaacaacagaggtgacatcgaatgtttcgacagcaaggacaagcgaaaaactattcatgttctcaaatcttttatttactctgcaacaggttagatcaaactccttcacacaacttcacttagtctttttgcctcttttttcttttttaataaagtctcctactgttgttattgtaggttcgattcttttggggttcgcggttattgtcgtttttaagatcatataccattttagacagaaacaagaggaccaagcaagggtggagaagttcttagaggaatacagggcagaaaagcctgcaagatttacttatgctgatgtgaaaagaatcactggtggttttaaagagaagctaggggaaggagctcatggggctgtattcagaggaaaaaa

SEQ ID NO: 6002 - DNA, 1199 bp, Glycine max
  misc_feature (857)..(859): n is a, c, g, or t
  misc_feature (862)..(862): n is a, c, g, or t
  misc_feature (864)..(866): n is a, c, g, or t
  misc_feature (869)..(908): n is a, c, g, or t
  misc_feature (912)..(918): n is a, c, g, or t
  misc_feature (921)..(929): n is a, c, g, or t
  misc_feature (931)..(944): n is a, c, g, or t
  misc_feature (947)..(964): n is a, c, g, or t
  misc_feature (968)..(998): n is a, c, g, or t
  misc_feature (1000)..(1002): n is a, c, g, or t
  misc_feature (1004)..(1005): n is a, c, g, or t
  misc_feature (1007)..(1009): n is a, c, g, or t
  misc_feature (1011)..(1017): n is a, c, g, or t
  misc_feature (1020)..(1032): n is a, c, g, or t
  misc_feature (1035)..(1036): n is a, c, g, or t
  misc_feature (1038)..(1058): n is a, c, g, or t
  misc_feature (1060)..(1080): n is a, c, g, or t
  misc_feature (1084)..(1089): n is a, c, g, or t
  misc_feature (1093)..(1096): n is a, c, g, or t
  misc_feature (1099)..(1101): n is a, c, g, or t
  misc_feature (1106)..(1107): n is a, c, g, or t
  misc_feature (1110)..(1116): n is a, c, g, or t
  misc_feature (1119)..(1123): n is a, c, g, or t
  misc_feature (1126)..(1127): n is a, c, g, or t
  misc_feature (1130)..(1146): n is a, c, g, or t
  misc_feature (1148)..(1180): n is a, c, g, or t
  misc_feature (1182)..(1182): n is a, c, g, or t
  misc_feature (1184)..(1184): n is a, c, g, or t
  misc_feature (1186)..(1194): n is a, c, g, or t
agcccgattcatccaaatttgcagtgcatcagcaaccctggcaatagtttcctctgagatctccagatcggggagaggaggaagaggtctgcatcattaaacaaatcaatttcgacttcaagtgaagaaagcacattcaacactactctaaaacacctctctaaactttagcagcactcggaacatattcttcaccgttaattcaaatttcatgagcataaatttttataacagtcaacagagcatatctatctacatgcaataatttatatttccttaaaacgcattaatgttcaattcagctatgaagagttcaaaactttgaatattagtaattaagtatacgaatctagcggagatataaatctaggaaatgaaacatgatctggaggaagtgaaggacctattgagaaggttagcagctttggcccagaaaaagagaataacaacaagaagcaacactacattggcgacgaaggacaagaaattgtaaccggctcgctcgaagaggtaccacaatgcggtggcagatacaagcaccgcaaccgctccgcgccaattcttccacagcaccacatcagcaactatcacacatcatcaaatcaaatgcaaaattaatcaactctgattttctttactatcagattacacaatcaaattctagctatcagtaaaggatccatggcggattgaacgaaatcagagagagagagagagaaagagaacttaagccttcgccgagaagacggtgaacggaaatatgtttagaatctcccatggtgattggggaagtttagtttagcggtgggtgcagcgtcagtaacaaactatagaattgatattactaacagtgcgannnacngnnnacnnnnnnnnnnnnnnnnnnnnnnnnnnnnnnnnnnnnnnnntccnnnnnnnccnnnnnnnnncnnnnnnnnnnnnnnaannnnnnnnnnnnnnnnnnctcnnnnnnnnnnnnnnnnnnnnnnnnnnnnnnnannntnnannncnnnnnnncannnnnnnnnnnnntcnntnnnnnnnnnnnnnnnnnnnnncnnnnnnnnnnnnnnnnnnnnnccannnnnncatnnnnacnnnttaannacnnnnnnntannnnncannacnnnnnnnnnnnnnnnnncnnnnnnnnnnnnnnnnnnnnnnnnnnnnnnnnntncntnnnnnnnnnccttt

SEQ ID NO: 6003 - DNA, 582 bp, Glycine max
ggtatgtttcaggcactaccgactccggcagttcaattgccttcccttcattactgaagtctgctccaaatccatcccattcaccagatgctcttttagcaaattgtgaccatgcttcaatactttcattccgcaccttgggaatagttctacttccatcctgcatggaatagccaaattggtatccaaagtactaaatattgcatgaattctaatttctaaacaagacaaagaaagcataaatttgtgtaatcatgggttatgaccattatccaaagggaaaactgttaaagcaacagcaccaacaagttacacagtaataatcttgttttttataagaaaaacatagagttagcacccatcttgatcgttaaaagatatatataggctacatctacatgcctacggcacataagtcctcaacttatatcacatgtgtgccttcaaatcaaaggttatataccattagtttcacccttcaaagatcaagctgggcaaaaatctgacattaaaaaaccaaattgatttcatgtatatcttcggtgaaccaattggaagaccattgtaatgacacatgtatct

SEQ ID NO: 6004 - DNA, 889 bp, Glycine max
  misc_feature (727)..(727): n is a, c, g, or t
  misc_feature (787)..(792): n is a, c, g, or t
  misc_feature (794)..(806): n is a, c, g, or t
  misc_feature (815)..(818): n is a, c, g, or t
  misc_feature (820)..(821): n is a, c, g, or t
  misc_feature (840)..(840): n is a, c, g, or t
  misc_feature (842)..(844): n is a, c, g, or t
  misc_feature (847)..(856): n is a, c, g, or t
  misc_feature (858)..(860): n is a, c, g, or t
  misc_feature (862)..(863): n is a, c, g, or t
  misc_feature (865)..(865): n is a, c, g, or t
  misc_feature (880)..(881): n is a, c, g, or t
  misc_feature (883)..(886): n is a, c, g, or t
tggattccttgtataaacttgagctatgatttgcaggaaaaatggatggctgaatgtttccaagtgtgtttaaggagctgttgatgttttgagactgaacaggccggataagcgcagaagaactaattgctctcatgttcaaggcagctggagaattcagcctactgaaaattccagtagatgcatatgatggtaatgtagcgtttgtaatccttccagacccagatgaggtgcaaaaatctccatatccatctattgaacctatacgtaggtaagaatcactaccacccaatgcagcaaccatgttagcttgctgggctgcctttttcagatagagtctatatttctgcaatacataatgacaacagaattaatatggcacagtaatgaaaaatatactttgccgcattaaatgaacaggaacaggtgcacaaccatcacctagcaaacacttaggttagaagtcttaaatgtcccattagtaacaagccctttttttaattttatctatccatattttatcgaaacatattattacaagaaaaagaaatatctaaaatacttatactatgtgctataaagttctcagagttattaattttcgctacaaactatcttttcctaatatttccatcacaaaaaatttaaggaatcatccaatctaaaagattttcattccttgatttgtcaaagactgcatagaacaattatgataactacaaaaccnaagattttatacctgtagatggcttgccacattttcccttgtaagcccttcaacattctnnnnnncnnnnnnnnnnnnnaaaaatttnnnngnncgggaaaaaccaaaaaatntnnnccnnnnnnnnnntnnnanntnttttccctttgaaanncnnnnaaa

SEQ ID NO: 6005 - DNA, 303 bp, Glycine max
gttgctttgttcttgcatagagagtagaaactaggaagatacatcactccagtatatatataaaaaaataataataataatcacaacaacaataaaaacaatagcaacttatttttgtttagtttaaggtaataataccaataatagtaacaataacaataaaataatggattggaatataatttgtatttgggggtgtgtgggtaataatgggtacaaaaaacaacaagtactagtctgtcatagaggcacagagatgaatatgatatgagaaaaaattggaagggaaagagaaaaaaaaaa

SEQ ID NO: 6006 - DNA, 721 bp, Glycine max
  misc_feature (704)..(715): n is a, c, g, or t
tcctaattacttgctgcatttctctactccttgtgcttgacacttttgtcatttaaaatggaacttaattttaagtaccaacttagccttttctgtgtcacactgctcttacctgccctgtgtacctctcaagactcttttacgtgctccagagcaacctattatggtagcccagattgttatggaaatccaagtacgtgagccttcttttctatctattattgcgcttgttcatatatggtgtgtgtactaagcacatttttaaattgtctgtacatatatggtggacaaattaaacttgcataagttcattgtatcctagctatcatattcattcaaatgatgacacactgatgtgcttttcaatgataaatagtagcttctgttaaataattgttacagaattttaaatgcctaaatagtctattcattgattgatagtgtaaagaaattgtatattatatttcgatcacaatcgtcttatttattcagtttattaacttttactataattatttttaaaaatatattattttaaaagtcatatttatcacaatttttattagttgaaaatgtaaaaaaaattgcacacgcatgatatgattggtcaattgataatgtttttagggggagcttgtggctttggagaataggaaaaacggtaaacgatggtagtgtcgcaggcgtgtcttggctatggagannnnnnnnnnnnaaaaaa

SEQ ID NO: 6007 - DNA, 806 bp, Glycine max
atggatccatatactctggaatatttcatgcaacaaacacagacaaagattttggtatgttttgttgcattttttttattgatttttgtcatattcaagactgttattttggacaattatttcttttaggaatattttgttatttcctatttctggtgatttttgggatttatcttattttaataagactttatttaggagttattgcttaattaggaatttgggatttgactagggtcgttctagatcactatcttaatagactcccgatcctgtttccataattgattttataggtcatagagcatttgacttcgtttgattcttatatcatcttattataggaatcattttgaaaatggcttgcttaacaaaggatggttctttacgaggacagaaatctggcacagaatttgtcagcaagcccctttcaaagattttaattatacctgccaaagaccttgtccaagttacagcacaggtttgctacttttcaactatatgcaatttgcgaagtactttggaattttgtagttacctaagctaaatatttgcaatcttgtgtgagttttgttttgtttggatgctgtatagtcagctatggttttggacaatttataattaggggaagtggcttttagcacattgccaacttgtttcctgatgatattgttgatgtgtcaatcatggcaggatgttgctattaccagggatggcttagctaatgagtatcaccatgatatgcatcaggaaatcatggttgattcattgatatctcagtctcgtcacgtgatctaggagagaat

SEQ ID NO: 6008 - DNA, 947 bp, Glycine max
tttctccctctttcttccaggattctcatggttggttgcggcaatgctggttggtactacaattccccttctctcccttcttttatttagggtttcttaatcattttctcttcactaaatggaagaatactgtcgtattttacagttatgtctgaggatatggtcaaagatggttacgaggacatcgtcaatattgatatttcttctgttgcaattgacatgatgagaacaaaatatgagtacatccctcagctaaaatgtatctaattcattcataagactcttttctttatttttataatctcttaccttttaactaaactcctcatctcatcaatctcaatagacatgcagatggatgtcagagatatgagcttgtttccagatgaatcttttgatggtgttattgataaaggtatcacttactctcttcaatacaaacttttctctaaattattggaatctagaatgcattatgcttcataattcatatactgatgctacttttgcccccatgctttgttgttgcttgatctaggaactctcgattcattgatggtacgttgcttcactgattgttctcataatttatcccatttttttttctctgcctgctctaatcctcaaatttgcttttattttatgtacttcagtgtggtactgatgctccaattagtgctgctcagatgcttgccgaagtttgtaggttgtatagactttaatgagaataaatttcttcagatttgaacagaagtttttaatagtcacacacttcatttcaattttctccctaattatgcctattttcttctttgcagactactaaaacctggagggacctatattttggtaatcttatgcattacatggataagactttctttgtatcagtgtgctaaatcagttttgcaagtttcgagagtataatgaattaataaattgtcact

SEQ ID NO: 6009 - DNA, 481 bp, Glycine max
tccttctcgctcgttctctgctttaatccatcaactatccttctaactcatatttcttcactgattcaagatacgatcaagtttccttatcatttgctcctaattacgtttaccctatacacacttttccagttattcaccaaaaccaacaaataacaaatttcaggttgttggagaaattgttctgttggggggatatgatgtcgatggagaaggaagcttcaagctccacacctacgcgcaaattgtcgtgcactgcatgcttcgacgctgtctatttctgctactgtaatacccattgccctaaaacctgaaaaacctttgtcttttttcaattgggtcatccaaatattgatgaagtttgtgccttttaatgtttgcagcgccggttcatcaaatgcagcagtattacaggcttggtaaatttgacaattgttccggcaaatggaaagcgatggttgattgcttaatgctcaagacc

SEQ ID NO: 6010 - DNA, 529 bp, Glycine max
  misc_feature (460)..(460): n is a, c, g, or t
  misc_feature (469)..(471): n is a, c, g, or t
cagctggtgtattcgtaagtacatgaaagcttgatcaccatcatagcaaattaaactattgaatgcttaacttcagtatatgtgtgtttgtttgccttatggaatatggcaaggcaatatgttcttctgttgcattggtttactagtttttcattgtaggcagatgatctattataatctagctagtcccatattcctactatttatatctttgcctttcatctcaaatttcagattggtaggcctgtggtgttctcattggctgctgatggtgagactggtgtgagaaaagtacttcaaatgcttcgtgatgaatttgaactaacaatggcactaagtggttgccgttcgctcaaggagataactcgtgaccatgttgtcacagagtgggatcacccaagattttctcccaagttataagatggcaggactccaccttgttcttctatattctaaaatngaaattttnnnataacctttgttcttatttcatgcttctgtggaaaactttgttgttaccgtgagtcag

SEQ ID NO: 6011 - DNA, 588 bp, Glycine max
gcaaagcaatgccaacaacaacaacaacaacaacaacaacaaaaacaacaacaacatcaatgtcatcaagaagcttcagagccgcgaaatttggtcgaagcctcatcgagcttttgcttctgtcactgcttctcacagattccgctctatgtgcttgacgcaccaatacgacactcatgatccctccaagactccctcttccctttggcccttcttgatgaagagaactaaggttgtcgaaattgtggctgcaaaaaacgtggtctttgctctttaccattctggtttgtgtgcagcttttagtagaggtgaggttgctctcaagaactatgattcttgattatttatataagctgtggctgcacaagccgccgatagcatcagttggttcttgctgcttgataggcataatatgtagcggggagctctatattgcaaatgcaggagattctcgagcagtattaggtagactggatgaggctatgaaagagattaaagctattcaactatccgtggagcacaatgctagccatgcatctgtcagagaagagttgcactcattgcatcctaatgatcctccgattgtgg

SEQ ID NO: 6012 - DNA, 353 bp, Glycine max
tagggagggccttcaaaagcttccgccgataatgtggttgcagcagttactctggctgctatttctgatgtgtatcatattggagtcccttcacaaaggccttcttccatggctattcagaggccaggacagagagcacatcagaagtggaaaggtccagataaaatcagtaggatatatggtgattggatcgaagacattgaatagagttataatctcccattcatggaaacgactgatgaggagggcttatgtaccatcaaaacgcaagaattttcattcacacgctattttattcggtaatttatcttaagatccttaacttccaacgggaatagcactttagatcgttt

SEQ ID NO: 6013 - DNA, 891 bp, Glycine max
tagcacagagaaagccagcatcataaacagcatcaagtaatggtgcagtccaatgattcgagctcttaatatctcaacaattggagaaggaagtttctcatttaacgccaagagcaaccattgccccgtatctggaagaggaggtgtattcctgtcagaaaaaaaaagtaaatgagttatcatttttttatatgtaaaataaaccaagacacactctggctgatcttttattgtgatttatgttaacagagaactactcaaaacctaatagccagtttttaatagtgattttcaaattgaaatgaccaatgccactgaacttgtgttaactggtttatacttactatttgctaccatatgatatatgaagagtgctggtaacacactctctgccacactccttctaacactttctatattattgttgaaattttattgaaaactataaaatcaccagtgagattcattctacacaaatttgtaatttccaacaagtttcagctaagtgtgctactagcatttctctagaagcatgtgaagcctttgaatctaaaacttaactaactatagatccgcattcagatcaaaacctacatttcaaacgagatccaattcacttcccgaaaccccatcaagatcaatacagaatcacgagataaaaaggaacaagaaaaccgagttggagtggaagacagttacaggtgccagtcgaggccgagcacagcggtgacggagcggacggagatcatttcgtagaggagggcggcgagcataaagaacatggaggcgatgaacggaatcgccgaccggaactccgcggaccagtgccggtaggaggggacgcggaccacggcagcgagggcgaggagggaccacagtgccggtgcagac

SEQ ID NO: 6014 - DNA, 407 bp, Glycine max
actttgagcaagcagaagaagggcttgagaggttggaagaagtgttcaacaagtacagtgaagggaaggcctatttcggaggagatagcattggattcattgacattggttttgggagcttcttgagttggatgagagtcatagaggagatgagtggaagaaaattgcttgatgaaaagaagcaccctggtttgacccaatgggctgaaacgtttgctgctgatcctgctgtgaagggcattcttccagagactgataagcttgttgagtttgccaagattcttcagctaaaatggactgctgcagcagctgcagctgcaaagtaaatggaatcaaattaattgcgagagtattttcaaaattgttgtccaagttgtttttatctcaggctatgttgttgcaacttt

SEQ ID NO: 6015 - DNA, 641 bp, Glycine max
  misc_feature (631)..(632): n is a, c, g, or t
ctgatgcttttctatgtccttgaattatcatccgatactggtcactgtttgttctaattgcttgtccttcttgcctcccaataagcagggatggtgagatgattcacatttctaagtatccttgttgcaatgaagacgaatgtgaatgcaaaataggaagtaaaaatacattcttagaaacacaatctggtatcacttccactttgacattgcaactttggcaaggattctatcatgatcgatatagagatattgttaaggtattgtgttacaacatccgaatggaattaacatacatattcaaatgttgagttcttgttcctaggatgatgtcgtttaatgtaatcttgtttgatttaaatttgtctgtctaatcctccaaaaccataatttaccctaaataatttcccacttacaggattcctttcctcacctaataattgctccaaatggtggcattgctgcttattccagttggttaccaagtattgtacgtctcctaccttgagcttatcctatatttagtttagttttttactgcctttaaaaaaactgaaaacagtaagacactttgatggcttgttttcttcaatttctttggttatcaaaatttcaggagttaattaaaaanntgtgatgtc

SEQ ID NO: 6016 - DNA, 363 bp, Glycine max
ttttcctcgggtaaaacattttttaattattaacctcgttttctaatataaaaacacttattagacatcccaaagcattggatgcattttttaatgtgtttctaaaacatgatggaccctccttatgcattttacttaggcattagatacatatctatctgcatcttgtttcaacatgaatgtatataaatataaatgagatttgtttctattatgtatttgcaatgaagattgtctgattttattgaccctccattgtcaacatatttctaacacatgcaaacacatatttatgtaatcagcttctttgctgattatatcacagcaattgggttttttggtcataccctatcacagcaataa

SEQ ID NO: 6017 - DNA, 360 bp, Glycine max
attggaactctttgagtggctttggatttccatctatggccatattccccatgccaacttccacagcctcctgctcagctttttccctctgcattttttcagatatttccccttcaatagcatcatgcttcacagcagtcaatgagggctcaagagtctggggacctgcactgaaccaaggatgctgaaggcattgagcagcagttggcctcttttcagggacaaaatcaagtaatggaagaaggaaatcggtcatgttatttgcttcttgttcactgaaatcatacttctctgtcagcaccttattaagaggccagaaacgcaaccgacggatgtgcctcaaatctccatatctgttga

SEQ ID NO: 6018 - DNA, 375 bp, Glycine max
ctatgatctattgaacactcccttttctttggattcttgaacaaactttcttcagattgggatgataggatgcatccatataaatatatacacatacatatatatagtgtatacattacaatacaatacaatgcaatttgagctctctctgctggcgctttcggatcggacgagggaacgaagattgaacgtacggttcaatgcaagggtgacgattttttttttaattttcattctgtagattcgtacagatttgaagtgaacacaaggcaacgcagattcaaacggggaggaaaagagattcgtgaattttgaagtgacaggtaattgtactgttgttattgtatcaactatcgaataactgtgcatagaaag

SEQ ID NO: 6019 - DNA, 348 bp, Glycine max
tgtatcttctttaagatctgttttccattttagatttctagatcaatgcttcatcaaaaaatccctctttacaaagcctatgaatcataacattatacagagtacagacagacacttagttgatagcctttaatcagtagatcctgaaaaatcatttttgcattctgaagtcttccacttcgcacaatccatccataagtatagtgcatgtgtacataggcggttttgaactccttggtctttagttttcttgaataatccaatagcctttggatgatcgtttttgcacaaagcatctaatatagaactgtaggttatcatattggcaagttgacctctatctgcctc

SEQ ID NO: 6020 - DNA, 640 bp, Glycine max
taggtgtggatccgatgttggaggcacctggaggaactccattagattggtctctgcaattcaagagacatcaaaaagagataattgaactgtggcaatcttgctgtgtaccattgacccacaggacctacttctttcttttgttcaggggtgatccatcagactccatttacatggaggtagaacttagaagattgtccttcctcaaagaatcattttctgatggaaacaagtctgtgagagatagtcagacaatcacactagcttcaaggttctctctttctgccacttacgctaacctttgatgctgaatatattttgagaaatagatcatgacttttgctattagcatgctatttatttagtatttacaaataaaatctaaccatcccttacaaaaaaactattgcaagttttgtttatttgattcacatggcttttccttgcaccatatcgtctatttcatgttgacatgtgtttggttgggggggatacagcgtgaaagcacttcggcgagaaagaggaatgcttgtgaagcttatgcagaggaggctttccgagaaggagagaagaaggctatacgaggagtgtggcattgcattggattcaaagcgcaggagggtacaactagcgaacagtt

SEQ ID NO: 6021 - DNA, 606 bp, Glycine max
agcctgacctacatgttggtgtggttggtctcggtggactaggtcacatggctgtcaagtttgccaaagcttttggagctaaggtcatagtaataagtacatcacctagtaaaaaggatgaagcaatacaacatcttggagctgattcctttctactaaaccgtgaccaagatcagatgcaggcaactatatatatgccaatgccatgcatttggaatattgtgaaaatatcaaaatacacacatttctctcaattaactaatgttgataatttcgtagggtacaatgggtgctttggatggtattattgacacagtttctgcggttcatcctctcttacctctcattggtttgctcaagtctcatggaaagattgtaatggtggatgcaccagagaggcctctagaactaccagtctttcctttacttgctggtaagcatgtgaaaaatatttccctttataggatgcagagcacatgaaagcatatgtgatgattcatatataagaatagtttagtgcaaaacttaagtagattgatgccaattaacttaggtactatttaacataattggcaaggagaaagatagttgctggcactctgattg

SEQ ID NO: 6022 - DNA, 469 bp, Glycine max
tgcctatacgaaattctggtatattgcacttggtgatgtgtgtatatggtgttgaatgttggattaaagcatgttattgtaattaaggaaacttatacaggatttttgctgatgttgaagagggacgaccagctcaagttccagcaaggaataaactgcctttgagcaatggtggcaagcatgttcgtgccagtcatgaggaacggaatgtaggttctgcagctggccatttgcctcctaaatcaggatccagttacaggaccagttcaaccagtaaacctagtatggcatcagcagattctaggaaacagcctggtaacaacagtggtaatggaccaggccggcctgttgggccaaaaggcttgccttcaaagatttctgttggtaccactgggaataagtcttcaacacctgctataaaaaacccagtgaatggtatgcagaaatcactcccttcgaagaatcatca

SEQ ID NO: 6023 - DNA, 343 bp, Glycine max
gcttcttcagcctgcaactacagctccagctgctccagtgcatgttccagctgggtggcaacccactcgccctgtgtcttcgaagcccactgccgaggaagatgaattggcagctttgcaggctgagatggcactttgagcaagtcccttttctcagctgcgacactattgatttatgctatctattcattaatctgttctagtttgttggtattgcaattaaggtggcagttgagtgaatttgtgtgtgcaccagtttcatgttaaatatcaacctttgcacagttgagttcacttgtataataatagtttggaatgaattccctaaagttgcttgtcaaaa

SEQ ID NO: 6024 - DNA, 327 bp, Glycine max
ttgtgtctgttgaaaaatcggaagttaataggaatattgttagaagttggtgggagcaaacaaaccagaaaggtaatctatatgatatggatgatgtaagggagctagacggtgatcgcttggaacagctgatgagcacatttggtggttttgatctaattgttggtggcagtccatgtaataacctggctggtagcaacagggtcagccgggatggactggagggaaaagaatcttctctcttctttgattattttaggattctagacttggtaaaaaatatgtcggccaaatatcgatgatttttgtcccaagaagcctctttct

SEQ ID NO: 6025 - DNA, 543 bp, Glycine max
acatccacatctctccttcggtatgcaactccaactgtgacaacaacaatacactctgccacagtgtagagttagcgtacttagctgatgaatgatgaaggtacccttctgtagttctctccaacgacaacagttggccaaaacaaaacaaaacaaaacaaaaataaatagtaaatgaaatttaactcaagacgcttaccacaaacgacaacttcttctatctcttttcaatccttccattttttcacacacactcctatctacattcaaacagcacactctctgtttcattcacaattcaaatctcaatcaccatgtctgaccaaggtattccctattcatctccatctgtaacatgttcattcttctttccttctggaatgcttccactcgtgttaaatttttttattttgatgattattatttatttttctgttgtggggttttttctttttttgcagaaggtggcaaagggtctcccaaatcttcgtctttgagtccctatgaagaagcaatggaggccttgtcgtctttgatcactag

SEQ ID NO: 6026 - DNA, 337 bp, Glycine max
tcctcatcgaggagatcaagtactccggcgtcgagcttcctgcactgcgccaatcgcaactcgaccgtctctcggagattctccgctccggcgtcgagctctcccacaaggtcctctcctccagccgctggaacgtctaccgcaacctccagctcgccaagaaaatggacaagctcgagaagaacgtctccaagttcctgttgggtcccatgcaggcacacatgttggccgacatacaccacacccggttcgagatgaccgagcggttcgaccgggtcgataactcggttcaaagattggagaagtattttgggaatatgaagataggtgttggcaa

SEQ ID NO: 6027 - DNA, 750 bp, Glycine max
  misc_feature (737)..(737): n is a, c, g, or t
tcttggagcgttgtgaaaatattggtaattgtttttcaagtcttatttttttttctccttaatattactattgtattttctcaatccttgagatcatattttgcatatttgttcttgcagatggattccttgctggtgtcatgagtaaaagtacgttaatatacaatatatatcttgtcctccttatgtttatgcatttacttccatttcttcttattttggggagtagggttctccggtttgtaaactgaattatcattatcttttaagaaatcattcagagataatgttgaattatgctgagtattttaaaggtttttttcttttcttcccatatattgatggtcaatttgatgttgcaaaaatgttgatttcagagtcgctgtctactgatgctcatttatcaagatcatcaaaattggaggacaaggacaaagagcacaagcgcgatatggatggagctaaagagaaggaaagatacagggagaaatacatgggaaaatcaattcaagaacttgaccttagtgactgtaaacgttgcactcccagctaccggcttctgcctgcagatgtatataacttctatttgatttcttttcttgttggctttgtcaataatgtattttgctcttgtgtaactctttcccctcattttttgcagtatccaattcctacagctagtcagagatctgagcttggtgctcaagtcttgaatgaccattgggtatctgtgactnctggaagtgagga

SEQ ID NO: 6028 - DNA, 477 bp, Glycine max
aagatgtgttagatgaagtaatcgtgagagatgaagataatgttgaggaggcagtgaagcgagggtacctaaacaccgattcggatttcctaaaggaggatcttcatggtggctcttgctgtgtgacagcattgattaggaatggtaacctcattgtgtccaacgctggtgattgccgcgctgtcattagcagagggggtgttgctgaggctctaacatctgatcacaggccttcaagggaagatgaaagggacagaattgagaacctggtaagcttctgagtgtgatagtacttaatcttttctctgtggttattgaaaccacatgaacctgtttgaatttggatttgttggttcttaagcattgaaatttgtcttgtagggtggctatgttgatttatgccgtggtgtttggaggatccagggatctcttgctgtgtctaggggaattggagatagacacctgaaacaatgggtg

SEQ ID NO: 6029 - DNA, 668 bp, Glycine max
  misc_feature (646)..(646): n is a, c, g, or t
  misc_feature (648)..(658): n is a, c, g, or t
cttccctgaacaaaataaaacaaaaaattagaaaagcctaaaaaggagctgcaaaaattatcaagagactaacatagaaaaatcaggatatatatgcaaaatcaatctaccttttgttatatgttatgaaaatggattgggtagataatattatataattgaaaaggcagaaaaaaagaaacctcgagatcggcctgaatctcctcacgctcgtggccggtagcaattggcacgacatcttcaaccctctttttgagggaagaagcacctgattgagataacaagaacgaaattgaattaagaaacgagcaattcaatatataggggaaatggagagaaggaaaacctgattgggcggtgaagtggcgggcgaggagagtctgggcggcgagtcggggacgagaaggagagagtgttgtgtgtagggctttgaggtttgaagaagagaagagtctccgccacatggttatgcttccgatctcagattctccttttcttctattctactaacccagactatgtatggatcgcaggcgcaacacatttgtcacgtgaggcatcccatcgcacgtgtcagtcagtcaaattaagtcactttcctctacccttcatttaacttttgttctgatttcatggttacgagcanannnnnnnnnnncccactcctc

SEQ ID NO: 6030 - DNA, 1086 bp, Glycine max
  misc_feature (1036)..(1041): n is a, c, g, or t
  misc_feature (1080)..(1082): n is a, c, g, or t
acttcactcgtgaccagatgtgaaattggtgacagtctcgtgagtagttttacttgcacagtagaaagttcttgccgtgtcaaaatagcaaacattttggtattttttggcttacatgcacgtgaaataaagtaatgttggtgttactgtttgtgtattgtaggaagaattcctcacaaaagcaacaccagataaggggttgatcaggttgttggtgtccatgggagaagcattgagaacaatttccttcaaagtgaagacggcttcatgtggtggaacacaatgtgttaatacttttggggatgagcagcttgcagtggatttgctagctaatcagcttctttttgaggttagaccagtgctattattgtcaataagtttcttcccaattaaacaataatttaaaatcctgattcttgtgcatcatatttctccacacttaatagtttaacgaattgaacccaattgatgcaatattgattggtccaacataggggacacaagtgtgtggcttttgcataagattttgaaatgaaaaatgacctgcatgaatcatttcccttcaatagtattttttattaagagaagtacttttgttgccaattgttatttgaccatgtttaaataaacttctccataaggaaggccggcttatgagagaagaaaaaaaataaataaacttctcctataagatgatttagaattgaataatagtgtaaaaaaatcgataaacttacatatgacgattttagaattgaataatagtgtacaaaaaaacctttacacagtcaatgcatgcaaaatatataccatcttaatattcaatgtgcaatgaaactgatgtttccaatgttctatgcataggccttaaattactctcatttctgcaagtatgcttgctctgaagaaaatcctgagctcttggacatgggaggtccagttgaaggtctgccataatatatttatagttatattaaactggcaattaaattgaatcttgtctcatacaaaaaatggcacttttttgcattttgtnnnnnncgcaaaaaaataaaaatacaggtggatttagtgttgcannngatc

SEQ ID NO: 6031 - DNA, 847 bp, Glycine max
  misc_feature (727)..(729): n is a, c, g, or t
  misc_feature (761)..(762): n is a, c, g, or t
  misc_feature (764)..(764): n is a, c, g, or t
  misc_feature (795)..(795): n is a, c, g, or t
  misc_feature (813)..(818): n is a, c, g, or t
  misc_feature (821)..(822): n is a, c, g, or t
  misc_feature (824)..(825): n is a, c, g, or t
  misc_feature (827)..(840): n is a, c, g, or t
ggaaggttttatccgtcccttatctagaggtaaatgaagactgctttataatatgatggtgatttgactgaatctatttgtactttagaaatgattagctatttttttcattcttacaaggcatgttcagtcacttaattgtttgttatacagtcttctttgcagaagttggcgggtcaaccctggattctcatcatggttttgttgtagaatatggtaaagatagagatgttgacttgggtatgacttctgctggatctgtatttgttttatcattccataggtcatgtgcataatatttagtaagtgaacctacatcatggtattattataactatggagctttgtggttaataataattcagacaacttattacttcttttgaattttcaaattcatactaagcttggatagagaccataaatgctttattattggtgacatattttgatggtgctgggttcatattatatgctggttaatacagctgcatttctgatgttaatatgtctgatattgtacaactaagagtcttgcatctgcaggtttccatgtggatgactcagaagtaaccttaaatgtttgtttgggtaagcaattttctggaggggaattgttttttcggggcatacgatgtgagaaacatgtaaatactggaactcattcagaggtaagtcatggtgattgaataataaagttagataggttttaggaagatttcgtgcnnntatatttttttcatcactgtaagtgtatgttnntntactgtaaatcagcaagaagcattgacaccnttctgtgcctcaagtagnnnnnngtnntnncnnnnnnnnnnnnnnacctttt

SEQ ID NO: 6032 - DNA, 356 bp, Glycine max
tgacctggcaccaatccaagcctctgcctcctgcgctctccctaacttcctccgccagcaacaagtgcagcctgtcgcggcaagcgtttgccaccaaggtccctccgtgcccgtcgtaaacagcgaagaaatcgtaactgccacagcgttgttccgccgccaccaaacctggaactaccttgaccgcgtcctccatcgcgcgtcgcctccctatcacggatatgaaaccgtgtgatgcggcgggcttggtgtagcagtcgtcgtcgcaaggacgctttctcttctttgggttgctggaatgcatctggcaactgtgtccgttattactgtttgaaaagctgcatgtgtgatcacgt

SEQ ID NO: 6033 - DNA, 1366 bp, Glycine max
  misc_feature (519)..(519): n is a, c, g, or t
  misc_feature (555)..(556): n is a, c, g, or t
  misc_feature (600)..(604): n is a, c, g, or t
  misc_feature (607)..(612): n is a, c, g, or t
  misc_feature (616)..(622): n is a, c, g, or t
  misc_feature (625)..(627): n is a, c, g, or t
  misc_feature (629)..(630): n is a, c, g, or t
  misc_feature (632)..(657): n is a, c, g, or t
  misc_feature (660)..(667): n is a, c, g, or t
  misc_feature (669)..(670): n is a, c, g, or t
  misc_feature (674)..(677): n is a, c, g, or t
  misc_feature (679)..(681): n is a, c, g, or t
  misc_feature (684)..(695): n is a, c, g, or t
  misc_feature (698)..(738): n is a, c, g, or t
  misc_feature (742)..(751): n is a, c, g, or t
  misc_feature (754)..(759): n is a, c, g, or t
  misc_feature (764)..(771): n is a, c, g, or t
  misc_feature (775)..(784): n is a, c, g, or t
  misc_feature (787)..(787): n is a, c, g, or t
  misc_feature (791)..(792): n is a, c, g, or t
  misc_feature (799)..(810): n is a, c, g, or t
  misc_feature (814)..(819): n is a, c, g, or t
  misc_feature (821)..(821): n is a, c, g, or t
  misc_feature (823)..(825): n is a, c, g, or t
  misc_feature (838)..(838): n is a, c, g, or t
  misc_feature (844)..(844): n is a, c, g, or t
  misc_feature (846)..(852): n is a, c, g, or t
  misc_feature (854)..(866): n is a, c, g, or t
  misc_feature (868)..(869): n is a, c, g, or t
  misc_feature (874)..(884): n is a, c, g, or t
  misc_feature (888)..(894): n is a, c, g, or t
  misc_feature (898)..(898): n is a, c, g, or t
  misc_feature (900)..(900): n is a, c, g, or t
  misc_feature (902)..(920): n is a, c, g, or t
  misc_feature (923)..(926): n is a, c, g, or t
  misc_feature (929)..(931): n is a, c, g, or t
  misc_feature (934)..(939): n is a, c, g, or t
  misc_feature (950)..(951): n is a, c, g, or t
  misc_feature (953)..(968): n is a, c, g, or t
  misc_feature (975)..(985): n is a, c, g, or t
  misc_feature (989)..(993): n is a, c, g, or t
  misc_feature (995)..(997): n is a, c, g, or t
  misc_feature (1003)..(1013): n is a, c, g, or t
  misc_feature (1015)..(1020): n is a, c, g, or t
  misc_feature (1022)..(1025): n is a, c, g, or t
  misc_feature (1027)..(1028): n is a, c, g, or t
  misc_feature (1031)..(1031): n is a, c, g, or t
  misc_feature (1034)..(1048): n is a, c, g, or t
  misc_feature (1051)..(1052): n is a, c, g, or t
  misc_feature (1055)..(1056): n is a, c, g, or t
  misc_feature (1058)..(1068): n is a, c, g, or t
  misc_feature (1071)..(1097): n is a, c, g, or t
  misc_feature (1101)..(1102): n is a, c, g, or t
  misc_feature (1108)..(1118): n is a, c, g, or t
  misc_feature (1120)..(1127): n is a, c, g, or t
  misc_feature (1129)..(1133): n is a, c, g, or t
  misc_feature (1136)..(1138): n is a, c, g, or t
  misc_feature (1140)..(1145): n is a, c, g, or t
  misc_feature (1148)..(1157): n is a, c, g, or t
  misc_feature (1159)..(1162): n is a, c, g, or t
  misc_feature (1165)..(1172): n is a, c, g, or t
  misc_feature (1174)..(1174): n is a, c, g, or t
  misc_feature (1180)..(1180): n is a, c, g, or t
  misc_feature (1183)..(1186): n is a, c, g, or t
  misc_feature (1188)..(1193): n is a, c, g, or t
  misc_feature (1196)..(1198): n is a, c, g, or t
  misc_feature (1207)..(1208): n is a, c, g, or t
  misc_feature (1210)..(1214): n is a, c, g, or t
  misc_feature (1219)..(1224): n is a, c, g, or t
  misc_feature (1227)..(1232): n is a, c, g, or t
  misc_feature (1234)..(1247): n is a, c, g, or t
  misc_feature (1249)..(1250): n is a, c, g, or t
  misc_feature (1254)..(1259): n is a, c, g, or t
  misc_feature (1266)..(1271): n is a, c, g, or t
  misc_feature (1273)..(1277): n is a, c, g, or t
  misc_feature (1279)..(1284): n is a, c, g, or t
  misc_feature (1287)..(1287): n is a, c, g, or t
  misc_feature (1292)..(1310): n is a, c, g, or t
  misc_feature (1316)..(1335): n is a, c, g, or t
  misc_feature (1342)..(1343): n is a, c, g, or t
  misc_feature (1347)..(1349): n is a, c, g, or t
  misc_feature (1351)..(1359): n is a, c, g, or t
acaatttcctcaaatacattacatttgttagtgacctctcatttgaggacacgcttcgtaaccctctaaggaccacttgatggcctgaaaacagtataaccattgacaccacatgctatatttgagtaatctgggtagtatccataactatcattctctgtgtttctcatacctaaatacaacagatcagaaccagccacctgccattggtttggaatcaacccatcgacctgcccattgacgccaggcacaccactaaccggtggaatataatccctcagtgaatgataatgcccaccagacaagccataccctccttgcaatctatggtcatgctggaaactccgtgatcgctccaacctgcaagaactggttgaagatcccaaatcagcaccggagagtcctctagaactaccagtctttcctttacttgctggtaagcatgtgaaaaatatttccctttataggatgcagagcacatgaaagcatatgtgatgattcatatataagaatagcttngtgcaaaacttaactagattgatgccaattaacttnngtactatttaacataattgccaaggagaaagatagttgctggcnnnnncgnnnnnncccnnnnnnncgnnncnntnnnnnnnnnnnnnnnnnnnnnnnnnnacnnnnnnnncnncctnnnntnnnctnnnnnnnnnnnncgnnnnnnnnnnnnnnnnnnnnnnnnnnnnnnnnnnnnnnnnngacnnnnnnnnnnacnnnnnngtcannnnnnnncaannnnnnnnnnctnaatnnacccctnnnnnnnnnnnncgcnnnnnngntnnnttcccgacccacncaccancnnnnnnncnnnnnnnnnnnnncnncccannnnnnnnnnntcgnnnnnnnccancngnnnnnnnnnnnnnnnnnnnctnnnntcnnntcnnnnnnccatctcaccnncnnnnnnnnnnnnnnnncagcccnnnnnnnnnnncccnnnnnannntctacnnnnnnnnnnntnnnnnncnnnntnntcnccnnnnnnnnnnnnnnnacnntcnngnnnnnnnnnnncannnnnnnnnnnnnnnnnnnnnnnnnnntccnntgcccnnnnnnnnnnngnnnnnnnngnnnnntcnnncnnnnnnccnnnnnnnnnntnnnnctnnnnnnnntncccccnccnnnncnnnnnnccnnncccccccanncnnnnnctccnnnnnnatnnnnnncnnnnnnnnnnnnnntnnctcnnnnnncctccannnnnncnnnnncnnnnnntcnacccnnnnnnnnnnnnnnnnnnnttattnnnnnnnnnnnnnnnnnnnncttcatnntatnnncnnnnnnnnncatctgc

SEQ ID NO: 6034 - DNA, 441 bp, Glycine max
tttgggatgttttctgaggcttattgcttcttcgttagagctcagattgagatggcttttggaaggtgagttcatatactgtaagctttgtcagaaatctaatctggaaaaggtatccgttgcagtgagaatggatgatggatatgttgcaggtttgagaacgcagttacaactgctgagaaagctagtcagattgacccccgaaacgttgaagttgctgttttgctcaacaatgtgaggatggttgctagagctcgattgcgtggtaatgatctttttaaatcagaaaggttcactgaggcatgctcggcatatggggaaggtttgaggctcgacccttcaaactctgtcctctattgcaatagagcagcatgttggtttaagcttgggcaatgggaaagatcaattgaagactgcaatcaagctttacacatccaacct

SEQ ID NO: 6035 - DNA, 356 bp, Glycine max
cttgtcttggccaccacctccttcatatcagttcactcgaggaacacactactgatccatgagggtcaagctcgggaactgcacaagacttggcaaaggaagacaaggatcaaccatggaagccaccgtggcaccaagaaacacctcgtgaacccgacaatcgaacatccatttcaggctcgtgaatttcctctgtagttctgtttcattgtgcttatttttctgtaatattagtaaagtaaaggttctttattaatttagtgttatagtacttatttattcttcatgcccttttctctgtaagtcccaaatcattccaaaaatgttgttcccggtgatttgtgtttgttagtaaa

SEQ ID NO: 6036 - DNA, 644 bp, Glycine max
atgcgaaggaacacagcaaaactcagctttgcacttgcattccacgcacgttaattgaatacaactttaagttggagtttattctctgtgctcatccgcatacttccattgcatactcccccctcctcaccatcacctgataaataaataagatgaacacctgcaaacccttccatgaacttcttccaacttcagttcttttctctttatttcgttaatctcccttaggataattgagaattctcaattattgttgtgctgttcaagtggttcgatccattcccagctgaacgttgctcagaattagctagtgcatacacgtaataacagaaaatcaccaacaactaaaatctcattcacataataataaaatcaaatgaaagtaacctaaaggtggaatattgagtaagaattaaccctaactagatctccattaattagaattctatattacaaattgtaaaattaattgttccatttttttcttagcacactcaattaactcttataactcaactcgtgatcctattgagactaaaattcatgatatcgacctaacaattgaaagtgataaatgaagaatgagaattatggtttcttaccaagagtgtgtttgttattgtgcatccaaaccttgagcacat

SEQ ID NO: 6037 - DNA, 913 bp, Glycine max
  misc_feature (876)..(876): n is a, c, g, or t
tgtttgatgagcggcctatatggtccaaaattcgcttaccgaactcttgcttgataagggcttaagcttttcgcacagcatgctcagaaggtgactgaagtaaattctgctgattagcttttttaacttgcaacaattgaattgctaatggtgcagtgaccatcattctctcttgcaggcttctatctagaatttcttactacttttctagtggaccatttctgaggttttggatcaagaaaggatatgatccacgcaaagatcctaattctcgaatgtaagtcatctcctaatttctaaataatctcgtggattttttagtcatacatttgcactaaaaaaagtgtttggttcctgtgataatatatttctaatgtattgttcggtttggaaatattatttaactaccagtatgtcatggtatcatgtaattcctttgtacctttcaatttacagttaacactgtaacaataaaagaggtagatctagaatggggatcatgatgattttagaagcctgtctaattttttatcattatcaaccatgaatcagggagttgatgacatattttgaactttggaaacatctggcttaagtttatctggggtgagggatagttagttgtctgctgaaatttcagactagtttataagatggggaatcagtttattgaatcttgattagaatatagttagtgcaaatgggttcgctggacactggcttagaaagaaatggctattttttctcactggtggtccatgcttctatgcaatttggtcagctatttcatacaacattcaatttgttctctaagtagcttgaatccattggttgttttcatcctaaactaatgtcattaaaaagaaatggggctcnttaaatactattttcatgtttttgttttgtgaggatg

SEQ ID NO: 6038 - DNA, 792 bp, Glycine max
tcaaaacgaatgcacctatcagcggttccacctccagacacaaggagactgctttggtgaggtgaccaagcaatggccttcacagcagcagtgtgctcggtaagtctcaaaactggttgctgagagtgttgattccataccaggagctgctcatataataaaacatgacattgaagaggtaaaccacaaaataaacaaacaaggaagtataataaagcacttttttctttgtgtttcgtgacttatttcttgaaaaaaataattatttcaataaaaaataactttctgtttttttagtgtgtttgtctaaactatttttacttaaaaaaaaattgttttatgcttattttgaaaagcaaatcctatctgcttacttaaaaaacgcttattttaatttttttttaaagtttaaacaaaccaatctttaaccttgtgacaaggaaagaaagataagtatacctgattatcattaccaccagaagcaagttccctgtcatcacaggaccatttcaatccacatacctgtacaaattgagggataacaattgctatcaatttctctgctttcaattagcctttaacattacaagtgcaatgtgtattcttcgaaatccttttacctcagacttgtgaccaacaagcttgctaacaaagtcacctggaaccctcatgtcatgctgaagtatgttcctatctctgctccctgaagccaaaatgcgagaattccatgccaagacaccagtccttgtctgatgcccacccatggttctgaccttcttacactgagttccc

SEQ ID NO: 6039 - DNA, 585 bp, Glycine max
  misc_feature (55)..(57): n is a, c, g, or t
  misc_feature (514)..(515): n is a, c, g, or t
agtggtgatgatttgattgcacaggtggaacactctgtgcagctatggacttgtnnngtaagttcctgtgagcaaattctgtcataaatggacatttattatatcagatcatattacagtctgacattgttttacatgtcgatgatccgttaatttattcaactctgttattgaaggctgctcaggccccgagatctttttctgttgttcatatgttcacaagtctagctcttgtcagcggggattagtttccctgagatcgactcctatttatgattttggcatgaaaggaaaaacctaatggaatactacaggcatgcaaattaggattagtaagctattatttcaggacttttggcgtgtattttagtagtacttataagtttaattttagtgtgtgcattacattcatgattcatgcttttactccaatcgtcagtgtattaaagaggttgaattccttgttatttgctggttcattttatttactattatattttttttcctcggatanntcaatagtagtgatgttcttttagtgaataatatatcactcatgaatatgcatgaacgaggttccttatt

SEQ ID NO: 6040 - DNA, 150 bp, Glycine max
actccaccgagagcaccttgcaccttgtactgttcctctctgctcctccaactacacttccactttctggttagattttggcttcacattgttgctttcctttcaaactcaaatgggttttgcctcttttttaggggtgtttttgatttt

SEQ ID NO: 6041 - DNA, 359 bp, Glycine max
gacctggcaagctccgccatttccggggcagcccgacccatttcctcgccgtcacccaccgtcggcggcaacccgagctcgtcgtcggaggcttctagaagatagcccaagttagattgtagctccccggagtcgggttcctgggccgggtcaccggaaccagaatccgaacctggagcatttatctcatcctcgaagcttttgatcactgagtcaagaccctgcaccgagtcacgctcgggcacattgtccgtgtcgtcaagcatgttaaaaatgtcgtcttgtagctgcacctccgacgagtcgaggaccgattcgagttgagactcggacgagttaatacccgaatcggacgagta

SEQ ID NO: 6042 - DNA, 410 bp, Glycine max
gacgaatccatcggccgcgactacaccgccgacatccccgacgagtgcctcgccggaatcttccagtttctaagctccgtcgaccggaaaacctgctccgccgtgtgtcggcggtggctgcgcgtggacggcgagaaccgccagcgcctctccctgaacgcgaaggcgagcctggttgacttcgttccgtcgctcttctcgcggtttgactcggtcacgaagctcgccctgcggtgcgaccgcaagtccacgagcgtaaacgacgacgctttggtcctgatctcgctgcggtgcaggaatctggtgcggctgaagctgcgcgggtgcagggaagtcaccgagcacggaatggccgacgtggcgaagaactgcacgaatctgaagaaaaataactgcacgaatctgaagaa

SEQ ID NO: 6043 - DNA, 801 bp, Glycine max
  misc_feature (795)..(796): n is a, c, g, or t
ttctgggtatctaaacagaggtgatgctttgcatgtaatggttagggtgcctaaggcttaacttcagaatcatgagctgtgatgtttacgtgccaatattgttcattatcatgtaaaaataatgacacttgcctgtttatcatagctgtattggtaaaattacacccgcacatacaaaaaactccactctctaaaagaatgcaagggaagaaagttgaagactgtttgttaatgactaaccaaagtgaaatgcttttgttttattgattatgcatacatgacaacttatatgaaagtatagctattgttagtcttgactgctcaaatttgttgcctcttttatttttctttgaaaattcatcattttcgtcactagtaatgtacctactatataaagaacttgatgttggaggaggtaatgtatttgttgctgtcattgtatacaggctcttttcaaggccagatttgagcaagctcttgagtctcagaagctaaacataaagaaaatagaacagcagcttcgacggatgggagtaaatcccgaggatccagctgccatggccagcatccagagagttgcttccacattcttcaatgccatagaccagaaagaaggaagcccttatgtcttccgtgaaggcaagcagtcaataacagaacctgctgaaggttttgaagagtcagagcctatagctgatagtgatcaggaagagctagatcggttcattgctgagatagaggatgcagcagataaagaatatgaagctgaagaggcaaaagaaaaagaagagttgnnagaat

SEQ ID NO: 6044 - DNA, 381 bp, Glycine max
ttggccttggggataatggccaactaggtcgtggcacaacacaaagcacatcacttcctgaacctgttaaggaattgccacaaaatgtgcatcttgtttctgttgactgtggcttgtttcacacttgtgttgtttcctctgatggggatgtgtggtcatggggaatggagaagggtcttggcttgtgttctgatgatagcaatggtggaacacattctggtgatgctctttctccgtttcttatctcttgcaatccacatcaacctaaattttcacaaccagttcaagttgcatgtggggctgctcatactgtcattattgcgcatgagggttgcaagctatggtcttgggggagaggaaggagtggagttcttggaaatg

SEQ ID NO: 6045 - DNA, 359 bp, Glycine max
atgcggttgtgctttgtgaggatctcaaagtgggattgaggccgagagttggtgaaaatggtttggtcgagagaaaagaaattgctgatgttgtgaagcgtttgatggaaggaagggaaggtggggaaatgcgaaaaagaatgaagaaactagaagttgcggctgttaatgctctcaaagaagatgggtcttctaccaagactctttcagagttggcactaatgtggaaaaatgtggcttaggaaaacaagttttttatttatgttatgcatgcagcttgtgtagtagtgcctgtaatgttcaggtatttcgtatcttagtttttatttatgtaatgtaatgcagcttgtatggtgcta

SEQ ID NO: 6046 - DNA, 374 bp, Glycine max
acttgtcgggatgatgctggtgccttgttaacatgcattacatttgtcggggactcttctcatattgctgttggaagccataatggggagctcaaattttttgactccaacaacagcaatgtggtggagagctacacaggtcaccagtctcctttgactcatgttcagtcttttgtttctggtgagacccagctattactttcttcaagctcccaagatgttaggttgtgggatgcaacatcaattttaggtggtcctagccattcatttgaaggatgcaaggctgccaggtttagcaattctgggaatgtttttgcagccttgtcatcagaatctgcacgacgggaaatccgcttgtatgatatccaaacatg

SEQ ID NO: 6047 - DNA, 342 bp, Glycine max
gagggtggtgagggctttgaccaggtaaatggaacctctttaaaagaaaaggttgatgatattgggaactcgccatcaaagcaacaagtgaagaagaagaagaagcctttgcttggcaagttcggaagcctgctcaagaaaaggggtggtagcaaccacaaatagaatgaacaaatggcaggtatattgaaaaaacattaaagaattgtttgacatgtatttgctttatgatttttgcttcttgaatagcttttaaagaatgacaaggcatgtaatcttgtttaggagtcttactctagtcacttattttgggttgcggttctccatgttggcagtaaattg

SEQ ID NO: 6048 - DNA, 1496 bp, Glycine max
atttaacacagattctcagataaccatcttcggttccaatgagaaacaatcgagagaatggaagtatactaatacttgataacgctgacaagcttctctgaccattatcagaaacatatagtttctgagggctaatgtgatgctgcccatcctgtgccattgagtcacataatcaggattaaaattttaaaaaattgagaacaaatcaacatctatatcattatcaggctttcctttactgatgagctccccccaaaaagtaaacatcaagctgaacaacttaagcaattcaatatggaaactaaagggcttaagggcacaaatatcaagcatatgcattgtattctcttaaatctgtgaagaagagattatgggcagtcaggaaggctctgggttttaaataaatatttttagcacattcatatactatagaggagcagaatctatgaacaagaagggggtcacatcaagcaacaagatataactaaagcaagaatgaaccattatcttgacatctaaattgggtgctggacaagcaaaagtaactgatcttttctaattcctatcctcgtcatgcaagttgtgagccccccaaaagagaatcttactgtttcattgggagatttagacaaggagagaagcccaattctattccgggaaattgaaataacatcttggccccaaatggagaaactggatatgccatctgaatgacctctgaaaataatgggctgcgatgataaattcctgcaagggtaatagagatgagcttcaggatataatccttccggatatgagaaagaaagctcatcactttcttttaggttcttttagaaaaatatcttcaattaaacacatgcaatatatcaaccaaactaaaaaagatcatcactttcatttaggttcttttaggaaaatatcttccaattaaatacatgcaatatatcaaccagactcaaatgtatgaaacgcaaaacaacagaaacatggagagcaaggaaagtccaatacagacatacaatgaagagagaaacagaaaaagagtggaggtcaaataggttttttcgctcgtcttgatcattgataaattctttaatttcccaagttaaattatatgcacctagtcacctacatcttataaaaacatctcatcaagtagtttgtaaactaccagcagatttatatgcaataaggttgatcattcttcaaacctcaatcagccatttgctttaccttctaacaactttcaagtgtcaaaaggcacaagactttgatctcttaataaaagaaagcttaagagagacagttctaaatggtccaaaactctaatgaattgaagttcatgaaggtgatagctcttacattcttaagtcccagactcgtaaagttctgtccaaagagctggaaacaagcagatgttcctcaggtgctgccaactgtaaacaaagacattgatgaagctgtgtgtaaaatcagattgggtagccctctaatat

SEQ ID NO: 6049 - DNA, 393 bp, Glycine max
tgattgccccatttgctttgaggtaacattatacaaatttcttatttcatcagcacggaatattaccaatttgttgaattgctgaaattgactttgcaccaaatttggtgattacagtatttgtttgaatctgtgaatgatgtcactgttctgctctgtggacatacaatacataagagctgcctaaaggaaatgagggaacatttccagtgagtatcacggagctcttcttgtctcctcacatgtccatttctatctgctcaaagtcctgttgcagtaaatgttgtgatttttgtgtttgattctgcatcaggtatgcatgccctctctgcttgaagtcggtttgtgatatgtcaaaggtttgggagaaatttgacttggagattgctgcta

SEQ ID NO: 6050 - DNA, 570 bp, Glycine max
gcttttgcacgtgtccaatcacattaattgagttgcgatcttcttttcctcaataactgtcttgtgaatatctccttgatactatcatttcgtatcttatcctttcttttgtggacacacattcatcttcactccacctacagtctcatagctagtctcaaacccaaataaaggagaacagttatgttaagcccttgacagccagcataaaatttgttttaaccccaaacatggatcgctcacagagcagatacattgagctccaacaacaatatctctgaactgtttcctaatattcactttaaacaatcacataaagtatctaggaaagtcattcttatgcagaaccatatttgggcaagtgcagcacaagttatataactagttttaacaaagataaaataaaacaaaaaaatagaagtaataaaatggtataatgatttccccagaaaaaaaatgattgagttttgcctaaatcagtcgaataatttgaaaagtgacaaagaaaatgtatagaatctccataaatgggtatatatgttatttttttcccatttttaattttttttt

SEQ ID NO: 6051 - DNA, 550 bp, Glycine max
ggtcgggttggtgaaggccttcatgaagcactcctacaactccctcggcggcggtgctaactccgtcagcgctggctacaacaaaggcagtgctctgggtgcggagatcatcggcactttcgtccttgtctacaccgttttctcggctaccgaccccaagagaagcgctcgtgactctcatatccccgtatgtttcttttctttactcatgtttattgttgttgttgttgtttgcaaataaaatggcgttaatttgtgcaggtgttggccccattgcccattgggtttgccgttttcatggttcacttggccaccattcccatcactggtaccgggattaacccagcaaggagcttcggtgctgctgttatctacaacaatggcaaagtttgggatgaccatgtatgcatctattgtttacctctaactcatatcattctgttatttagtttattaaataaatgcgtttggttgcagtggatattctgggttggaccattcgtgggagcgttggcggcggcggcgtaccatcagtacatcctgagagcag

SEQ ID NO: 6052 - DNA, 412 bp, Glycine max
ttttgtagaagatgtagcagatgctgttgaaatgcctgaaaacagccaaagaaatggtgttgaaacccctgtaagcaacaaagcagatcgcctcccagaagaagcaaaggagatactgaaatcattggcaagtaaatgggaggatgtacttgatgcaaatgcattgcaggtgatccctctcaaaggggcaatgacgaatgaggtattccagataaagtggccaactatgacaggggaattgtcacgaaaggttcttgttagaatgtatggtgagggtgtggacgtgttctttgatagggataatgagatccacacatttgaattcatgtcaaagaatgggcaaggtcctcgtctactaggacgatttacgaatggccgtgttgaagagtttatccatgcacggacattaaaa

SEQ ID NO: 6053 - DNA, 414 bp, Glycine max
gggggttccactcctagctctcctcgccggcgttccccttggtgcaatgctgctcctcctctccggcatctcgctcatcgccagcctcttggggctggcggtggcgacgccgctcttcatcttcttcagcccgctgctggtccccgccgccttcgccataggaatggcggtgaccgcggtgctggcggcgggggcgtgcgggctggcggggctcgtgttgttctcgtgggtggtgaactatctccggcagatgccacgggggacgacgatgatgacggtgctgccggagcaagcgaagcggcacgtggcggacatggcggagtacgtggggcagaagacgaaggaggttgggcaagacattcagacaagggcacatcatgcccagggaacaacaaggatgacagtgcattgagt

SEQ ID NO: 6054 - DNA, 1379 bp, Glycine max
  misc_feature (638)..(642): n is a, c, g, or t
  misc_feature (644)..(644): n is a, c, g, or t
  misc_feature (656)..(660): n is a, c, g, or t
  misc_feature (662)..(666): n is a, c, g, or t
  misc_feature (668)..(671): n is a, c, g, or t
  misc_feature (673)..(676): n is a, c, g, or t
  misc_feature (692)..(694): n is a, c, g, or t
  misc_feature (696)..(697): n is a, c, g, or t
  misc_feature (699)..(707): n is a, c, g, or t
  misc_feature (711)..(712): n is a, c, g, or t
  misc_feature (715)..(715): n is a, c, g, or t
  misc_feature (717)..(717): n is a, c, g, or t
  misc_feature (719)..(719): n is a, c, g, or t
  misc_feature (722)..(722): n is a, c, g, or t
  misc_feature (729)..(731): n is a, c, g, or t
  misc_feature (733)..(736): n is a, c, g, or t
  misc_feature (741)..(742): n is a, c, g, or t
  misc_feature (746)..(746): n is a, c, g, or t
  misc_feature (748)..(750): n is a, c, g, or t
  misc_feature (755)..(755): n is a, c, g, or t
  misc_feature (761)..(761): n is a, c, g, or t
  misc_feature (766)..(767): n is a, c, g, or t
  misc_feature (771)..(773): n is a, c, g, or t
  misc_feature (776)..(780): n is a, c, g, or t
  misc_feature (787)..(787): n is a, c, g, or t
  misc_feature (803)..(815): n is a, c, g, or t
  misc_feature (817)..(828): n is a, c, g, or t
  misc_feature (840)..(851): n is a, c, g, or t
  misc_feature (854)..(854): n is a, c, g, or t
  misc_feature (856)..(859): n is a, c, g, or t
  misc_feature (863)..(863): n is a, c, g, or t
  misc_feature (865)..(872): n is a, c, g, or t
  misc_feature (878)..(880): n is a, c, g, or t
  misc_feature (882)..(883): n is a, c, g, or t
  misc_feature (885)..(891): n is a, c, g, or t
  misc_feature (907)..(913): n is a, c, g, or t
  misc_feature (918)..(930): n is a, c, g, or t
  misc_feature (932)..(932): n is a, c, g, or t
  misc_feature (934)..(937): n is a, c, g, or t
  misc_feature (940)..(943): n is a, c, g, or t
  misc_feature (945)..(945): n is a, c, g, or t
  misc_feature (954)..(956): n is a, c, g, or t
  misc_feature (959)..(963): n is a, c, g, or t
  misc_feature (966)..(974): n is a, c, g, or t
  misc_feature (976)..(990): n is a, c, g, or t
  misc_feature (992)..(994): n is a, c, g, or t
  misc_feature (996)..(997): n is a, c, g, or t
  misc_feature (999)..(999): n is a, c, g, or t
  misc_feature (1008)..(1008): n is a, c, g, or t
  misc_feature (1010)..(1010): n is a, c, g, or t
  misc_feature (1013)..(1015): n is a, c, g, or t
  misc_feature (1018)..(1030): n is a, c, g, or t
  misc_feature (1039)..(1039): n is a, c, g, or t
  misc_feature (1050)..(1057): n is a, c, g, or t
  misc_feature (1060)..(1060): n is a, c, g, or t
  misc_feature (1062)..(1062): n is a, c, g, or t
  misc_feature (1064)..(1069): n is a, c, g, or t
  misc_feature (1072)..(1082): n is a, c, g, or t
  misc_feature (1084)..(1095): n is a, c, g, or t
  misc_feature (1102)..(1104): n is a, c, g, or t
  misc_feature (1106)..(1110): n is a, c, g, or t
  misc_feature (1114)..(1114): n is a, c, g, or t
  misc_feature (1121)..(1121): n is a, c, g, or t
  misc_feature (1123)..(1132): n is a, c, g, or t
  misc_feature (1134)..(1140): n is a, c, g, or t
  misc_feature (1143)..(1144): n is a, c, g, or t
  misc_feature (1146)..(1152): n is a, c, g, or t
  misc_feature (1158)..(1170): n is a, c, g, or t
  misc_feature (1175)..(1175): n is a, c, g, or t
  misc_feature (1177)..(1179): n is a, c, g, or t
  misc_feature (1181)..(1186): n is a, c, g, or t
  misc_feature (1188)..(1194): n is a, c, g, or t
  misc_feature (1196)..(1213): n is a, c, g, or t
  misc_feature (1215)..(1220): n is a, c, g, or t
  misc_feature (1228)..(1229): n is a, c, g, or t
  misc_feature (1233)..(1244): n is a, c, g, or t
  misc_feature (1248)..(1258): n is a, c, g, or t
  misc_feature (1260)..(1269): n is a, c, g, or t
  misc_feature (1271)..(1284): n is a, c, g, or t
  misc_feature (1292)..(1300): n is a, c, g, or t
  misc_feature (1305)..(1317): n is a, c, g, or t
  misc_feature (1320)..(1320): n is a, c, g, or t
  misc_feature (1322)..(1322): n is a, c, g, or t
  misc_feature (1324)..(1330): n is a, c, g, or t
  misc_feature (1332)..(1334): n is a, c, g, or t
  misc_feature (1339)..(1357): n is a, c, g, or t
  misc_feature (1360)..(1366): n is a, c, g, or t
  misc_feature (1368)..(1370): n is a, c, g, or t
cgaaatggttgcgactttgagtcttccgatcatagacctctcttctccccatcgtctttccacagccaattccattcgtcaggttttcaactcacccccttctattctctgcttttctttctcacaagccaaagattatgtcacgaatttcatgtgtgtgttataattggtaactatgaataggcatgcgtggaatatggtttcttttaccttgtgaaccatggggtggacaccgattttgtgagcaaagtcttcgaccaaagttgcaagttcttctcgcttccggtccaacgcaaaatggacctggcccgcaaggaatatagaggctacactcctctctatgctgagacacttgatcctacttcactctccaaaggtattcttcctttctttctttcttttgttttgaaggaaatactaaagaaataatgaaaatattgtgcttaaagggtaaacaaaagtattcatccttttggcatacataatcgtattctttttattggttttacattgaaaaattgattggagtgaggatattccgtacacccccaaaagtgggtggaaataagaaatagatagaaagtaaagagaaaataataaatgtgataggcgatgtgataaaacaagagacagatggnnnnnanatgacatggaannnnnannnnntnnnngnnnngtattttccaattaannntnngnnnnnnnnnaatnntgngntnaantttattnnntnnnngcatnnatanannntgttnacatcnaatcnnattnnnaannnnncttttanagtaacataaaagggnnnnnnnnnnnnntnnnnnnnnnnnntcaaacttaaannnnnnnnnnnncanannnntttnannnnnnnnaatttnnncnnannnnnnntatgccacaccccccnnnnnnnacccnnnnnnnnnnnnntntnnnncannnncnaccaccgannnacnnnnnaannnnnnnnntnnnnnnnnnnnnnnntnnnanncnacaacccangnttnnnccnnnnnnnnnnnnnttccccctnccaaatactannnnnnnntcncntnnnnnnttnnnnnnnnnnncnnnnnnnnnnnnacaaaannncnnnnntacnacttctncnnnnnnnnnnannnnnnnccnncnnnnnnncacccnnnnnnnnnnnnntggcnannntnnnnnngnnnnnnncnnnnnnnnnnnnnnnnnncnnnnnntaactatnnacannnnnnnnnnnnaacnnnnnnnnnnntnnnnnnnnnntnnnnnnnnnnnnnntctccccnnnnnnnnncctcnnnnnnnnnnnnntcncncnnnnnnnannnatctnnnnnnnnnnnnnnnnnnnccnnnnnnnannnataccaaca

SEQ ID NO: 6055 - DNA, 1084 bp, Glycine max
tggaaaggtaaaagtatttccttttgatattaaatgatattagttatgtatttctgctgtacttccataattaattggtgactgtagtgtatgcttcaatttatcctttgcttatactgaatggtatatattatcagatacaagtttttctaatagaaattcatcaacttcttgcagctatgcactttttgatatggatgggaatcaagttccccaagaattggtaacaaaaattggtaaaatatttggagcgattttagaagaggcgagtaatttaatatttttagttatttgattaactgatatattgaattttcataatagaaaagacaaaggttcaggaatacattgtttttctgattgattctgttaatgttcaactccacttattatgaacataacctctaaacattcaccttgctttaatgcagacaaataatgtacgagaggaattcagtgaagacatgtccatactccgtgcactttcaattgtttttgaaagaaaaccagaattgaggtgattattggcataaaattatcctttgaccacctttattgattttcttggagctgaagtaatgtataatttaactttctctgttggatgcaggttagaagggctttcccacaaggtgctacagtggtatttatgcagaatggagggctggtttgctacagatgctgataccatatcactgaaatgttgggatcaggtaatttgacaaaaccaagtttgagatgatgaagtgaatggccaactttttcttttttttcttttttcttatgtatacttataattgaatacaatgttgatcgtaaagttgcaagctcatagttatcccctataggttttagtttgagattaaatggtaatgcgtgccgccatattagatgtaaaggatgcaatatgagatacataagtggcttcatatggtgatcctagtcacattatgttgctactttattgttaattactacatgtttccatcaacatttttcgtgtgtaacttattcttctgtttatctgcatacaggaagtattactacctggtggtcatggtcttatggtcaggggtaccagcct

SEQ ID NO: 6056 - DNA, 1054 bp, Glycine max
  misc_feature (1026)..(1027): n is a, c, g, or t
  misc_feature (1042)..(1043): n is a, c, g, or t
caggtccatgctccacattcctatactactgtcaggacattgctcagtattctccgcatatcagctgtaagtcttcatcttttccccacaaaagagagcagtgaaattagacatttaggttatattgacttttctttttgggttaatgatttatgtacatacgtaactccacatgcagttcttaaaattaaaactgatttaggtgttggttaataatttttggctttaaatatctgttattacttaggttggctaatgcctttaagtccgcaatgtgaagtaatagtacgcgtctgattattttttggttgtatattgtctaagcaaatgctattccatttttaatttctaaacaggcactagcaagactccgtttttccgagactgttgctcagagtgacgtggacgaagcactgaggttaatgcagatgtcaaaattctctttgtactccgaagatcgtcaaaaatctggtctggatgccatatctgatatctattccatactgcgagatgaagcagctagaggtaaccgaatggacgtcagctatgcccatgcactgaactggatatctaggaaggtaagtacatatactgctcaaagttgaatactgtccattgtgtagtattgtagaagatgatttttgcgtcaaacttgagaacggtctagattcaagtttgactgatgaaactgaggaactcaacaatcaaaaaagatcatggaacaattaaaggattagtttatttcattgaataaagagtagtaaaatgaatgttatctaatgaactaagaaatggtaagggaatgtttttaaactggcctagtttgcgtaaatactattccttgtttttccaaaatacacctattattttttttatcctctctgtaattaaattactgatacttggctgttaactaaatgtgttagcacttagtattttgtttttgttgtgtgaagacagagcaaggccctgcctgtcaaataagtttgctgtttattctaaccttggaacttttggctttcaaannaggggtacagcgaannccagtgaaaga

SEQ ID NO: 6057 - DNA, 347 bp, Glycine max
gtggcagtgatgttattaaccccaagtcaatcttgaagagtaaggataatctttcggagcccagggatgttcgcaaacgtgttcggtttgattctgaatgtgatgatagtggtaacgatgatgatgggcttgaaggaagaaccagggatgttcgcatgaagacctcttcaatggaagaggctacagcttctgatcagttgtcaaagtcaaaagaatttgattcagctgttccagattacattcgtaatccttcaagatacacccgttacacttttgatgattctccaagtgacatggatgacaaatcaaataaggaagcatgcatgagcttccttttgcagtgaagg

SEQ ID NO: 6058 - DNA, 341 bp, Glycine max
gaggtagacccagctttcatccaagacctagaacacagaccaaagctctccataatccaagctgaaggaattcccataattgacctctctccaatatccaaccacacagtttcagatccatcttccattgaaaacttagtgaagcagatagggagtgcatgcaaggaatggggtttcttccaagtaaccaaccatggggtgcccctcactctaaggcaaaacattgagaaagcctcaagattgttctttgcacagaatttggaggagaaaagaaaggttagcagagatgagagttctccaaatggttactatgacacagaacacaccaagaacattaggga

SEQ ID NO: 6059 - DNA, 405 bp, Glycine max
ttgttaacattattgttggaactcctccttcgagccagtgttgtgcattgatcaagggtttggcggatttggaagctgcactttgcctatgcaccgcaattaagagcaatgtgcttggaatcaacttgaacgtacctgtgacgctcagcgtgatccttagtgcttgtcaaaagactgtccctcctggtttccaatgtccctcctgagataatcaaattaggttcatgagatatctctcgtcatcagagaaatgtttagatatgcacttaacatgaaattgattgactgcctatgtaagcatttctttggcaatttgcagagtgttatatatgtttttttttatgtattactgtagttgttgtttttttgttgggggtttatatcgttgttaatgctagtgcacgt

SEQ ID NO: 6060 - DNA, 403 bp, Glycine max
tctgtatgcagcagatggttctgcatctgaactcaaagttgctgtctaagtctcatctgtcatccatgatagaaatttttatttactgacaaaattcagctttaccttcttggcttctgtgaacttctagatctaaaattgaaaaactagtcaggtgttttggtacattggaagcatttaaaagattgagtccagaaggcaagattagttgttacttcagcatgctagagacttgctcctttttgtatttgtcaaattatgcctgattattagactgtaattggttagggcgagtttgatcagatcatgtaggaataaggttcaattttaccaatatgttcaactacatttatgaaagcacttctctacatttatgaaagcatttctacttgacacatcgtca

SEQ ID NO: 6061 - DNA, 648 bp, Glycine max
ggtttgtcagcactcgttaccggtggtgcctctggtatcggtaactccctcttttccttaacgccattcatattcgtatctaaaaatatcatactcttccgtttgactttgcaattatccgatttcaaatattcaaaaacaagtttcagttgactttaggaaccgattcaactaaactagctatgctatgcagatttttgccactgaaattaattaacataagagcaatgttgtgttgtttgtttacacgctctttcgaattgaagatccgattccttcactctttgagattttgtcgtggaagcgctttgttcatttgtgccgtttcgaaatgaatccgtagtttaattgggaagaaaagagatagcaaactacagagcacgtgttcaaactactgttagtaattgaattaacactatttgcataagcttttctgtaagtacttatgagagaagcaaataagaaaaaaaaatgaaacaaactcctcctatataagctaaaattagcttatgcataagcataagttaaaatcaacttttggagaagttaaaatcatttagttctgacatctgaggctttaactatgataagctttggtcacaggcaagtgaaagaatgataacatgccatgtgatttgatacatctgc

SEQ ID NO: 6062 - DNA, 366 bp, Glycine max
gcatacatagtatggagaaaagaaaggaagaaaaagcttccaccgagtccaaagggccttcccatcattgggcacctccaccttgtgtccccaataccccaccaagatttttacaagctctcactccgccatggacccatcatgcaacttttcctcggctcagtcccttgtgtggtggcttccaccgcggaagccgccaaagagttcctcaaaacccacgaaatcaacttctccaaccgccccggccaaaacgtcgccgttcagttcttaacctacgtgtttggcccttacggaccctccgtgaagttcatcaagaaactttgcatgtccgaactcctcggtgggcgcatgctggaccagttcctt

SEQ ID NO: 6063 - DNA, 373 bp, Glycine max
ctaaaatgatggatgtggtgaagaacggttagcagcacatggcttcttctacactcgctcccactctcagcctctccaccaaatcccactgctatctccccaacaccaaacaccggttttcatgtcccagaataaagttattctactccaagcaccgctccttctccgtctcagcttctgcttctgcttccacttcaaattcgcttcaggctctcatattcgactgcgacggcgtgatcctcgagtctgagcacctgcatcgccaagcctacaacgatgcctttgttcacttcaacgttcgctgcccctcttcttcttctccgggcccactcaactgggacgttcaattctacgacgaactccagaacctcat

SEQ ID NO: 6064 - DNA, 407 bp, Glycine max
gaccggattcaagtctttgaatgctttcgacttaatttctttctcgaccgggttggatatgtcgggtcttttcgaggacccgaccggatcgaattcggttgaacgggttgtttcgacagtggtgccagagaaaattatggagagagtggaggcaatgacggaggagggaagggtggtggtgagaagggagaagaatggtggtggagcaaagctagaagggcaggatggtaatttgattggtattgttgtggtttaccaattaaccgatgagctggtggtggttgaaatgaaaagaagtgaaaagggaggggggtttggggggcagttttggaaagataaactgcggccactgcttcttgaattggcaagtgaattggaagagccggtctctcggtgatttctataga

SEQ ID NO: 6065 - DNA, 632 bp, Glycine max
aaccctttctctttcaataatatccaccaaacgcccaggagttgcaaccaatatatcaacacctttctccataaggcgcagctgtttccattttttttaaaaaaaataaaaaagtaaccaaccaccactgattcatttattaaaaaggcacaaaagcacccactttcaccaggggcctatgtaatgtaatgaaaagcacacacctgctgagtaataggagccccaccgtaggcaacaacaaccttcactccagtttgatgcgcatatttattcgcttcatcgcgtatctaacaaatattataaataaataaaaataaagaacgaaccaaatttaatttttgagaaaaaagaaaataaaagacagagcagaataagtaaataaataaacctggcatgataactccctggtaggagacagaataagtgcagtggggtatgcaacagcggcaccacgagccggcattgatgaaaacccagaaagagaacgacccttcaaaatcccagatataatgggaaaacaaaacgctgccgttttgcccgaaccggtctgtgcgcacgccattaggtcgcgtcccgcactcgcgatgggaatcgcgtggcgctgaaccggcgtgggtttcacatacttgcat

SEQ ID NO: 6066 - DNA, 397 bp, Glycine max
ataaaatccagcatggcttagaacctacctaaaagactataattttcccctccaaaatcactatattacgcagtatatatggtacgttgtccaactacagccaaaaagatgcagctaacgactttacaagtctaatcccatccagtggcaacaatagatgcataaccgcgtggcccatcttcttcaaccctaccaccacctccattcaactcacaagaatcagtgtgattataactgccggaagaagctatatgtaaacattcaaaagagcaatctatattggagttttggatgtcataggaggtatcaacgtaagaggcatcatcagcagtgtaagactctacaaactgaactgcattgccattggtattgtagcagttgtaattctgcacctcag

SEQ ID NO: 6067 - DNA, 512 bp, Glycine max
  misc_feature (504)..(504): n is a, c, g, or t
tacacaaacgttgtttggaaaactggcgttagaggtgagaatactctgtcgtgtttactttgattttttttttcttttttttctgggtggaatttactttaattgattacataatgttgactgtaatttattttttcttgttacagtggacagcagaaaaaagatgttgggaacttttagtcctcagcaggaaccatatacatttgaattggaagaagaaactatcccttctggcatgttcgtcaggggaacctatgcagcaagaaccaaggtaaaataatattcagtcaaacttagaaagttgacagctatttgttttcttttttaaactttgagtggaatactcttgtttgacaaataggaagagaagaactaactcaattttcttgcttcagtttgtagacgacgatcgaaaatgctacttggatgtcaattactactttgaaattcagaagaacagaccaacaccttaatgagatttatttttaacttgagtaaattgtngtaaaatt

SEQ ID NO: 6068 - DNA, 458 bp, Glycine max
tatgggtcaagctgctttcttgtctaaaaatctcgactctgttgataacggtttttatgactcaatacctggttagttgattcagcgctctgacttattgatattactgccagtgctttaaatgaatgcaatttattaatgtttttggctgtgctgcagaccctgtgttttggcctgttttcataatcgccacccttgctgcaattgttgggagtcaagctgttataactgcaactttctccatcatcaagcagtgtcatgcgcttggttgctttccgcgagtcaaagttgtacacacctcaaaacatatatatggacagatctatatcccagaaatcaattggatacttatgatcctaactcttgcaataaccattggatttcaggacacgaccataattggaaatgcttatggtaatttattcccatatgagcctctctctctctctctccatgct

SEQ ID NO: 6069 - DNA, 361 bp, Glycine max
tcatctgcttcaaaagtccacaacaaggttgaaattacattggattataatgctacaacagaaggaactagtgttgaaggggaagatagtggacgtgagaggttgaagaggcatagagtggaagtggctggaagagtttggattcctgacatatgggggcaagaggagctcttgaaggattggattgattgcacagcatttgatgctcctttggttccaagcagaatcgtgatggcacgaacggctttggttgaagaaggtagaagagccacatcgggtggattgagaatcgagaacaggtgttgaatttttcatcaatgttttattatgtggattattcagttcattcagtgacaaacca

SEQ ID NO: 6070 - DNA, 370 bp, Glycine max
ttcttcactgccatagtttctgaattctactatatcaactactcaagggccagggaaagcttccaaccttatgctggtggcgagactggtgtaggtatgggaacctacaaatgagcttgttagttaagaattttacagcaaacatttaggtgtgactatatctggagtctggattctgcagcacatttgatctatattgtcatgtatacatatcaacaagagaaataatttcttacattctctgatcacacttgatctatagtgtctgcatacttaaattgtagtcctttcattgttggtaacttcattgtagggtcaatttccttaatatttttggtactttgtgataggaggaatttcacacatttgg

SEQ ID NO: 6071 - DNA, 174 bp, Glycine max
gggcggataccttcctgctatttatcctgtctgcgcgaatctgacatccttgaatttgagctatgctgatgttaacacggatcagctgaagtcagttatccgccactgtcataagctgcagatattctgggtatgtgttgtagctttgtgacttgtgtggctgcattgttgaga

SEQ ID NO: 6072 - DNA, 706 bp, Glycine max
gtaagagagagagatctagagagagagagagagggtttttattttattttaataagattgtgttgtgtttggttctttatttgttgtttactttgaagtggggtgtgtggggagagaaagttgggtttctctcgcttgtatctggaaaaagtctcgattttttcaagtggggtttgagggatttagggtttgggttgttgggtcgtgagtggaatcagcaaccatgaatatgatgcgaaggttgaagagcattgcttctgggaggacttccatttcttcagatcctgtaagagatgtttctttttttagctcaaaaagttgtttttttttgttttgattattattattttgttgggtgaactatttttgctggaaaaatggaaaaagataagttggggaaaaaatgagctaattaattgttttaggtttctgggatttgtttggaactattgaggatgctgcttgtcagtttttttcctctattttgttttaaaaaatattttctggggttttgactattgttattttttttttatttttataattgggtttttatgtgattttattatcttacatgtatcatttattgagtactggggattggggattttttttttggaaaaatttaggggaggggattaccgatttttatgaccttattttttataagcccaaggggggaaattttttctcttttgtgtttttt

SEQ ID NO: 6073 - DNA, 414 bp, Glycine max
ttatgctacctatcccccctaggcccaggaactaggaactaggaaaatgccccattcacaaaaaccctaataactaacctttttcagacccaccaaaccaatcactaccctcaattcccctctttacttattccctcccaaacatcaatctctttcgatttttctcctaaagctacttcctttcgccttttttctcttctgggtacacctccaccacttcctttcttttccctctttggttcaaatcacgttcttccgttctgatctcaaacacccaccttttttgtttctcaaattgttttccaccagtttcgtgctcaatccgtcagatcagtgttcactgtttgttgattttgaattttgatctaattagtgtttgtttggttgcacaaaattcactcacaaattcactca

SEQ ID NO: 6074 - DNA, 260 bp, Glycine max
aggatgcacccctgcgtacatcacgagggtgcgtcagaggtaccagggtcgctggctttgtgggctgtgcgtggaggctgtgaagcacgaggtggtgagatcagacagtgtcatcaccacggaagaagcgctggaccgtcacatcagcttctgcagagagttcagatcatcgacggttaccaataataaaacagagcaccccatcttcgccatgggacgcgtcctccggaggagcctcgactctcccaggcctctccgat

SEQ ID NO: 6075 - DNA, 383 bp, Glycine max
aatagcaaactaccgtaagcttaaatgaaataggccaacgccagacttgaaacaaaataattttataaagcaaatgaagaaaagaaccccaccccgtatgaaagaattaagttgaacagcacaatgttcttgttcttgtggttgtaataatgatgaacatataacagtaacagtaaaatccttattcttgagcttcaagttactctgggatgggcttggtcttggacctgtagaggagtttcttcttcttggatgtttggttatctatggtgagtacaatcttgccaggttcaccaattttgaaagcgttggtaataacggtctcatcagcgggaccaattttcctgttcttctgaactatgacagtgtaaccatcctcagca

SEQ ID NO: 6076 - DNA, 374 bp, Glycine max
gacttcagaatctatcagtcattcgtcttgatcagaacaatttctcatccccagtgccagaaacctttgctaattttccaaatttaaccacccttcaccttagttcttgtgaattgactggaacatttccagagaaaatctttcaggtagcaacattgtctgttttagacttatcattcaattatcatctgtatggatctttgcctgaattcccactgaataggcctcttcagacattgattgtgagtggcacaaatttctcgggagcaataccaccttctataaataatcttgggcagttatccatcttggatctttctaattgccattttaacggaacactacccagttcaatgtcaagactcagggaactc

SEQ ID NO: 6077 - DNA, 1119 bp, Glycine max
tatatgtcagtgtataacaaactactatcatttttattattgtgagaataaaagacaatgttagagaatttacaataataattcatgcatcctgttcaaccaactaagttaaatccccttaatataaactatcatctaaaagatgagtccaaatagttagcaattagaaagtcatgtatggtaacaaccataatacctgcatctcggttgacagccaaatgttattaaggtgagggaagtgtctccgagtcctatccgcaagctgcatgtattcttcaaatccaactaccttcatttcacatgctttgtctcccatccttacatgcatacacagaagaggcctagggacccatggcttgtgattggaccacacgtattcatcaatatcatcaggccttggcctggcactactttcctgagacatagaagagtaaaggaatgtaaatttttgtgaatacaatttatatggaaaatatagtactaccgttttatctaacaatgagagtattttggtatgaaccaggatacctctcgaccccaaaccaatgactagtcctcgaggtattgagatccattaaagggatgacttctcccaacatatattttttcatacacaaggattaagcaaatccatgaccacatgtttaagggaaaagattatctatcaatcatatcacaccatgttggtatctaacaatgagagtatgagtaacttgatgggaaaattaggtaaataataaattctgtaatagtaggacaccaggacctattttttaatctttcccgtgtttagatgcaaagcatggttacaatgtactacttccactctttaattctttcacgtccaataagaaaaatagtgcaaatttaactacaacctttggccaatccccagcaagactttcaaggaccatttttgcagctaattttccaaagctagcgtggcgggcctcgttcattaaattgcatgtgtattcggttgggaacctcattaagtagcgtactgcctggaaacaatatttatggcaactagaacaaatcatcaactgttactaaaaatgaggacttaacataactccttttctgcaagtctggtaggtacctgtgctctccaccacc

SEQ ID NO: 6078 - DNA, 471 bp, Glycine max
aagaatggattgcttgttccagatctagttcctgttgcctatgaagtatttgatgcttggaagcttttgattgaaggtcttgcccagctcttgcatgtcattcctgcacatggctgtaggtagattttatatatatattttaattgtgaatgtcttggttgctttgcatttgtttcatttatttctaaggctgatacaagatttatattcttatcaactgaattcatgcagtgaatgctcagaagttcatgtagcccaaactggtcaccacattcgggattgttctggcactaatggtcggcagcgtcgtagttctcatgcatgggtaaagggttcagtcaatgatatacttgtccctattgagtcttatcatctttttgacccctttggtaggcgtattaaacatgatacacggtttgaatatgaccggattcctgctgttgttgagctatgcattcaagccggtgtaat

SEQ ID NO: 6079 - DNA, 1186 bp, Glycine max
  misc_feature (683)..(685): n is a, c, g, or t
tttccttctttctcattcttttctgagaacatgaataccaacttttactagttagtttgcagtgcagaaactaatacacatgcaattgaatttgcacaattcacaatacattagaagctttcatttgttatgatgagataaaatatcatcctaagtgtcattctcttatgttaaccaaaatggatgacctcttttttcagaactatttaacgagacaataaaaagggaacaataacaataacatggaaattgcatatacacacaagaagctcaccttcaatttgtatatctcctgacgtgaaaaggttacaatgcaatcaccatttcttacattagagaaagatccaagaggaacattcagtgggactaaaggtgacagtctctcataaaattgaacctgcagcacacaagaagaagaaaactttgtgagagaaatcaaacattttaatgaaaataccatgaataagcagaggaccaggacagcagttgttaatgaaaatattggtctaatgtatatgctcccttcccgtccccacaaaaatggtcttgatgttgtttagagactcaacaaaaagacataagtttcggtacctcaatctcgtcaccagtaattttcaatatctcctgaataaggggcacagcagctggatcaccacaaaggtgaagttcatcagcagcaattnnnaataaagcacgtgtaaatgaatatccccttgtagtacaccctatcatctggatgcaaaaataaagataattgttagatgggaaaagaagtcacaataacaaacataccatggaaagcctacaagttattttcttagaatcactagatatggaataacaactaccaaagcccacaatgccatcaattcctcctcaaatgcagatgtttcagtcataaaacaattactccaattctcaattagtaatacaactataattgaatatctgacactacaagattatgataagaaccaaacctgtaaggtggaacctaaagttctacccttttttcaatgtgaaatttattatgtcagttcacataaaaccaaataattcttggagttatttagaaataatatgaaaaagggatctccaaacgaaaattttacttgcctgaatttcatcaataacagcacattgataatcagctgatagatcagccatttcaactgtaacagcctta

SEQ ID NO: 6080 - DNA, 396 bp, Glycine max
cggaccctcgccaagctcaaaacccgcgagaagaagttcaagcctgtggcggagcacgtgaatgcggtgcaccacctccgcaacccagcctccttccccttcaagtggtcgtggcgcgacgtctcgatcaaggtgcagaacatgcgccaccagtacctcggcgtcaagcagaagatccgcctctcccctcaccacttcaattggaaggacggtaacaatcattgggagaattttcttaaatacaaagaagtcttcggcgatgtgcaattgttggaatcccccaaacctatcaccaccgccaaattagggtttgatgttgattctgatgatgatgagaatgaggaggaagaagaagaagatgatgatgaggaggattgtgatgaagaggaggatatt

SEQ ID NO: 6081 - DNA, 644 bp, Glycine max
ttaagaaaattaatttgtgaaatagaatagtgtctatctcgttggaccatcaaattgcggttcagaaaattgcttttagtaattctctgacttgcagtataaatgttgagaggcttttgctacgtgaagtcagtgtgcaatgaagatttcggtagttaaaaatttcaaatttcaatattatgacacctgtgttttcatttgtttaatcatctcagctaacagatgagctgatcaaggtggatgaaaagctaaaagcagctgaagctcttctggaaagtaaggtacactagatatttcctcgttgaattttttcttcacttcttgcaaaaaccattattccagtgccacttaatacttatatgtttgacagaaccttgaaataaaaaaaatcaatgaggagaaaagggcagcactggctgcacaatttgctgcagaagccacacttcgaagggttcatgctgcacagaaagacgatgaaatgcctcctattgaagcgattattgcacccctggaggcagaactcaagcttgctaggatggaggtacattttgatggctatgttatgcattgaattagcttttagctgggaccggatggtagtttattcagttattcaatgtcccatggatgctcattccatgatc

SEQ ID NO: 6082 - DNA, 508 bp, Glycine max
tgacctgatgaggttggagccacaccccagaatgcagaaatatataatagtaatttattgaagaggatagagcagaagcaaggcactcctgctaatccatctgttccaattgatatttttgtctttgcacttttcaatgagaatttgaagcctggtcctgtttctgagagaaactatggcctttattatcctgatggtaccccagtttataacattggattagaaggttatctcccagaaatggttatagagtccaaatctaacgtaagtatacattcaatcactttaccagtgaaaagtttcattacttttttgttgttgtttttgaaacttttctaaagtagatatatctaatgctctcattgctattgattcgcaggctttgtccaccaattttctcatctacatatttacatgtttgttgttcatttgggagctttcaagaccgtgacaaaacaaataactttctacaaatcattcttttgcaagagttggtgaagggagacaa

SEQ ID NO: 6083 - DNA, 450 bp, Glycine max
cgaagaagaatcagttaatacagtttcacccattattgacatttcactcaatcggaagagtttcccagaagggttcatatttggggcgggatcttcctcgtaccagttcgaaggggcagcaaaggaaggtggtagaggaccaagtgtatgggataccttcacccataattatccaggaaagatcatggatagaagcaacggagacatggcaattgactcatatcacaactacaagaaagatgttgggatgatgaaggatatgaatttagattcatatagattttccatatcttggtcaagaattctcccaagtaagttaatttgcttacacccaatgactaatttgaaataaattttccctagttggatgttacccattaaccattttctaattaaactatatatctacagaaggaaagctaagtggaggtatcaatcaagaaggaatca

SEQ ID NO: 6084 - DNA, 855 bp, Glycine max
  misc_feature (798)..(798): n is a, c, g, or t
  misc_feature (803)..(805): n is a, c, g, or t
  misc_feature (810)..(811): n is a, c, g, or t
  misc_feature (829)..(830): n is a, c, g, or t
  misc_feature (840)..(842): n is a, c, g, or t
  misc_feature (845)..(846): n is a, c, g, or t
  misc_feature (849)..(850): n is a, c, g, or t
agttcacaggtaggtggttgattttcaaactgtatatcatgaattaagattaccagcgttagattggatttagcttatattcaatatttttttatttgttttgagggtggggaatggatgggaatattactgatgatatatcattcgttatcttacctataattacacttgaaagggatttgattatttataacctttgtattgtcatgcattgatttagacttctttatgaacatatattgcctgcaatacttagggctttctaccaacttttggttatcaggaaaacatcccatctgctacagcagcaaaggtaaaggcaggaatgctagatggagttgagtctgcccttggattatcaaaagggtcacttccaaaaccgttgtataccaggcttcaactatggtaagaatagtatcttgaagtattgtattgcttgctttgaattgtccttccatagctttgaccaagttaggcgtatagagttttttcttgtatatgctcagtaagtaggtaggtaactgggaaccagaattttcaagctatgtattttgcatgtgtagtctatgcatgaagtaactgggttaataagaagaaaaagggaacagcagaagaaaacaagatggtttaataaaattgaaagaattagcagtttacttgaatcaacttgcttggatcatatcaagtaaaaagaaaaggccgtaataaaatgataagggatattcttgtactggaggatgagtatgtgaatattaatgtctatttttagtagggcagagcctgccatttgggaagggntacannnaatgnnacttctaacattatacanntgcttgacgnnnaanntgnnactat

SEQ ID NO: 6085 - DNA, 408 bp, Glycine max
gctatgggatctggttccggtatgggccgggctggcgtgggtgctctcagacctccatcaaacccgatgatgggtatgggcatgggaagctatggaggcgtgaacgcaccaatgggtatggggcagatgccaccaccacctagtcgatttcctcctggaaattataactccatgatgggaagaagtggttatcctcaacatccttatgggggctaccgatgagattgaccattatacctaatacctagatagcaatgtcaaactgtatacgattgatcactatacgtagatagcaatgttaaagtgtatgagatggagcactatacctagataagatcatagcaagtgttttgttaagagtttcgagaaacggcaccccaatacctctggtctacatcttgcacaata

SEQ ID NO: 6086 - DNA, 622 bp, Glycine max
cgggttaaaaagaatagcagcggtgccacttgggcagaggaggaggaggaggaggaagaagatcaacaacacatcaccaaacaaccttatggagatttgggccaacatgttttttcccctcaggcgtgtctggctttctctctctgctcgcctcaagcctcgcaaaaacggtaccccctccgaacagagattaattgatttacagataccacccttgtcattgtttatctacttaatttatctccactttgctcgcctgcactatgttcatacctttctacgtcacacgctatttaattaacattttcagcacccaatatttgtaatttgttgcttgactggaatggatctcaaaatgtatctgccctgtatcacaacgtgattttcaattcatcatattcattcatctcatagagactactttcttctttttttttgccccaggagcagggctgctcaagcttcaggatgatgtacagacttgtggatatcaagatgtacaagtgatgtgggaaatgctacagagaaccgaaggtgaagttatagaaaaccaccataagcgcaagcagtttcccttctggaggatctttgtatggtccaaccatactcaatctgcaaatca

SEQ ID NO: 6087 - DNA, 822 bp, Glycine max
  misc_feature (23)..(26): n is a, c, g, or t
gacgtaggaataaacattaacannnngccacaaaagaagtacacataacaagctatcacagaaggtcaaaaaaataatccagaccttggccaatttcccagatcgagatgccacatccccatgaacgagcttcctctaaccgcaaagaaattgacttcaaagatggataaaataccacatgcctgatatccttgtcgtcagtgtaaaagaaaaaatgctccccactattcttatcccactgcagttcaggccagtgcttctccaaaagtgccaggtaatctctcccaataatagctccaccccctgcatctgcatctgcattcttaactttcactaatatgtaaaataaataaacttttacaacataatacctcataaaagctaaaaaaaagaaaaggaatagtaagtcctctaaatgatctcaaagtatcagaatggctcaaaagggtgttcatgttccactcaagaaataaagaattaatataaatgatgccctaatggaacattcctttcccattccccttctcctccttgggcccccctagtggagatccgttaggcaccacttcagcagatctagcaccctgtgcgtatgtgtgtgtgtgtgtgtgtgccactgtgaaaattgaaattaactacaagtttagttcaaaggatgaaggaggagggattgtcctggtacccaacctccttcattcccctccaaccaaacatgtaaaggattacgaagacaagaaacaaaggaattaccccttgaaagggagaaatcatttccatagaagttgataccaagaagtatcttgggggcaaggctttgggctc

SEQ ID NO: 6088 - DNA, 858 bp, Glycine max
  misc_feature (827)..(829): n is a, c, g, or t
ttgttcacttgttgttcggaccagattgattcattcccttgaatggaatactgacatggaaatttttttcacctggatattctcaagggacaggccaaaagggaaagaagttgtgaaatatgaaaaagctgttgatcctcaatatcttccaacacagtctgatgttcagaaggttcttaatggctctatgaacagctttaggatttataatgtttatccaagatatttccgtgtcactggttcaggtgatgttagacctttggaagaggtaatctgattccgagtacatattttcagttcagaaatgctagtaacacattttgttatttgagttttattggaaatttcaatattttgtggattacacttatttaagaagcttcaccttcactcatgattttgtagttttcaataaattttaaccaataaaaaagaatgtgttagagggtgctgctaacactgtttccatgtgtttcttccttcaattactaattgcaggaatatttgagtataataactgcatattggcattccataggtgaccgccagaaactaaccatcttttgctcctactgatgtagtttttccagtaacactggaacttttctttctgactattgttggttatagattagaaactactagattttcttatattggagtgatagtcacgaagagggaggagagctggtgttcatttcactgataattgcaccctggtttgtctaaaatgctccaaaataactattagaaacttcaaattcaatttttcaggataatgctcttagtgctgatctcattttgaatcgcgagcaatttgagtggtnnnctccgagattttaatccatcaaatttgag

SEQ ID NO: 6089 - DNA, 389 bp, Glycine max
ctttggcatttttcaactcctccacctcacttcacacactgtgatttgggctcttgagggacctctcagaatggcaacaccccttttatgtgtaccgtactctcttctagttcttttcttgtacaacaaaatttagatgcagtttcttagatgttggtgttgctttctaatcaaaattggagttttaccttggtggcacccagattatcgaggtaaaactctgattttgatagaaaaatgacaccaaaaacactataagaactgtatgtaagttttgtcgtgttttgtaatccttgtttgtgatgtgatgatttcagctgcaaactatctctacgagtctgatcatggttactatagactacatatgttatctaataaatgtacgtttg

SEQ ID NO: 6090 - DNA, 391 bp, Glycine max
ctgatgaaaacattggagggatgaaaacagtgagctgtttatgcctcttggtgaaagaggggatggtgatggtgatgatgatagagcaaatgttggaagtgatgagtcggaaaagaagcaggagctgtttgaagaacgtggtatgaatatttttcaaactgtctatggcggagcagttgaagctgtcccctcgagtctcagtcttaggaagcggttttttgaaatattggagggtacaaacttgtcgcattatgaagatatgtgcaaggagatattgaatgacatgaagagggatttttcaacacaaccggaattttgggactggctcgcaaggcatgaatgtgatcttgaaaatgatctggagataagtgaggagggcattattcctcac

SEQ ID NO: 6091 - DNA, 1632 bp, Glycine max
  misc_feature (894)..(894): n is a, c, g, or t
  misc_feature (903)..(903): n is a, c, g, or t
  misc_feature (1626)..(1626): n is a, c, g, or t
  misc_feature (1628)..(1628): n is a, c, g, or t
ctgtaactgcaactttttccttttctttcttagcaggttttggaggtttttcaggcaatacattttgaggtttctcaattccttgaatatcagttatccttaacttagtcaactcctgaagatgataaccatgcatcaagtagaattagcatcaaataaatgatatcaaactttacgtgataaaataattgatttccaacacacctgacgatgtcctttggttcttcggtaattttttcttctctttttcttaaaaataattacctttgcatcaagtgcctggtataaagggaaaatgagcacacatgcaagtgtatggaaagaaatcaaatatacagtggttagaaaaaccagaaaattttcattattgcatcacatggaaatctaaagctattagaaataggacaattataatgcatggatacagttcagaggaacaggcaatgtagccagcaggaaagaggggcagcacacacagaccatgataaaaggaaatcattatgagcaccattattctactatttcaaaaaccaaatcacaaggatgggtgcgatggatcaaaatggcattaggacaaaatggcaatagagtcagagacttggatctagtttggttgagaatttgtaaactttgagcaaatggtgagtggcgaaggagagtgttgcaacataggtggagaggtaccagcagcattcagaactcaaaagccattgagatgtcaaattgtagcatgataggaaaacactcaaaattattattttttgttttcagatttgggcttaatttcagcaagattttctaaaaaatgttttttaagttcaacgaaacattttcaactgtattttcaattttctttgaaaatgaaaagaggaagtggaccaaacaaacagctcntaagagacncctccttataacacaaatgcaaaatatatgattcttttttaattttgaaaaccagaggagattatgtcatttagtcacaattggcaatttaattccttttttcattatgaatgcaaatgaatgaatagaaaaaacagtaaatggaacatagatgcaactcccaccataaaaaaagtcttgaatggaacagtaaagactgagagagcagatcattctatccaagcctatgctattcctactcccatcataaaaaaagttgattctacacaatttaaatgggaagttctacacttacatgctcctcaacaacagcatgaacagctgcatctggtactataggtctgccgataattgtctgactagcagagccaagcaatagaactttgttcagaatcaactgcaatgggcaaaaatgcaatgaaatattcaattaactggcatgaaagattccataacaaagaaaatagcaaataattagtacaaagaaaacaagccattgattattatttattaagattgctgacacacttataaaacatattccaatcacacaaacaactagggcaaacaaagtagtttgtagaactatcaaaatggtaagaagcaactgtactttaacaattgttgcacatgttagcacatacaagagttaggatcttctagtaaaagagacattcaccttgtcattcacttcacaaaacttcaatctttcagtgaaaatgngnctcg

SEQ ID NO: 6092 - DNA, 682 bp, Glycine max
attatgaaaagggaaaaaaaatagcaacatcataccgcatgcaaagcttagcatatggacaattcacaaatatgtaaaaaagcacagaagaaactgatgcatgaaactcctaaaggcctaaacacaagtagataccacagatatgtaattaaaatagcaccaatcatgctaagattcataaatcatacagtaattcctaaaggtctgtacggtttacaacaagtacaaaagacaataagcaaacaggcctacaaaaccaacagtggcatatgagggtccttgtgaattgaaatgaaatagagaacaatccaacgcaaaaaactttacctgaaattctcgtactttgaacgttggactaagaattgcacattccaacgcacatcccctagcaacacactcactagcattcattgtccgcctaggctcctttttgaaaaactctgtcaatattttgttaatggccggcacacgagaacctgaaccaaccacctcaaccgtgtgcacattttcgacggtaagacctgcttcagcaagtgccttctccagaggccccttcacacgttccaaaattggaagacttagttgctcaaattcatctcgcttgatgaagccccggacatccttctcatccatcaagcactcaatgttgagaggtgcctcaggatttgcactaagcatcttc

SEQ ID NO: 6093 - DNA, 788 bp, Glycine max
ctatcttctgatctaggtgtatttggctatacatctagaagattcttctataagcttctataaatctgcaaagaaacaaaccagagcaacaaaagaaaaatcatttaccagaccataagcaaatcctgaggagatttttactagtaaagaacaaaccatttttccaagttagagagggaaaacaaaaacttaccctaataaaaattatccccagctggccacttctattcttattacctacaattcaaatcttgaggcacaaaatagagccaaagaaaagtgtatcaacttgttagaagaagtctatccacatttattatgcaaggaagagtgacattcagagagcaattagcagtaccttgaattgtaaacaaaactaatgggaggccacatcactagaagaggttgtcggttctagcttgtcctgagaagatgagctagctgaaaatacagcactctcattgacctctgccaatgtagagaagtcagcatgataacctccagctgcttttgttggtgaagcaaagagactatcaggaagggcctgccccacacttctccagggccaagaaagcatcatgaaagaacacaatatcagaaaatttgaaatgaattgcacatatcctcaacgagggcagattaacatgaggaccgcccccaaaatgctgcagtacaatagaaataagatctgaaacaaaatcaatgcccatacctattactaagatctacgccttcggcatttccactctccattaaattcctgctctcagaatcatcaatgtgagctg

SEQ ID NO: 6094 - DNA, 567 bp, Glycine max
cctttgatatataaagtgaaactttttacattttttttaacacaaatattaatttgttaattttgttagaaatattagttgggattcaaccaccaaatgacatttcaaagacatttccctaattggggatcttaacttttttattgcatgagcaggagttacttccttcaacatagattttgcggcgaagaaggtgacagtggttggggatgtgactccattgagtgtcttggctagcatatcaaaggtgaaaaatgcacagttatggccagcatctgcctcagcagtgggatctggtactgttgaaacaaagagaaaaactttatcttattaagaggaaggtagaatattggttttgatgtacgcttgagtgtgaatcggatggtaatttaatagttgtaaatgcaaatgctagcaagattagctgagtcttaacaagtagtaaaaagtaggtagaattttggagaaaaataatgaaatttgcattttttatagtataaatttaacattctttaggaaatttattgtaataaaatctgaagtgtgcgtcatgaagttgacatgtta

SEQ ID NO: 6095 - DNA, 410 bp, Glycine max
catccccaacacaaccaaaaccacaaccccaccattccttagtcctattgcaagtgcccatataacgaaaacaacgagtgtcataacgttgtacgcgaaaaacgccacaaaggtgcataaaaaagttaccatgagtcttttccatactttgggaacaacgttcatgactttggagaaggtgacttctcgtgaagtgtagattgaggccacggtgtagaccgctgctgaggtggataagagggagaagacgaggaggaaggtgaagtagaggagcttgaagagaatgaaaatggcccattcggaagagagcatgttggtgaggttgtggtattggggcgtgtcttgtggggtttccatcatttgttgggtgttgtggaggatttttccgaagaggatgttggagacttcga

SEQ ID NO: 6096 - DNA, 1460 bp, Glycine max
  misc_feature (384)..(385): n is a, c, g, or t
  misc_feature (388)..(389): n is a, c, g, or t
  misc_feature (469)..(470): n is a, c, g, or t
  misc_feature (538)..(552): n is a, c, g, or t
  misc_feature (554)..(558): n is a, c, g, or t
  misc_feature (560)..(562): n is a, c, g, or t
  misc_feature (570)..(575): n is a, c, g, or t
  misc_feature (582)..(584): n is a, c, g, or t
  misc_feature (586)..(587): n is a, c, g, or t
  misc_feature (589)..(593): n is a, c, g, or t
  misc_feature (595)..(602): n is a, c, g, or t
  misc_feature (607)..(610): n is a, c, g, or t
  misc_feature (622)..(624): n is a, c, g, or t
  misc_feature (646)..(650): n is a, c, g, or t
  misc_feature (653)..(677): n is a, c, g, or t
  misc_feature (679)..(679): n is a, c, g, or t
  misc_feature (685)..(686): n is a, c, g, or t
  misc_feature (689)..(700): n is a, c, g, or t
  misc_feature (705)..(710): n is a, c, g, or t
  misc_feature (713)..(720): n is a, c, g, or t
  misc_feature (722)..(726): n is a, c, g, or t
  misc_feature (728)..(730): n is a, c, g, or t
  misc_feature (736)..(737): n is a, c, g, or t
  misc_feature (740)..(740): n is a, c, g, or t
  misc_feature (742)..(742): n is a, c, g, or t
  misc_feature (746)..(747): n is a, c, g, or t
  misc_feature (762)..(763): n is a, c, g, or t
  misc_feature (766)..(770): n is a, c, g, or t
  misc_feature (778)..(781): n is a, c, g, or t
  misc_feature (790)..(792): n is a, c, g, or t
  misc_feature (795)..(796): n is a, c, g, or t
  misc_feature (798)..(801): n is a, c, g, or t
  misc_feature (806)..(809): n is a, c, g, or t
  misc_feature (811)..(821): n is a, c, g, or t
  misc_feature (826)..(837): n is a, c, g, or t
  misc_feature (841)..(847): n is a, c, g, or t
  misc_feature (850)..(858): n is a, c, g, or t
  misc_feature (862)..(871): n is a, c, g, or t
  misc_feature (880)..(899): n is a, c, g, or t
  misc_feature (901)..(901): n is a, c, g, or t
  misc_feature (904)..(904): n is a, c, g, or t
  misc_feature (906)..(911): n is a, c, g, or t
  misc_feature (917)..(918): n is a, c, g, or t
  misc_feature (929)..(933): n is a, c, g, or t
  misc_feature (935)..(936): n is a, c, g, or t
  misc_feature (947)..(952): n is a, c, g, or t
  misc_feature (957)..(966): n is a, c, g, or t
  misc_feature (969)..(978): n is a, c, g, or t
  misc_feature (985)..(997): n is a, c, g, or t
  misc_feature (999)..(1003): n is a, c, g, or t
  misc_feature (1015)..(1020): n is a, c, g, or t
  misc_feature (1025)..(1026): n is a, c, g, or t
  misc_feature (1028)..(1035): n is a, c, g, or t
  misc_feature (1038)..(1050): n is a, c, g, or t
  misc_feature (1052)..(1053): n is a, c, g, or t
  misc_feature (1055)..(1056): n is a, c, g, or t
  misc_feature (1062)..(1062): n is a, c, g, or t
  misc_feature (1073)..(1078): n is a, c, g, or t
  misc_feature (1083)..(1087): n is a, c, g, or t
  misc_feature (1089)..(1097): n is a, c, g, or t
  misc_feature (1103)..(1105): n is a, c, g, or t
  misc_feature (1108)..(1118): n is a, c, g, or t
  misc_feature (1126)..(1131): n is a, c, g, or t
  misc_feature (1133)..(1136): n is a, c, g, or t
  misc_feature (1138)..(1148): n is a, c, g, or t
  misc_feature (1151)..(1151): n is a, c, g, or t
  misc_feature (1157)..(1167): n is a, c, g, or t
  misc_feature (1171)..(1173): n is a, c, g, or t
  misc_feature (1176)..(1183): n is a, c, g, or t
  misc_feature (1190)..(1193): n is a, c, g, or t
  misc_feature (1196)..(1198): n is a, c, g, or t
  misc_feature (1200)..(1207): n is a, c, g, or t
  misc_feature (1213)..(1228): n is a, c, g, or t
  misc_feature (1233)..(1239): n is a, c, g, or t
  misc_feature (1241)..(1242): n is a, c, g, or t
  misc_feature (1246)..(1247): n is a, c, g, or t
  misc_feature (1249)..(1252): n is a, c, g, or t
  misc_feature (1254)..(1260): n is a, c, g, or t
  misc_feature (1265)..(1278): n is a, c, g, or t
  misc_feature (1280)..(1286): n is a, c, g, or t
  misc_feature (1288)..(1298): n is a, c, g, or t
  misc_feature (1301)..(1301): n is a, c, g, or t
  misc_feature (1303)..(1313): n is a, c, g, or t
  misc_feature (1318)..(1321): n is a, c, g, or t
  misc_feature (1323)..(1324): n is a, c, g, or t
  misc_feature (1326)..(1339): n is a, c, g, or t
  misc_feature (1347)..(1349): n is a, c, g, or t
  misc_feature (1353)..(1371): n is a, c, g, or t
  misc_feature (1373)..(1376): n is a, c, g, or t
  misc_feature (1378)..(1382): n is a, c, g, or t
  misc_feature (1386)..(1392): n is a, c, g, or t
  misc_feature (1394)..(1401): n is a, c, g, or t
  misc_feature (1403)..(1407): n is a, c, g, or t
  misc_feature (1415)..(1417): n is a, c, g, or t
  misc_feature (1421)..(1441): n is a, c, g, or t
  misc_feature (1444)..(1456): n is a, c, g, or t
tctgttctctgcacacttttgttgtcggcggttttggtccaagaagttgaggcaagagtaatcagcaaagaagcaatgcagcgtaacaccattcctggatgcagcaaagtacaccccaatgtcgccgcttgtcatctgccattagttaacatcaactatagaagaggttgtgagccaggagaaagatgtcgccaataagatccagatcgaggatgatataagccagggactcggcctttgatcaatttcttttaaaaaccatgtgtactggctacaatatgtaaaaggacattaccttgtacaccaagtaaaataatgaaatttcatctttgtctttccgtaaagttaatatggattggcgataacatctttctcctggtttannaanngcctcttctatagttgatgttaactaatggcagatgacaagcggcgaccttggggtgtactttgctgcatccaggaatgnngttacgctgcattgcttctttgctgattactcttgcctccacttcttggaacaaaaccgccgaccacnnnnnnnnnnnnnnngnnnnngnnnctgcatcnnnnnngtcattnnncnncnnnnntnnnnnnnnttcgnnnnttttacaaatcnnngagcatggaaagatacattgannnnnggnnnnnnnnnnnnnnnnnnnnnnnnntnttcacnnccnnnnnnnnnnnnccgtnnnnnntcnnnnnnnntnnnnncnnntccctnntcnancccnnttctcccttctaccnncannnnnaccccccnnnncctcctcgnnntcnncnnnnatctnnnncnnnnnnnnnnntaggnnnnnnnnnnnncccnnnnnnnccnnnnnnnnnatcnnnnnnnnnnaaatcatcnnnnnnnnnnnnnnnnnnnncntangnnnnnncctccnncttctttctcnnnnncnnttccctcattnnnnnncccgnnnnnnnnnnccnnnnnnnnnnttttccnnnnnnnnnnnnncnnnnncccctccctccnnnnnncccanncnnnnnnnnttnnnnnnnnnnnnncnncnncctccntcacccccctnnnnnntcccnnnnncnnnnnnnnncccgcnnntcnnnnnnnnnnnctactctnnnnnncnnnntnnnnnnnnnnntcnctcttnnnnnnnnnnntctnnnttnnnnnnnnttccaannnntcnnncnnnnnnnnctccgnnnnnnnnnnnnnnnnccccnnnnnnntnnctcnncnnnntnnnnnnnctccnnnnnnnnnnnnnntnnnnnnntnnnnnnnnnnnttnannnnnnnnnnncttcnnnncnncnnnnnnnnnnnnnntttccccnnntgannnnnnnnnnnnnnnnnnncnnnntnnnnnctcnnnnnnntnnnnnnnncnnnnnctttctcnnncttnnnnnnnnnnnnnnnnnnnnnttnnnnnnnnnnnnntcca

SEQ ID NO: 6097 - DNA, 1297 bp, Glycine max
  misc_feature (639)..(640): n is a, c, g, or t
  misc_feature (698)..(699): n is a, c, g, or t
  misc_feature (728)..(734): n is a, c, g, or t
  misc_feature (736)..(736): n is a, c, g, or t
  misc_feature (747)..(748): n is a, c, g, or t
  misc_feature (751)..(753): n is a, c, g, or t
  misc_feature (755)..(762): n is a, c, g, or t
  misc_feature (773)..(777): n is a, c, g, or t
  misc_feature (782)..(782): n is a, c, g, or t
  misc_feature (790)..(791): n is a, c, g, or t
  misc_feature (793)..(795): n is a, c, g, or t
  misc_feature (797)..(798): n is a, c, g, or t
  misc_feature (800)..(810): n is a, c, g, or t
  misc_feature (812)..(815): n is a, c, g, or t
  misc_feature (817)..(829): n is a, c, g, or t
  misc_feature (831)..(848): n is a, c, g, or t
  misc_feature (850)..(851): n is a, c, g, or t
  misc_feature (855)..(856): n is a, c, g, or t
  misc_feature (859)..(861): n is a, c, g, or t
  misc_feature (871)..(876): n is a, c, g, or t
  misc_feature (878)..(885): n is a, c, g, or t
  misc_feature (890)..(890): n is a, c, g, or t
  misc_feature (892)..(902): n is a, c, g, or t
  misc_feature (904)..(912): n is a, c, g, or t
  misc_feature (915)..(915): n is a, c, g, or t
  misc_feature (923)..(939): n is a, c, g, or t
  misc_feature (941)..(946): n is a, c, g, or t
  misc_feature (950)..(964): n is a, c, g, or t
  misc_feature (966)..(967): n is a, c, g, or t
  misc_feature (969)..(991): n is a, c, g, or t
  misc_feature (996)..(1017): n is a, c, g, or t
  misc_feature (1019)..(1027): n is a, c, g, or t
  misc_feature (1029)..(1035): n is a, c, g, or t
  misc_feature (1038)..(1044): n is a, c, g, or t
  misc_feature (1048)..(1065): n is a, c, g, or t
  misc_feature (1067)..(1073): n is a, c, g, or t
  misc_feature (1076)..(1076): n is a, c, g, or t
  misc_feature (1078)..(1094): n is a, c, g, or t
  misc_feature (1096)..(1103): n is a, c, g, or t
  misc_feature (1106)..(1121): n is a, c, g, or t
  misc_feature (1124)..(1132): n is a, c, g, or t
  misc_feature (1135)..(1148): n is a, c, g, or t
  misc_feature (1159)..(1187): n is a, c, g, or t
  misc_feature (1189)..(1191): n is a, c, g, or t
  misc_feature (1193)..(1194): n is a, c, g, or t
  misc_feature (1197)..(1204): n is a, c, g, or t
  misc_feature (1206)..(1219): n is a, c, g, or t
  misc_feature (1221)..(1221): n is a, c, g, or t
  misc_feature (1228)..(1236): n is a, c, g, or t
  misc_feature (1239)..(1250): n is a, c, g, or t
  misc_feature (1253)..(1255): n is a, c, g, or t
  misc_feature (1258)..(1266): n is a, c, g, or t
  misc_feature (1268)..(1277): n is a, c, g, or t
  misc_feature (1279)..(1285): n is a, c, g, or t
  misc_feature (1290)..(1294): n is a, c, g, or t
ggacagtaggtttcttttctttttttttcttctattttttcacttttttttaaaattgtttacttcttttagtgcagttatttggtatttaagtcggggattttcttttctttttctcattttttttgtgtgaatggctcatggcatattggaggaacaaaacctggggcggttgagtgtaaaatacgttttttataattcaattaattaggggtaggaaatgaataaaatgggtcatggtttttttaattattcattttctaaacattatatttgttttcggatatatataatataatggtacgttaattgatttatttaatgttaggaaaattctaatgagatttgatgggtttatattttttctgggatgtggttgatgttgttgggtaattaggttgaaggctaaaaaaacaaatcaaaaaaaacagagagaaccgagattcccgttcatgacaaaaagcgagggggatcatctggaaaatggatacagatggaaaaagtacggtcaaaaagctgtgaaaaacagcccctttcccaggtactatactaacacttttattcttcaatcaatacacgcaaaactttgcttgcttgttccctttttcactttcggttcgattaaaatttagattttannccaaccaaaaaataaatgcattgtaaatatcaaaaacactattaacatttgaatcgtnngcatatattataggagctactatcgttgnnnnnnngnttcatgtaatnngannnannnnnnnnagcgatctttnnnnngaccnaagcattnngnnnannannnnnnnnnnnannnncnnnnnnnnnnnnncnnnnnnnnnnnnnnnnnnannaacnnttnnntcgggaaatnnnnnntnnnnnnnntgganannnnnnnnnnnannnnnnnnnaanaccagcannnnnnnnnnnnnnnnntnnnnnntgtnnnnnnnnnnnnnnncnntnnnnnnnnnnnnnnnnnnnnnnnttcannnnnnnnnnnnnnnnnnnnnnannnnnnnnncnnnnnnnccnnnnnnnaaannnnnnnnnnnnnnnnnnannnnnnnaanannnnnnnnnnnnnnnnntnnnnnnnnctnnnnnnnnnnnnnnnnttnnnnnnnnnttnnnnnnnnnnnnnntatttcctctnnnnnnnnnnnnnnnnnnnnnnnnnnnnntnnnannccnnnnnnnntnnnnnnnnnnnnnncntcatctnnnnnnnnnttnnnnnnnnnnnnttnnnatnnnnnnnnncnnnnnnnnnntnnnnnnncttcnnnnnttt

SEQ ID NO: 6098 - DNA, 832 bp, Glycine max
tacaatccaagcaagaggaaaagttagtgaagatgttcgatctggtaagttgaaaaatgcattctgtgcaaggctttcttatgtaaactttccattgactgagcagccttgtgaaaaatttgttccccatgcctagtatctgcatataatgaggagcaaaacatgaattatcagaatataatatgattatagatgtaagttctggctttgagtattatgaactcaatctggaatctggaaagtttttgcttagtttatagtttttctttaaattccatcactcaatgggggatactgaagttattagttggaaaaagaggcttaccaaactaaagttgacaaaaaggatatgatgacttgacatttgtaacatatcactttgatgtacttatcatagaatccgaaattaattgttttatgttgaatcaataagaaattgatttagttgcagtaatggctatggtgtgtcattttctattatttgtgtatcgcttgataggaaatttctctgtttatcttgttgcgaactgctgcacattttctttatgcagattcagaagatgaagatgaacatgaagattgagtagggaagcaaaagcacaatgtattctttaggcaaaggtgaatctaaaatgatgacaaatggttttacactcaaacatgatgaatattgtcgtatgttatgtggatttattttatgttaaattgtccatattttattttatttttttatataaaaaagagtcagtttgtccatattttattttatttttttctataaaaaagagtcagtttgtccataattatattgtaaactagaaacttaagtttt

SEQ ID NO: 6099 - DNA, 399 bp, Glycine max
tcctcagagcacagaccatggaactcgccgaccggttaaggtttctgaactccattattgagatcgccgatgaggtcggcggcgaatccttcgagattccgcagattccggaccctctcttcatgccctggcagatcccccaccctatgatggcaacgccgcctgacatgttcttccatggaaatgaaggcctgtttgcttgatagtacttctaattaggtttattgttgatgttcgttccctagtgttgttggtgaataaagaaagggaatggtggtgtatggtgttaattaatgagtcatatcgcgtgttggtgtgctttttgtgtgtgtgtgttttagatccgtgactatgttttgtgtatgcagtatcgttacatggttgaacgtatctgctttg

SEQ ID NO: 6100 - DNA, 505 bp, Glycine max
aaaaaaaagttacgatttttataccagcaatcaaacaaattttgtacccatcaaatctctaactaagtctcatttctcgattcatctctctcattgagctgcattgcaacactcactcaccaatggcactcagacccatcgacaacgctcttccaacaaccccagagagacctaaaaaacaacccaaagtcgctcttgcaacccaaaagcaacaagaccgtgctggcgtcaatggcgaaaacatagttccattgccctcatctggggatgccactgttgactatgtctcctccgacaaccttaagcccttgtcggaccctgaagttaagattcaggtatgtgtatgttcttgtttttgctcatttgtgccgttaaaaaactcaaattcacttttcttcggagcattaaatttgaaagcaaaacatctttggaaatgcagagcttggttgaagatttggattcgaaaaattggacgaaggtttgtgagtcgctgaatgatgttaga

SEQ ID NO: 6101 - DNA, 321 bp, Glycine max
acgtatccgaaggcaggctcaccgaactccgcgggattagcgtgaagatcctcttcttctggctcaacattctcgacgtcgttcgcgtcggcgaagacctcgatttctccgtcggcgtcgcctccgcttcctttcccctcgataacttcttcgtctccccgcagtgtggttgcggcttggattgcgatgattttcgaattaggaaactcgatttgggaaaccgaaaaccctccctttcctctgtgtagaaatcaagttcaattaaactctcctttatttaattatgattattatctgtggacgcttgtgctctatgatata

SEQ ID NO: 6102 - DNA, 362 bp, Glycine max
actgtgtacaaaggtgcttatgttgacaatcttgaagaataaaattttcatgtcatagagattcgacaaagtttaacgttggctgtggaaagcctaacacaaccctctccttttatccgggcttgggaccggctaagaatagcaaagctaccctaggcaggaaatcttgaagaataaaatagctaaaaaaaatctccaatgccatttctataatgccaaatgtctgtgggaagacattacctcctctcaaattcagattcttggcaatgtggatctaaccaatccttggttgattcctttgcattgttgatgcataattttcccccacccacaagctccctcaggttatccaccttattcaa

SEQ ID NO: 6103 - DNA, 384 bp, Glycine max
tcatgttcttgtatctgcgctttataggttgccactatttattagattgtttattccaaatggaaccaaataaaatttattgcatccaatacctgtattttctaccctgttccctcaattagaggttatgggatattctaatagagcgataacttttgattccattttcttctcaaacaatgaaatagaaacattaatccatttcatcacaaaatatccaaacactggtaacataatgttattccattccatcccttttatttccatttcattccaccaatcagtagatagtcaaacatagcctaaggattcaaaagaagtcatcacaaggttgttttccagtcatcaaaacgtttattgcaccttcgtgagtcaaatttgttc

SEQ ID NO: 6104 - DNA, 1272 bp, Glycine max
  misc_feature (1254)..(1255): n is a, c, g, or t
  misc_feature (1259)..(1268): n is a, c, g, or t
ggagtgaaaaagagagacccttttgaatggagtctgttctaagccacgttggtgcaggtttcttcaatggcatgatcccaaggggagttttaggtacccatttcaaggctagttcctttgttggtgttgatggtgggaggccaaggcgtgtagtgttggtgaaagctgaggctgtgagcataaacccagatataaggaagagtgaagagaaagtggtagattctgtggtggtaactgaactctccaagcccctcactccttattgcaggtaaggttcagtttgtcaagctcttactttctggataattctatcgttatgccatacttttctatgccattatgtgcttggttgaggaggtagctttcttctatttttatttgaggtagtgtgcaacaggaggactgaaacttctttctaatttctatgatgttaacatgtttgttggttttaaaatgtgctctatcatgaaaatataaaagggaatgattccactaattcgtttccacaaaaactctaaatgttttcactttggttcagggaaataaattcttttgatagcatgttactatttaattgtgataaattaagattattttttctataaattttcattgggagccaaatgaaatagaaagggggaaaaaatagaactatactattttcattatcacaggttctgctctcaattttcatccagaagagtgtattgtatgcaccatatcattgaagttaatgtgtttaaccagtacaatttagaaaaagaaaatatcaattgttcgagaatcaatagcctgcttggtgtcattcatggtcaaatgcagagttgtgaagctttagtttgttgcttaaaacaagttgcatgaatatgaagatgaattattctggtttatttcatgctccagtgcattgaatattcatttcatatcaaagtataatcaacatctgttctggtatcaaatgtcctcaacaggataatgttcaacatttgatgcatataaaacaagttttagcctaggtagttgtactactttcaagtcccatttaaaaggtaatggcaaaaggacatgtttgatgtggtttggaagttaagggttgaaaaatgaagcattccttagaatcttgtatcaagtggaaagtcttgattttcccctatctatagtgtgtgtttgatgcaatttgaattccaaaaatcttatctttctgagtgcttgggtgcagatgttggagatcagggacttttcctctatgtgatnnaagnnnnnnnnnngcac

SEQ ID NO: 6105 - DNA, 626 bp, Glycine max
  misc_feature (570)..(575): n is a, c, g, or t
  misc_feature (579)..(579): n is a, c, g, or t
  misc_feature (581)..(581): n is a, c, g, or t
  misc_feature (599)..(599): n is a, c, g, or t
  misc_feature (601)..(608): n is a, c, g, or t
  misc_feature (611)..(613): n is a, c, g, or t
  misc_feature (615)..(615): n is a, c, g, or t
  misc_feature (618)..(622): n is a, c, g, or t
tatagaatatactagattttgtcattcttctatgctttcctaatgcctaagtacctaacctatgttatttgtccatgttttaccagctttaccctgtgatatcatcatttggtgcacagattttcttttcattagaacgtgctgcatctccttattttggcataaaggtaaatgggaatctctctgagtacttgattgcttaacttgctttctaaatttttttgttgttcctacaaatgtttgaagtcctatattcagctgtactctgaattctgcccgtgcgttttgctgttatcacagtttagactgttgtttctactcttctgaagcatctttagcctcaatttatcatttgggaacaaaatcagcttccctctcaatatatcaattaataaactattatatccaaataaatttcatgataaaaacattcaaacaaatcagtcaaatattatattcattgtcaaattgaaattgaaaatttaacttgctttagttttgtcaaactgagtgttaccaatcttagtgttggcatcgtcttaaaattaattaatgatttgccctcaaacnnnnnnggtnantatttgttttatgacagncnnnnnnnntgnnngntcnnnnnatat

SEQ ID NO: 6106 - DNA, 333 bp, Glycine max
ctttcatggagacaagtggattgtcacatcaacaatcaatataactcttgtttctggaagttagttgcatctggaaaaagcaaaagggaagcccagaacagtttaaaaggtggtcagttgcaaaagaaaattgaggaattggctattgactacaataaattaccagtcatgtaccgacaaggatcctcaatttatagggacaaggtagacaatgttctaattcatcaggagaatggagagtctcctgaaaattatggaaaggttattgtaggacattttgacatcattggaccaaccttttggttggaacacccaaacatccttgatgaatag

SEQ ID NO: 6107 - DNA, 382 bp, Glycine max
tcacctaaggtacccacagttcaaaagagtgctcacaaagggtttcttgacctactggaagaagcttcctgtgatgaataaattgaagttatgaaagtgtcaagatatatgcaagcaaatagtctcattagaaaattttgacttgtaaatgctggttcatgtaagatttgtagcaatgaggctggtgcattttatctttgttccacctagacgacaaaagaattcattcatgtacttacaggcgacgcatgctaaatgcgcattttgttattttctctctaatgcttcttctctttatcaatattctcagacctttttattttggtattaatatcatatgacatatgataggatggcatacgccagtgttctccaacttcaa

SEQ ID NO: 6108 - DNA, 505 bp, Glycine max
atttaatttcaattctagttatgtgggtgaagacaatcatagttcagattcatatttcaaaaccaaaaacaaccaggatgataacaacagaaacaatgcttccccaactaatatagatgttgattcacatgtcaatttctttgactcagagagtgatgttacacaacatgaggtactgaatcagtttgatatcatattttatatatcatgtggtattgtttcgtttaccactctactgagtcttcatactttttaaacatattgttgttattactattctttctatttccagaagcccctaacaagcccagagaatcgtagggaagccttacctctgtcaatttttggtgatgagacaccagatactgatgaacatcctgtgtctcaagatttatctccctatacaccctcatccccaataaggaacagcttcactagccctggttccaacttttctatcaatgacatatggaatttatataatcaagctgaaaaccaaagttct

SEQ ID NO: 6109 - DNA, 389 bp, Glycine max
ttatgctagcatcatgactgtaagtatataatctctatgattttctagtatctgggttgtgtctttgaatttcttattaattcttatcatcattatatatttgagttgtgacttctttgtaatataactttatacaaatctcagaaagagacagaatatcactaacagaattgaggtgaagagttatattattcaacccaatgagaaaaggttacacctcggtttatataggcagttacacaaaagtaactgtcaactgactctagtcagttaactataaaggcacactaaactgtagttaggcctatacatagaagctaagaaaggaaaacagtctatcgagtaaatatactcctatacccccccctcctcccgcaagctcatgagag

SEQ ID NO: 6110 - DNA, 904 bp, Glycine max
tttgagtactgttatgaattaaggtgatttatagcttgagagaagcctctactactactttttcctttaaatttaaaccatcgcactgattttgactttacctgcagtcctaaccagactgttgaactttccattaatctgactatgaaaggtggagacaattatcttgtcacggaccctatagtaacggtcagtggtgaggtgagaacataaaatccaactttgggtttccttaatattaatatctaatgattttcagccctcttaacctcataaatgtttcttgtaatgtccagggtattaacttactttgtttgggagtcctgaaaagcaacaacgtgaacattataggacgtgagtattttaattgaagaaaaactaaattatatctgactatatatgatcttgaagctttcatttcagattactttgtcaattcatgcttcttatcaatatagcagccacaactgctatattcttattagaccttcttatgtttcttctgaaattctttagcattcgccaatgcctgtcttgtttgtctgtttttaagtttaacaaatcacacatcaatactatgacaaaaacacctaaacttccacagttattgttgatgcattgatacatacctgaaatattcgttgtatttatcttcatgcagaaaatttcatgactggttaccgtatagtctttgaccgtgagaacatgattcttggttggagggaatctaactgtgagtacagttcacccctattgcttcagtacactgcatcctttctccattaattattcttaatgagacatgttattcacaggttatgatgatgaactctctactttacctattaaccgatcaaatacacctgctatttctcctgccatagctggaatccgaagcaagatc

SEQ ID NO: 6111 - DNA, 479 bp, Glycine max
tttatccatttgatgttcctttgattgtcattctttgtaaattgagaaatctacagatttcattgacatgtggtgataaatgtgacaaacaaatctacagattcatgcagagacctaaacttttctactactgatgtttcttccaggacaagattttaatcagaatgcagagagttttaatcctttgcattcttcaagctgccaagtagttggacaaactcaagtagcagctcccattctaccttcacagggtggaattgttgatggtatgctgaaacaggaagtctctactgagaaaaaatacactactgaaccaaatatcatggatgctggcttattacaagttagttcaagagatcctcctccaactgagaacgtggtaggcaaagaacagcttgctcagcttaccaatctctcagcctcactggctcatatccttggaacagggcaacagctgccacaactttatgctgctttaa

SEQ ID NO: 6112 - DNA, 364 bp, Glycine max
cctcatggtgacaccgtttgtcccatcccctggctcggatcgcgtgtcccgatcgaaccccggtgcctggctcattctccgccccaacggggcctcagagagtagctggaagccatggggtcgtctcgaggcgtggcgagaaagaggtcccgttgatggcttgggctacaaggttgagcttttctctgacaatggaccagccaatagaatacccattgccgaaggcacaatgagtgtcaaaaagggtggccagttctgcattgattacaaggtcatgaaggatgctggattgggttcaaggttgccaggggaagaaggctttgtgatgggttcaactgtggatggtgaaggcaaagttagcaag

SEQ ID NO: 6113 - DNA, 649 bp, Glycine max
  misc_feature (534)..(543): n is a, c, g, or t
  misc_feature (546)..(557): n is a, c, g, or t
  misc_feature (559)..(561): n is a, c, g, or t
  misc_feature (572)..(576): n is a, c, g, or t
  misc_feature (591)..(593): n is a, c, g, or t
  misc_feature (599)..(601): n is a, c, g, or t
  misc_feature (610)..(610): n is a, c, g, or t
  misc_feature (612)..(612): n is a, c, g, or t
  misc_feature (618)..(620): n is a, c, g, or t
  misc_feature (623)..(623): n is a, c, g, or t
  misc_feature (625)..(625): n is a, c, g, or t
gactccagagagctgcgtccttgtttaatccacaacttgttgaaatggtcaaaggactcaatcaagagattggcgctcacgtcttcattgctgtaaatgcatatgaaatgcacatggatttcgttaccaaccctcaagattttggtacgtacgtgcactattatttcatttcatttagtttttaggacagaaattaagaaagcatattaaacttttactatggacttgggccaacaggatttgttacatcaaagatagcttgttgtgggcaaggcccgtttaatggggttggactctgcacacccctttccaacttgtgtccaaatagagacctatacgcgttttgggatccatttcacccatcggagaaagctaaccgaatcatagtccaacagatgatgactggctctgaccagtacatgcaccccatgaatcttagcaccatcataatacttaagtgcttatctgaattcccttggaaccaattaccggcatggggcaaattttgccactgggggatccaccattaggaannnnnnnnnnaannnnnnnnnnnntnnnctccttagtcnnnnnaggtctgaaccaagnnnatcctnnntatgtatantncatagnnncgncnctagaacatttcggatgatggcat

SEQ ID NO: 6114 - DNA, 352 bp, Glycine max
cattgagggtatgcgtggaggacactggaattggaattcctttctcagctcaggataggatattcatgccatttgtgcaggctgacagctcgacctcacgaaattatgggggtactggaattggcttgagtatcagtaaatgtctggttgagctaatgggtggtcagataaacttcataagtcgaccccaggttgggagcaccttttcttttactgcagtttgtggagcatttaagaaaagttcagttactgacaagaaggaaaatttggaagatctgccttcaaattttagagggatgaaagtcattgtggttgatgggaagcctgttagagcttccgtgactaaaaaaaa

SEQ ID NO: 6115 - DNA, 676 bp, Glycine max
  misc_feature (60)..(61): n is a, c, g, or t
tgcagctacacttgagcatggcatgcatcctcctgtgtcaccgaaacccgaatggcgcgnnctcatggatgaaatggctgtcattgcaacaaaggagtatcgctctgttgttttcaaagaacctcgttttgttgaatatttcagatgtgtaagtgctgcttatactcagtcttcagttgttaacctttgcttagaagatacccttcgaaaaatctagtagcttaaatggttggtaatttgaaacaaaaatgataacttggttaaggtagtcataatttgacttttaaagcagttattataaaaatcaataaacttactaagttactatccacgacaatgtcattgagtgactgtgcgcattctaattaaactcttgacaattttcatttcaatactctataaaattcatggtgtatgctctttttccctcctttggagtcatttaactaatgaaaatacttatgacactgtaatttctttcctttgattctgtttcatttatgaatattgtgcactgcaggcaactcctgagttggagtatggaagaatgaacattggcagtcgtccatcaaagcgaaagccaagtggaggaattgaatcactacgtgctattccttggatttttgcatggacacaaacgaggtttcatttgccagtgtggcttggttttgggtca

SEQ ID NO: 6116 - DNA, 772 bp, Glycine max
  misc_feature (158)..(164): n is a, c, g, or t
  misc_feature (759)..(766): n is a, c, g, or t
  misc_feature (768)..(769): n is a, c, g, or t
aactttgaagtcgacagtctcaaggtccggaactgtaaccaagctccaacacagaaacaattaattaattacgcaattaaaaggaacaaattaacagaaatctgtatgttaaatactaattagtaattaccactcatcaacgcctcctcaagattgcnnnnnnngtagtgcctatggaagcagctatgatgccagcttaggcggtggatatggggggcctgctggaggctcattttatgggactagagggggatacgcaggtgcaggaactggtcgataccatccttatggaagatagaagcatgtcatcgaagacttatagtctaggactaatatttctagcatcaaagcaagtttgtagtttgtttggttattcagttctttaggctacatatttttattttctaaaaaatggaaaactgttaatgatattgttaagtcccattagttattagcagcaccctctcgccagcctatagatgaccgaacaattttttagctcggccagttgaagtatgactatcggattgatgtatgagctgcaaattgtgcagatggttgtattcttagttttgttaatggctacctttgtcactactgctcaagaggcggagttggtgacagagagattcgaagagtgtttgataggttttaccggaatcggagccacgatacccggttgcagagaaagagaagaggggttgcaaatagtaaacatgtttccttctgggaattgaatttgtttcactgtacgacacnnnnnnnntnnttc

SEQ ID NO: 6117 - DNA, 393 bp, Glycine max
cctttatgatacaaaaatccccaatccccaaccgttaatttttcaattttttatttttattttttggtttttcttctaatggcgacggatgcaagggcgaagttccaaaacccggaattccggcccgatttccacgcggacttaacggtgtcaactcacgacggcctccacttctggcagttcatgatcgccggatccatcgcgggctgcgtcgagcacatggccatgttccccgttgacaccgtcaagacccgcatgcaagccataggctcctgccccgtcaaatccgtaacggtccgtcacgccctcaagtccattctccaatcggagggcccgtcggccctctaccgtggcatcggtgctatgggcctcggcgccgggcccgcccacgcc

SEQ ID NO: 6118 - DNA, 356 bp, Glycine max
ttgtttgatccattgtattcttctgcaaagcatgacttcctcttttactttggcgggagaagctgtatcagaaccacattccaacagcatatatttccatgctatagattagaagccttcgaggtccttcataacaatttttctgctgcacaaaggttctggcaccgtagtttgttagtaatgtatctttttcagaggcgtaaagtcagaagaagatagtaatgcagcgaaacttttggttttatgtgatagattcgtgatgggatttgcaaattttgctcgaactttgtagagttggttggttcatgtgcgaattttgttgactgaatattagggacagagaccaagatgtctaa

SEQ ID NO: 6119 - DNA, 382 bp, Glycine max
gttgagagagcatttgtcaaactaaaaggcatcactaagaactcatagtgttcttcatgatgagtaccaaatgctgtcttaggaataatttggtgataaccagatttgagaaagccatggcagcacccaattcatctaataattcatcaatgataggaatgggaaatttatttgggattgtaacctgagatagtcatcacaaaacctccatctgccccatcctttttttaccaaaatcacaaggcttgattaggggctactgcttggtctaatgattcaagccatcaacatgtcattaatcgttttctccattttattattctgataatggggtaacttgtagggtcttaaatttggaattgttgctccttgaggactatga

SEQ ID NO: 6120 - DNA, 813 bp, Glycine max
  misc_feature (16)..(16): n is a, c, g, or t
  misc_feature (802)..(808): n is a, c, g, or t
  misc_feature (810)..(810): n is a, c, g, or t
ttcttgccttgctgcnggggctccactgttcttgtaagtgaacaagcttcactcatattgaacaaccctagtatccaaagactttgcatgtcacagaaggcagtttaacccatgacatgatgacaaatcttaataaaacaatctttttaattcattttatcaaatacattctttattattgaccaaattttattgagataattatataagaagtgaaatttatgttatttcataaatctttaataaatttcaaccgataacaaaaaggttttaaagagtgtgttttagaacctattattagcatttaactttattgttgtcggtgctgtatacacaaaaaaatagagagaacattagaaatatgtaagattttgaaggttatttgattctttaaaacagagtggaggacctaattgggaactcccattagggagaagagactcaaaaacagcaagcttaagtggctcaaacaaaaacattcccccaccaaatgccaccattgaaaatcttgtgacatttttcaagcgtcaaggccttgatgaagtggacctcgttgccctctcaggtggaacttcaacttctcattttatttcctagtaatgaatgagtcacatatattaacatttttattaattataatgtaggtgcacataccattggggtggcaagatgtgtcacattcaagcagagactatacaaccaaaaaggaaacaaccaaccggatgagaatctagaaaaatccttttactttgatttgaagacgatgtgcccaaaatcaggtggtgacaacttcatttctccnnnnnnncnttt

SEQ ID NO: 6121 - DNA, 330 bp, Glycine max
ggactcccaatcaactgagacccctggcctgctcctgctccatcctacatcgatcccatggctcggccagttgggctcaaggtgaaactaaagtgcttgctgcagtttatgggcccaaagctggaaccaagaagaacgaaaaccccgaaaaagcatccattgaagttatttggaaaccgaagactggacaaattggttggagaaatactatattcaactcaacactttcttttcattttaagaaacaaaattaatatactgtttacattggtttaggaaaagtggagaaggagtatgagatgatattgaagagaactttggaaagcatct

SEQ ID NO: 6122 - DNA, 652 bp, Glycine max
aatagcccaagcagaagctatggctcgtgcagacatgcttaggttccagtctgaggtatttattggtttattatttgtcctaaattctgaatccaataaaaattaagaaacagcaaggattaagtaagactataggagataaaatgaatataacaaagtcagatttctgctgctgctgaagattattggagcttctgaaatgacaagaatacaattatttaaatggtccttattagacaaggaatttcatagtgcatttgcaaaaaaaagactttggtattttatatatctgactcattttgagataagaatacatttctgcttccagcgattagcaatttattttggacctatatcatccataatttgaacacctataacagttttgatatttatttactcatttgatggacctaatttgtcaaccttattctttttgcagagtggattgactatcagcggtgatgggatcctgggaccatttacttcagacttgcctgaagagggactggatctgagtgaggtaccaccagctgaagaatcatgattcagaatatcgtgcccttttttttttggttaactttttaaaaaaatggttggaactaactaacaaaaattggtgccccaccatgccctggttttttgggagtta

SEQ ID NO: 6123 - DNA, 1141 bp, Glycine max
  misc_feature (1136)..(1138): n is a, c, g, or t
ttgtttttctgatccacgagtgcgagcattgatgaatatgaagatatttgttgacacaggtcccttattattttagttccaatataacttctataacttactgtattatatttttctgtggcatttcttactatgtatggatctgttgtcaaactcattttccttttagcccgatggacttaaatttcccccctcctaatccacattataatataggagaatgcatattcttcacgttatctaaaaaatgcatattcttgttttgctaatgacactatatcttcacgttatctaaaaaatgcatattcttggtttctatttttattaatagttgcctatgtcttccttctagctattttacaagcatgcatattttatgtctttattgcactactaagttatgctatcaatttacattgtgaaatgttcagtgcagatgctgatgttcgtctggctagaagaattaagcgtgatactgctgacaatgctcgtgatattggagctgtgcttgatcaggtagctaccgtcaggcacaccatttgcacttccattatcatattttgattatcttttgcttttttgccttcacgtttcttacatgtactgcatttcaagacttggaaatgttattttagttcatgttgctgagaggctggtatgaaatttcattgattagaaaacatgtaataagtcagtttttatgaaattaaatctttaatgatcttttcgtaggttatgattataaatcaagctaatatattccttttttttgcttaccatatattagtaactgtttcttataatatatacttgatgcagtattctaaatttgtgaagccggcttttgatgactttattcttcccaccaagaagtatgctgatatcattataccccgtggaagagataatcatgtggctattgatttgattgtacaacatattcgcacgaagcttggtcagcatgacatgtgtaaaatatatcgtaacttatatgtcattcagtctacttttcaggtacccctttcttgttatttattgactttatcaatgatcccatcttcccccgttcagctggaacttccaaattcaattttttttatttattaaaagttgaatcatcacgataatgcttcgannngat

SEQ ID NO: 6124 - DNA, 460 bp, Glycine max
ctgcgatggaactcgatttggaggccaatggcttctctgccactaactcccttcacatgccaaaatctccacacgctaaaccctaggcctcgatgtcgcaccttcaagcttttttgtcgaccttcttcttccgccgtcgcgcacacctcgcctcctctctccggcgacctggaccgctacctccgctgctccatgccgcagaactcgccgctccgagtcgcggttcttgtcagcggaggcgtcgatagcagcgtcgctctccggctgctccacgccgctggccactcctgcaccgctttctacctcaagatatggttccaagtacgccgtccttcttctcatccaaaattgaattaggtcattggtaccgtggctgtttctttctcacgcgtggtttttctgtaggaagatttcgagaacttttggtctgagtgcccctgggaagacgatttgaagtatg

SEQ ID NO: 6125 - DNA, 337 bp, Glycine max
tccgggtctaaacaaggctgcaaaagctaaggcaaagaaagagaccaaggagaatatcaagaagtctcggagggaccgtttagaccctgacaaaccttctgcaactacccttgaccttctcaaggaaagctttggaaaagagaaggtggaccacagtgacgtagagcagggtgcggtggcggttgctaagcctcttgtttctgggatgatgaaaagagatgatgggtctgtgacatatgaagagcttcagcaaaggcttcgtcgcaggctcgaagagtttcgtgcaggtcgtaatactgggaattcggataggaagagggaagaaaggaatgctagg

SEQ ID NO: 6126 - DNA, 777 bp, Glycine max
acctccgatttaccgtccgccaccgccaccgtcaccgatgtaccgtccatcaccgtatcagcagaatcctactccttcttgtaactctctcattccgaaactgattaggggtttaagtttttagtcgcgttttcgcggtggtgaaattgattttttcctattgaatgtgcagcaggatttggcgttagggttggtataaagccagaatataggatcacaccgccggtatgttttgctttgctcgattctggtattattattttgaataggtcaactcaagttcaatataaaccttatttctagctcgaattagattcaaactctatacgagaaaataggttatttagcaattttaagttgtcatttaatcacaaaccattattactcctaactgatttttcccaaataaaaattggtgacataaagaaataattggtggccaatggcaaagctgaagcatcgttaatgcagatttcctatggttataaactaccctttgcttgatggccactctgttgaatatcagttttagttttaattttcatttatgcatgtagctgacctcggctagtggaatccaatggggtttattcatattagttttagccgattttttttgcttaaatttcattttgagggtgttcttctccatgccaagtgtgtgaaaatactaaagctttgcataattgatttctgttccgttagttgaatatggttttttaatggttatgacaattttgcagcctcatttatcatcccttgcgggagataatccac

SEQ ID NO: 6127 - DNA, 406 bp, Glycine max
ttttctgcatatcttgagagtgttcaggatgaagtggccgctgtactcattgcaaaaagaaccctgttacgagccaaaaaccattctgatgcaattgatatgcgagcaacaatagacgaaagaatcaaggatattgctctaaaatttggctcccaattacctaaatctaaacttcatagcttccctaaggagctttctctcctaccggagctccttttccatctcaggagaggaccactattgggaagcattattggccatgaagatgagaggtctgtgctgagaaacttgtttctgaatgcatcctttgatctatcactcagaatggtagctcctcgttgtctaatgcacagggaggggggaacttttgaggagctaccggcgtatgatcttgctatgcagtcta

SEQ ID NO: 6128 - DNA, 374 bp, Glycine max
gacctttattctttagctgatttctttttgaaacttttggttcaacattatttgaacctaacacattaatattttagtacaagaaaatataaaataacaatcacacacagttaaaaaataatacatggcaagcatggcttgattcacttgacatataataataatactcttaatctcttaatttttcaatctttattgtggtccatcccaacagcattaattaattaactcttctgcagttgcgtctgatctctcctttgttccctgtgagaggcttcatgttacccatcttgatcatagaagccttgaaatctctagcaaatgcaaaagggttcctgctataaagctccaccaacttgtcactttcactaaaa

SEQ ID NO: 6129 - DNA, 351 bp, Glycine max
aggctactaaaagtgtaaaggctacgaaaggtgtgaaggctaagaaaattaagaaggctgcgtgagttggattagtggttgatgttagaaattgcagcttgatgtggctctgtgcaagcttgtgtggttctgcttgttgaacctccagcggatttttgttttagaccacattattatggtagttgtgttgtgtcagttcagttcgtcatttctaattcaaatttactatacttgaggtttagaatgattgttaaatgggtaaaaatctaaatgttgcatcccgacaagtttagtatactaaagatatttagatattgcatgttgttggagatcgacttggaaattgagata

SEQ ID NO: 6130 - DNA, 348 bp, Glycine max
tcatgccaggttctagagcagaagcatcttcacatgcaaggaggaccatatgatcattacaactttgatgggacaatgcacctcccacagttgttcagtccagaatcagctattgcaccacctacaaattcttccttggccttatccatgaatgccatggacatccttgagtgctctcaaaacctgttgaggctcacaaccactggctgtggacttaatcttatgcagcaacaacaagaagagaggttcagtggtgactggtctttcttggacaagctactagcatcacaccatggcatggatcaaagcaaatgtaaccctcctactaatcatcatgctgcaactgct

SEQ ID NO: 6131 - DNA, 466 bp, Glycine max
catgcttttaaatcaggtattgtcttttttataatgtatatgatttgatgatgtatagtgcacttattgttgttaaacttatgaattctgtatgaattatatgactaacaggaactgcatgaggctggaggaatcgagtttgtatttccaggaacaagtataccagagtggttcgatcagcaaagcagtggacattcaatttctttctggtttcgtaataaatttccagccaaacttctttgtcttcatattgcaccgtctactgggttttttatccggtatccagaggggttcatcaatggaaaatttcaagaatttgagtcccatgagacggacgatacagaaagtatgttgggattggatcatacacatatctttgatctccaagcgtatgatttaaaaaataataatctgtttaaaaaagtggcttgggaaaaggaatggaaccatgtggagggtacatatc

SEQ ID NO: 6132 - DNA, 427 bp, Glycine max
tctgagtcaagactcatttatttataaccaccaccagctcaggtggcgcagccaaaccaaacccacaagaggttaagaacaagtagaataacaaaacccattcttcacctctctcccatcgtaataatgggtcagagcctgagttgcagtggcaaccatgaccacggcctcttcaccgccgtgctgcacggcgaccttcaaattgtcacaactctcttggattccgacccttctctcttgcaccaaacaactctctacgatcgccactctcctcttcatattgctgcagccaatggccagatcgaggtcccttctttttcttctctcacgcgttctattcacgcaaattcacttctttttctttttacatttctctttttctttcttccagattctgtctaggctcttagatggatctcttaaccca

SEQ ID NO: 6133 - DNA, 731 bp, Glycine max
  misc_feature (709)..(709): n is a, c, g, or t
ccttgtgctgctttgactgcaccagttcccatcttgcctatgacatctgatggttctgttccaaatgacaatctccctgctagtggatgtactgggtcagcatccatatcatgtctatcaggatcactgccttctcctggtacagtaaatcctactggtccaaatgatcaagctgctaatgataatgatattttaccaatgcttgatatttttaatgacgacaaatggtttgaggtgcactatatatttcttcttgtttgtgcattctttttgggaaatgctgtaatatttgtttttcgttgtgttatgttccagtgcctattatctgtagtctcctcataattcaagtgtcattttaatttttatcatttgattgtgatgtatgggttaatgttagttggatatgcctaattccagggacttatttatctgaatttaagccttaatatatgcatattgtcttgtaatatgcttgtgtatactcatttcttgacatatgttgttatgcttgtgggataacaggaggtctataatcctggtcaggaaaacattgttgaaggtgcatcaccttcagatgatttttttgagggcttggaagactacttggctggtttctcctctggccagaatactgaattcaacacaaacggaatgcggctactacaggtgatgttggtaactctgatgaattttttgagggcttgaaagnctactgggcctgctctggctgg

SEQ ID NO: 6134 - DNA, 374 bp, Glycine max
tcatccatggcatctcaaggtcacggtaacaagctcatcgtttcaacatcaccaaagagtgatagtggcggcggcggtggcggcacgggatcattgcccaaaggacagtgcttgtgctcaccaacgacacatgaagggtccttccggtgccgtttgcatcgtgggcatacagcttcaccagctaattggatgaaacgctccaagtccatgcctgccaataagcctgtggtttctgactccacatgctgatgataacaaaaaaaaactattgtgagttatgtgttcatgtgtacctttatatgatatgatatgaatccttgcttgcaactcttgaattttggcagtgttgattttatatatgctttggaactttg

SEQ ID NO: 6135 - DNA, 544 bp, Glycine max
ccctgcagtctcttgccctctcccccaccgtggatccctgaaaacgtttatgttcggagcccagaacgtcatccccgtcgcttgccccgcattgtacaccgccctcgcttccttcccaatagtcttcagcaacaatgcagtaacataacaccaacatgtcaataatgtaattcgataaagtcccacacccgagtaataaagagaagttgaagtgtatataaagctttgaggtgttggatgttagtgattatgtaactgaccttgctgatttggtaccagaggtttgggtcgaaggaagcggcggtgagaatgacttgggggaaactggtggcggatttgatggtgccgttgaatctgatgccgaagccggcatcggcgacgccgtgcagcgcttcactccaccactggtaactcgggatgccgagccggggaatcgccggtgccgtgttgacgagttgggcgagtttctcgtcgagagtgagccgcgagacgaggtcttgggctcttttggtgatggggagcctggtgttgcagaatgggtagt

SEQ ID NO: 6136 - DNA, 375 bp, Glycine max
catgatggatttcggttttctgctataatttctaacaatgtttacgcctccatctccgttataaaatttgttgactagtaaaggaggaaaacatgttcgattaattatgctgctggtgaattgctgttgagattggtttatgtgatttttttttcaccgatgtgtatttaaaaattattcgtattttatggtgatgcatgattccagttgataaaagctatgacatgtgggctgacttttggatatgatggaattttcaggtatgaggagaataatttgaaggtggggagaaaaaaaacgaatgtgatgttcataggtgacgggaagggcaaaactgtcatcacagggaaaaagaatgtgatagatggcatgacg

SEQ ID NO: 6137 - DNA, 546 bp, Glycine max
  misc_feature (395)..(398): n is a, c, g, or t
  misc_feature (511)..(511): n is a, c, g, or t
  misc_feature (514)..(519): n is a, c, g, or t
  misc_feature (522)..(539): n is a, c, g, or t
tgtaattaatttacagaactaaaaatgcattataattaattactgcatgttatagataccacatgcagaaaaaagtatgtatggaggtttttagaaattattgttatttgatatcttaaaatcaaattctgcaataggaaaaaaaatcaaacaacattgagtttatccagctaaaaactacattaccgcatgaaaagtggcatggggtttccttttcttttcctcctttcatgaaaaagaatgaggaactatagtgaattgaaacccattatacaagaactacagttgaaaagtacattgacataaagaatcaagagtctcagaagtttgctttgccacttgatacacatgacacacacacccatagaggtgagaactgggaacctaaaaaaaannnntgtgtcatgtgtatcaagtggcaaagcaaacttctgagactcttgattctttatgtcaatgtacttttcaactgtagttcttgtataatgggtttcaattcactatagttccncannnnnnttnnnnnnnnnnnnnnnnnnaaaggga

SEQ ID NO: 6138 - DNA, 342 bp, Glycine max
cagcattttacacaggcacgttgattaaaagatgtatggacaagaattctaacattaaaacctacccagatataggtgagcttgcatttggaaagataggaaggctaataatatcagtgtccatgtacacggagctctacttggtttcaatagggttcttgattctggaaggcgataacttgaataacttgtgccccattgaagaggttcagatagctggcttcgtaattggtgggaagcaactgtttgtgatattggttgcccttatcatcttgcccacagtttggttggacaacttgagtatgctttcttatgtatctgcaagtggagtgtttgctaaaa

SEQ ID NO: 6139 - DNA, 370 bp, Glycine max
tgagaggtttcttaatagctctattgattttaagggcacaaactatgaatttatcccatttggtgctggaaggagaatctgcccaggcatttcatttgctacacctaacattgagctgccacttgctcatttgctttaccattttgattggaagcttcccaacaatatgaagaatgaagaacttgacatgactgagtcatatggggctacagcaagaagagcaaaagacctatgcttgattcccattaccgttcgaccttaaaattaaatgtcataaactatttaaattttatcttttactattctcagcatcttgtatggtaatttgggcaaacaagaatatatatctccaatgactttatgcacttca

SEQ ID NO: 6140 - DNA, 626 bp, Glycine max
cccaattgccaagacagttgggagtgagaccaatggctggcattttgttgcatggaccacctggctgtgggaagactaaacttgctcatgccatagctcatgagactggtcttcctttctatcagatttcagctactgaggtggtttctggagtttcaggtattaggctaaacacttgattggacatgaatttttacttgtcttttggattagttcgaacctaaagtgcataacagtatagtaagtaataaccctttttaatggagttttagatgatgcagagtgtttgtgctttgtttgattgtttagatttattgtttttattactatactaccataagatgatttggatgtaatctctgaagtatttgtgtcttttcgtgattaggtgcatctgaagaaaatattagagagctttttgctaaagcgtacaggtctgcgcctgctattgtctttattgacgagattgatgcaattgcatctaaaagagagaatttgcagcgtgagatggagaaacgtattgtgacgcaattaatgacttgcatggatcaatcaaataggcttcttcaaccagcggatgatgtggagagttctggtgatgatcatcatcctggctatgttcttgt

SEQ ID NO: 6141 - DNA, 439 bp, Glycine max
gattctttgctcgcaattctgatggggtttccttgggacccttgatggccttgcttcaagacaagatcttcctacatagctggttattctccatccacctctctccccctccctcttaaatattactaatcatgcgtattcattcttaggtcggagctgaaagattcaattcgggaagggggtattccattcaacagggtttatggcactcatgcttttgagtatccaaggttggacgcaaggttcaatcaagtttttaacacagcaatgatcaatcacaccactatagtgatgaagaaggttctggagtgctacaaaggttttgagaacataaaaatgcttgtggatgttggtggtggtcttgggatcaacatcaacttgatcacttccaaataccctcatatccagggtatcaattttgacttgcctcatgtcctag

SEQ ID NO: 6142 - DNA, 412 bp, Glycine max
taactatgttgcggagaaagtcaccaacatgcccaagccagaggcgagtgtcaccgacgtggacttcaagcgcgtgagccgcgacagcgtcgagtacttggccaaggtctccgttcagaacccttattccacttccattcccatttgtgagatcaagtactccctcaaaagtgctggcaggttcctatcactattcgctaccccccctttttaattattggattaattggttttcttttgtctttgtgatcgagttaatcatccaccatcaaccaatcatggatcgggttgatttgttttatggttgttggattttttgcagtatctgcttgttcttaaatgatttaatacaaagatcaatcttcggtttgagcttaatcaaacttaaactttctcgtccttctccagaaaa

SEQ ID NO: 6143 - DNA, 605 bp, Glycine max
gcgagtgcgcgagtgggtttgaacgaagaaccctaaccatctccgcagcgcaagctgctcattgcaaccctccaaactatcaactgggatcgtaaccgctctctcgccctcgccaggtctttgattcttgtttcctctatttccttatttcttgccagcacaccaatcttattctgttcttttcctccctaattcttattttgttttgctttctctcttattctacttccttaattctctatgtggttttaatttatgttttacaaaattttctttttctgtaagcggttacaattatttaatgaacaagcgctcagtgtttttaattgtaaatcttggcgctctatctgtgaatctttgttcggtggtttaggctcagactcgctttgtttgcagatttgattggatcggcttcctgcattcttggactcgggaatttggaccaaaaacagttccccaaatcttgctttttgtcttgttcttgtttctaagtcgttaatgtcagtgcagcgaagtaatctctggcaagttgattgtggcaggggagaggagggttctaaattgggcagcatataaacttggattacccattttggtggttttcc

SEQ ID NO: 6144 - DNA, 335 bp, Glycine max
ccaccctttctccagcacatgggattagtagtcctgccaagctagggaagtccccactcatcaatgacagcaaccttccccaaagagggtcagggatcaagaagtctttgactgattttcttagcattgatccaaaagggaaggaaagtggcagttcaattgagaaacaagttccagaatcaaatacacttgatgaagtgacaacatgtgaaacagatgtggagtccagtgattgcacagaaggtggtgccagcccaagtatcttggaccggaaatggcacgtgtgaggctattgatcttttatagttgaggcatttctccacctgcctttcttt

SEQ ID NO: 6145 - DNA, 348 bp, Glycine max
agatcttcaacaagttcgacaagaacggcgacggaaaaatctctatggcagagctgaaggacatgctctccgcgctcggatccaaaacgacggacgaggagttgaaacgcatgatggaggagctcgaccaaaacggcgacggtttcattgacctcaaggagttcgcggattttcactgcaatggcggcgccggaaaggacgactcgaaggagctccgcgacgcgttcgatctctacgacgtcgacaagaacggcctcatctccgcgaaggagttgcaccacgtgctccggaatctcggcgagaagtgctccctcagcgattgccggagaatgatcagcaacgtcgaca

SEQ ID NO: 6146 - DNA, 675 bp, Glycine max
atctggctcgcctgagacagtacgcaatctaggataagtttatgtacatatgctttgtttagttgcttaagtctcctcgcattaatcttttgtgtgatcttgcttgtgtgttgactaatataattccataatcagtttattttttcacatgtctgttactagaaattaactatgtgatgatgttgaagttacttggtactttggaatcattatattatctcgtgctcctgtattgttttttggatatgtggcattgttatgatgaacaatggaacttgttacaaaaatactgtggaagactctattatcctcccttttaacttcattctgtttacattgtcagatatcaggggctaaggttattgtccacgaacctcgtcctggaacaagtgataggactattatcatatccggtacacccgatgaaactcgagcagcacagagccttctccaagcatttattcttgctggatcatcgtgacaatatcctctcactgatgacccattaattctcaactagtttttaccattttttaaaatcctttttgtcctacctgaaagcatgtacaatataggaaaatatccacaccatttgccattccctgttagtaatcttggtgtctactgtcactctaatgtgtcattgtcactcttatttatttaaatttcaaaaaa

SEQ ID NO: 6147 - DNA, 694 bp, Glycine max
acgcacgagcttcaaaaccaaaaccaaactctgttctaacctccaaacttttatgccattcatgactcataacatcatagaaaaagaagaactactcacgaaccgcgaccaccaccgacaataaaaggacaacaacgttagtgtttaaaagcatgaaaatgctgccacctcccaccgccggaggtgcctcccacagcggcgccggtgaccgcaccgtggtggtgggcatgaagatggactctcacagcaccgagttgctcacttgggctctgttcaaagtggctcagcccggtgatgttgtgcttgctcttcatgttcttgggaatgatggtataaacaaaaccatcatatgtgtttctttggatgaaacttacacacattttttaagtgtttttggtgttgttcttctaccagaattggagtttcatctcggtaatcagcataatagacgtttgtgtaaagattattgaggtgaaattgtaattcggattggaaaacaacatcaaaagtgtcaatggaactaaataagttttgttctgtttctttttttgtttatttatgaatttgtttttctattggagtttgacatttttttttatcttttggtgaaatgggttggtgtagaaattgtgaatcgagaagggaaatcctcgttgttttcacttgtcaaagcatttgactctattcttgccgt

SEQ ID NO: 6148 - DNA, 519 bp, Glycine max
actctgttacaggatatatttgagctacaggctcctggatggaacctcaaaattcaaagatttgcatcaaacagtacaagaggcaaaggctaaactggagacagaagttggtcctgtcaatggtgtttcttccaagatggctcgaggcattgtcagcagactccatattgccagtgatatacagaaactctgctctcttgctatcgagaaagctgatagctggcttgccactgttcccaatgtaaattcagattccacaggtagaaactagtgctctaacttttatttgtatattttttgggggcaggagcttaaatttcttgcttttcagtctcatttatttggctcatgatgctattttataacttgcagagggttcttttcctgctgcttgcaagtttgtttttgaagaggtaacaacttcctcagccaaaatcattttaattgaaatgtcaagtatatgttctgaggaaattaagggatacaagctctggtattacaagagttgggatgaatcac

SEQ ID NO: 6149 - DNA, 639 bp, Glycine max
ctctcatcaatatctcattcctattcctatgtcttaagtcttaggattattttcttttctactcaaaacaaaacatgtctcacaccccacccagctaatctcccccttcaacacaacaacataatggttgcaactgccgccacatttttcaatccactatttcttcacacggttctctctctactctacttttcattttatttatttaagaattgtgatcttaagaactttagaagatattcactctattaatcatggtcatctgtttgagaaagaaatttctttcagctaaaagaattattgctaatttgtcaccaattggattttctttctacctcactttttaatgtaggacaaaagttcttctgttcataactttagaattaattataaaatcttgtctaatttcgtgtgaacgattctgattgctaaattatttagtgcagcatggtagggttaacatatgggcactaagcaggattagctacttaagtggaaatgtgaagtctaggttccctatttatagatcagaaattcatcatcaggttcattacttttcacaccttgcacctatatgtgcaacctttaaggaacccaaggggtttggtcctaccccaaagaaaaagaagaagagcaaga

SEQ ID NO: 6150 - DNA, 349 bp, Glycine max
  misc_feature (335)..(335): n is a, c, g, or t
gccttgcttcggcaagaaccgatgtagattgtccacttgatgttgtagctgttgatggtgacttaggtctgcctttgagcttcacacctgttaatgataagaaaggtattattcgtgtttccagtgatctcaacatatacttcaccagctacacaatattctgtccacagaccacagtgtggaagcttaaggactatgatgattcaacatcacagtggtttgtgaccactggtggtgaattgggccaccccagttcgcaaaccgtggcgaattggttcaagattgagaagtacgaggatgcttacaagttgttgtattgtccaagtgtgtgcagnttttgatgtactta

SEQ ID NO: 6151 - DNA, 402 bp, Glycine max
gagtctttgatgtgaagcatttgatgaggttctgctcaaacctgcacggtggattggaccgtgtttgtcagtcgctgaaggtggaacgtgttattggaaaaagtcatcaggctggttctgatagtttgctcactctgcacgcgtttcagaatatcagagagaattactttgacaaggctgacggacttgttcagtacgctggtgtcttgtatggtttggaggttttctgagctttcttatatatgaaataatagtaatcaatttggcctaggtttcttttctcagctttaaattgtaaagcttacacattttctctggcttatcaatatccattaggaattattaattctttgggttctatttgcacctgcgaaagatagtaatgtatgaggaggcaatgca

SEQ ID NO: 6152 - DNA, 994 bp, Glycine max
ctctggtttctgatgaactccagtgaaatatcccagttggtgtactgtacatgagtaaagcttatcataatctctctctatgactgaatttgaagcgcacttgtagttgtatgatgataagagctcaagtaacataattactctcacttaattaataagctaacttgtttctccttaggttgggttgggttgggtgactatcaggatctgaaatctcatgtgtcttttataaaagacaattcattatttggccaacttttcttgtgtttgaaaaaatctattaatgaaagattgtgcagtatataatatagaattttgttgtatgtcaatctagtactttacagtgctaaacaaaattttggtgcttaactagtgttgaaaaattttgctctatgaggcaacatataatctggtgtgttcaattgaaggtatgagcttgcttgagttagatgttacttcatggtttgagtgtgatgtatcattttcaacattaataagaaatgaatcttttactagataagtgtctgcttggagatacaataaaagcttaagggctgaatttttattttgcctgcagttgtgtcatcataaaaatactgcttctatgtctttttcatatccaactccttttaccaactgctatttcttttcttgattaattgaattgttattagaatgtgcaaagcacaatccgaaggtggatggagacactgaaaacaatgttgcggagttactgtcggaagaactaactctacgggaaactgaagctttgaaaaatcagcatcgtgctgacatggctctgctggagtccaagaagattgcatcccagtatcaaaaagaagcagacaagtgtaattcaggaatggaaacatgcgaggaagccagggaaaaggccgagatggcactagtggcacagaagaagctcactgcattgtgggaactaagagcttgtcagaaaggatggaatgaagggcttgccaaatctaaaaaacag

SEQ ID NO: 6153 - DNA, 578 bp, Glycine max
  misc_feature (409)..(410): n is a, c, g, or t
  misc_feature (444)..(444): n is a, c, g, or t
  misc_feature (446)..(446): n is a, c, g, or t
  misc_feature (448)..(450): n is a, c, g, or t
  misc_feature (452)..(453): n is a, c, g, or t
  misc_feature (456)..(463): n is a, c, g, or t
  misc_feature (467)..(467): n is a, c, g, or t
  misc_feature (482)..(482): n is a, c, g, or t
  misc_feature (484)..(484): n is a, c, g, or t
  misc_feature (486)..(488): n is a, c, g, or t
  misc_feature (491)..(496): n is a, c, g, or t
  misc_feature (499)..(503): n is a, c, g, or t
  misc_feature (506)..(512): n is a, c, g, or t
  misc_feature (514)..(515): n is a, c, g, or t
  misc_feature (522)..(524): n is a, c, g, or t
  misc_feature (526)..(526): n is a, c, g, or t
  misc_feature (529)..(534): n is a, c, g, or t
  misc_feature (541)..(544): n is a, c, g, or t
  misc_feature (550)..(551): n is a, c, g, or t
  misc_feature (556)..(562): n is a, c, g, or t
cttacagaccatgccaaacgcaaacatgcttctccttttcctcttccttctggcgctcttctcagccatgacaacaccgtcaacctccgcgatcgacaccttcatctttgccggctgctcccagcccaagttcacgccgggttccgcctacgaaaataccgtcaactcgctcctcacctctctcgtcaactccgccgccttcgccaactacaacaacttcaccgtccccgcctcctccgacgccgtctacggcctcttccagtgccgcggcgacctcaccaacgaccagtgctctcgctgcgtgtcgcgtgcggttacccagcttggcaccctctgcttcgcctcctgtggcggcgcgttgcaggtcgacggctgtttcgtcaagtatgacaatgccaccttcataaannaaaaaaaacagccgacgacctgcaacgcgccccncngnnngnnaannnnnnnntgcnagctgggtaaccgcngngnnncgnnnnnnagnnnnngtnnnnnnngnngtcgccnnncnctnnnnnnagccgtnnnncgcgtnngaggnnnnnnngacggtgaatttgttg

SEQ ID NO: 6154 - DNA, 1245 bp, Glycine max
cttaactttaccaagccttcatattctcaattcccatactcttttccatcattttggttcttttgttttacttgttctacctcaaaaggagggcttcctctctctcatcaccacctctccacatacttcccagtacttctactgatccacaaactgcatatccttattctacacaagtgagtaagattttctttctttgtaatttgaagtcataattgcacaacacaacatagggatctagattctatgactaacttaggtggctggcttcaatcacttatgcactgcaccaccacgcatccattatcagtaattgaacaaaaaactaatgttagcctctatgttgttgctgttaatatcacagccttgccgtttagatctgacagtgcaatttctggacaaacttccaagaattttatttgatgaggatttaagaacaagagattcagtgtacgcctttctttcagttcttttttcattttttttatgcctatgattgatctttttgtttgtattatcttttgaaagattgctgtgttacctgtgtagctatagcctataggttttatttccatgtctctttttggactttgcattgcttaatgtgctttaatctagggtatctacagtatgtgtactgggcctacattgttaatttgttatattttaattttatctctgccaaattacactcaaatgattgttgttcttcaaaagttgaaggattttgagcagaatattcgatttttccaaagttttagaacctttcatgacatccattattttcataaaaagtgacatggaaaaaggaagtaacaggtgtaaagaatatatgaagactggccttttttttatgcaaaacttgcacatttgaaggtgactccccaggaataaagtcaaaagaaaaataaaaaatatagaattcatgcacgtgtaacccgagtgggtagtaaaaaaccaaacttttaaagatagatagatataggttgcatttgctttggaatttctagtggacaagtgctggatggattgcactttggaactcttgtcttttactgatttaattctgtagtgttgaaaatcattatttcaaaactaaggatatgattgtgctaatattctagtaactataaattcatgaatcgaaggctaaaaggttgttgatgttttttttgtaaccagatgttgtgtttgcctaggagaatttgagctgaatgaagagttgctacagattccttattgcaa

SEQ ID NO: 6155 - DNA, 500 bp, Glycine max
  misc_feature (439)..(439): n is a, c, g, or t
  misc_feature (442)..(446): n is a, c, g, or t
  misc_feature (449)..(452): n is a, c, g, or t
  misc_feature (455)..(460): n is a, c, g, or t
  misc_feature (468)..(475): n is a, c, g, or t
  misc_feature (478)..(480): n is a, c, g, or t
  misc_feature (483)..(483): n is a, c, g, or t
  misc_feature (485)..(487): n is a, c, g, or t
  misc_feature (490)..(492): n is a, c, g, or t
ttcaatgttactcttcgtcaccgtcttcttgtgggggtactttaacgtatgaggtgagtcccatcttatgtcatcagcacaagaagaaaaataggttcagttatttgtttctctacattaagtcaactgcataatacataacactagtcactagtgcatgtgttttgcatgcagctgtctatttggcattgtatgatttatattagatatctcatgttaatttttatttaaatgccttttccactttagaaagatgatattaactggaaatggatgcatcaaaggcagattgttaaataaattaaagaatcagggtttggctggctaaacattttctttagatctgattttggctagtgtactggtataatgacctttattatgtgattaagcttctctttgaaaattatctgtaactgcagatgttattatactttgngtnnnnnctnnnngannnnnntgattatnnnnnnnnctnnnttngnnngannnctgtacct

SEQ ID NO: 6156 - DNA, 459 bp, Glycine max
  misc_feature (406)..(409): n is a, c, g, or t
  misc_feature (430)..(432): n is a, c, g, or t
agtgatccccatcccagaatcaaagattgtctactactatggtaattaaacaggaacatgattggaaattgccatgtgaaactgtgcctatgcttttcaattccacaaatggaaacatgttcatgacaccactttgtgggatttcttcatatggatctaaaccacttcaggagcagtatttcctcagtggatgccagtttggaccttatgatacaattatgcaaatgccgtccatgcaaaatcaatgaactatatagaatgcagggattaaagttaaggtactaaaatgctaaaccttattcattgatgttggattgatttttagatgcttaagggtggttttatgtaaatatttcaaggattcacgagtttccttatcactcaatctttgaagagccttcaaagnnnnagtgggtggggagggcgtgtnnncttgaaatatttacataaaaccaccct

SEQ ID NO: 6157 - DNA, 415 bp, Glycine max
gttctgtatatggaattatgatggaaacatagcctatgaagacatcattagagcaacccaagactttgacatgagatattgtattggaacaggtgcctatgggagcgtttatagggcacagttaccaagtggcaagattgttgccgtgaaaaaactccacggatttgaagcagaggtgccagcttttgatgagagtttcagaaatgaggtcaaagtattgtcagaaataaagcatcgacatattgtgaagctccatggattctgcttgcacagaagaatcatgtttttgatatatgagtacatggagagaggcagcttgttttcagtgttgtttgatgatgtggaagccatggaattggattggaaaaagagggttaacattgtgaaaggcactgcacatgcctatcttcatcat

SEQ ID NO: 6158 - DNA, 623 bp, Glycine max
  misc_feature (604)..(604): n is a, c, g, or t
  misc_feature (607)..(608): n is a, c, g, or t
  misc_feature (610)..(617): n is a, c, g, or t
  misc_feature (619)..(619): n is a, c, g, or t
tacctcactcgtattagcgttgctgtgtgagagaaagagaaatggcaacaagcgaagaagtggttgcggcggcgccggaggcagccgcgccggaggcagggttgaagcacaaactggagagaaaatggacgttttggtgcgacaaccaatccaaacccaagcaaggcgctgcttggggaacctctcttcgcaaggtctacaccttcgacaccgttgaagagttctggtggtatagaatttctcttcctcctcctttttcttctcccaaatattcatttttttagatgaagggaatctaagcatgcaatctcaaatcttatattttatgaattcttatcatgggtttcaatgattgatgcactgatttatttatttaaaaaaatataattgatttttatggatcttaggatagaaaatcttaatgtgtcttaatctttcttattttttattttgccttacatggggatttatggttttttgtttttttaattgttattattattattatttggagattgggagtgttggtaaattattggaagaaatgaatttgatgtgggaaatgctggtttagtttgtatgatcaggtattcaagcccagcangtnnannnnnnnntncccc

SEQ ID NO: 6159 - DNA, 416 bp, Glycine max
tataacattctgaaggccatgaggtggctaattgagggtagccagtcgggggattcattggtgttccagttctcaggacatggttgtcaggaactggatacgaatggggatttcgatgagcttgatgagcgtgacgaagcaatatgtccggttgattgggaaaagcagggaattatactcgatgatgatattaatgctgcaattgttaggccactaccatacggtgctaaacttcatgccattattgattcatgcaatagtggcactgtccttgatttagcttatgtgtggagccagaggtcaatttaggattaattaatgcttgtttcatgaacagtaaatatgtatcatactctttaatgtttttctagtgtaataacgtaacagggacacatgggattatcaatatggaggtc

SEQ ID NO: 6160 - DNA, 370 bp, Glycine max
ttaaaaagattgcgacaagcccggatcttgaattgcatgtttactggcttactagctgctggctaccagagaataccattaattgggatgacaaagatattcttatttcctgtggcagatttgaagttaataaaacagatgatcttctcagtgtttatagtactacctcttgtgtttcacatcaagtgcatgctgatgctgttggtaagaataagaattatgccatctttccgaggaaaggtgaagtttgggcattatatagaaaatggacaaataaaatgaaatgttttgagatggaaaattgcgagtatgacatagttgaagttgttgaagaaactgatctgtccataaatgttttagttctggagtt

SEQ ID NO: 6161 - DNA, 415 bp, Glycine max
ctgacacaacctgaaggtgtaacaaatttggcaaatcttatatttaagcggattcgaatgcaaggttttattgttggtgaattctatcacctatatccaaaattcttggagtttgtcctgcctcatattagagaaaggaaggttgtgtatgtggaagatattgctgaaggtcttgagaatggtcctgcagccttggttggcctctatagtggtcgcaatgttggtaaacaagtggttgttgttgctcgtgactgaatgcagatgctttcgttggacattgctgtctttttttatgattttggtgttgaatattcagggctctttgtatgttttttgcaatcattttcaattgtggtatttgtgatagcagtgtaacttaagcaactcttagttgaaacgtattccctgagtggta

SEQ ID NO: 6162 - DNA, 760 bp, Glycine max
atgacttgcaccaccatgggaagcagaagctgaattttctcgaggttgcgtggggtcagtcccaggttgtgctgtcagtctttgcaatacttcatctaaactacctccggcctcaaaagcagcaaccactgcaaagaaacagcagtatgagaacactcctatatgtctataactagtatcaccttagcacattgttgtgccttgaatctagataactattgtacctcttgatctttcaaaacccatttgcacaactttttcaatttcagaatctcgtgctgctttctgtctcttccttttcctggactcgatattgaccttcatgttgaagagagtaagaaggaatattgttttaagtgacacagaattttgtcaagacaaatagtaacctgtaaagcagaattagtttctggatttgtcaaatcatccaatgctttctgagtgtcattttcatttcttctaagggcttcagcagcaagctccttgtcaaacctgccagaatagcaatgtcaagtctgactgttatagtatgcttatgtgaagtagctttataatactagtagaataaaccctcaatttcaatcctgaagtattaccctctcccctaaatggtccgtaacattaaagaattatataagtaatccctcaaatattagaaattaagccaagtagtccccaaatattgaaaaacccttcaacttgaatatttgaggaattaattgtataattttattacttcaggcattacctaggagaacgg

SEQ ID NO: 6163 - DNA, 689 bp, Glycine max
tctattgtatgtcaccgccacttctaggcgaccaatagtattctcggcagcattgtctgcaatctcccgactctgtcagccagcaacaaccacaatagcatttatctgcttgcttttgagaaagattgtcaacgtattcgtagtaaacaccccggccataaagacgagggggaggataacgacgagggggaggaggaaaacaaatgatcataaaatcaaggtcaccaccaccaacaaatttggcatcaccctgttcgttagttattttgacaacctcacctgcaaacgcttgcattagatcttaacacatgaaccatttaccatagaaagaaaataataagaacacaagtgaaaaactgattttacaaggatcattttttttttaaaaaaatgtataacgtacagagacaaaatatttaggtcatcaaaaaattataaaacatttatagcaaaaatgtatttttttggtgaatatttataaaaaaaatatattagtaatatgtctttttcataaatttactatatatttaaatgtttaactagtgttttgaaaacatgtatagatattctatttgaaatataagaatatataaggaaaagtgatatatagctcaccctcctttgaatggctggctgccacctctgatgaagatatcagaaggagcatggcccaacatgcttgctgggat

SEQ ID NO: 6164 - DNA, 400 bp, Glycine max
caattctcaggcactgctcaacctgcagaaagctctggaggagtttcaaagagtggtgggaagatagaggattcagctttctggatcccacacccacgcacaggaatttacttcccaaaagggcatgagtgggtgatggatgatgttccagaggatgcagctcgtttaaaccagacttattggttcagaaatgttgatggtgttgaccaccccagacactaaccataatatatgctccacaacattccaaaaataactacataatcgggaatcatatggtggtgaccaatctttatgtgatgtgttattaactagttttcatacattagaaaatatatgaatactatatatagtttaatagaatcatatagtcttggataatttcttcctgctaaaggcc

SEQ ID NO: 6165 - DNA, 390 bp, Glycine max
cttttctcgattgagaatagatgaaaaaaattaagtggcgtctatctctcccatccttgataatatatggtttcctccgctatacgtggcacgtgctgtccaaatacaatgtaacaacaagtattgtctccttcataattcacatgttgttcatttattccaaaattaaaatcataattaagtagggaccaaacagaaagaaaagaaaagaaaagctatatatctagctaatttgaaagtaagtttaagcatcaacaatttcctcagtgtctgcagaagcgaaaataagctggggttcttcccttccaactccacacgttccatcaattgcattgttcctccccaacgccttcaacgccaaatgagccgccttctggcctgatatcatca

SEQ ID NO: 6166 - DNA, 1008 bp, Glycine max
  misc_feature (505)..(505): n is a, c, g, or t
  misc_feature (507)..(507): n is a, c, g, or t
  misc_feature (549)..(549): n is a, c, g, or t
  misc_feature (552)..(553): n is a, c, g, or t
  misc_feature (587)..(587): n is a, c, g, or t
  misc_feature (593)..(593): n is a, c, g, or t
  misc_feature (627)..(633): n is a, c, g, or t
  misc_feature (654)..(654): n is a, c, g, or t
  misc_feature (658)..(661): n is a, c, g, or t
  misc_feature (663)..(669): n is a, c, g, or t
  misc_feature (673)..(674): n is a, c, g, or t
  misc_feature (677)..(677): n is a, c, g, or t
  misc_feature (680)..(684): n is a, c, g, or t
  misc_feature (687)..(688): n is a, c, g, or t
  misc_feature (690)..(693): n is a, c, g, or t
  misc_feature (696)..(697): n is a, c, g, or t
  misc_feature (708)..(711): n is a, c, g, or t
  misc_feature (714)..(715): n is a, c, g, or t
  misc_feature (717)..(732): n is a, c, g, or t
  misc_feature (736)..(737): n is a, c, g, or t
  misc_feature (744)..(748): n is a, c, g, or t
  misc_feature (751)..(764): n is a, c, g, or t
  misc_feature (772)..(777): n is a, c, g, or t
  misc_feature (780)..(780): n is a, c, g, or t
  misc_feature (783)..(789): n is a, c, g, or t
  misc_feature (794)..(797): n is a, c, g, or t
  misc_feature (801)..(805): n is a, c, g, or t
  misc_feature (808)..(810): n is a, c, g, or t
  misc_feature (812)..(823): n is a, c, g, or t
  misc_feature (826)..(828): n is a, c, g, or t
  misc_feature (830)..(848): n is a, c, g, or t
  misc_feature (850)..(869): n is a, c, g, or t
  misc_feature (872)..(879): n is a, c, g, or t
  misc_feature (885)..(889): n is a, c, g, or t
  misc_feature (896)..(899): n is a, c, g, or t
  misc_feature (909)..(912): n is a, c, g, or t
  misc_feature (919)..(922): n is a, c, g, or t
  misc_feature (926)..(938): n is a, c, g, or t
  misc_feature (948)..(957): n is a, c, g, or t
  misc_feature (969)..(974): n is a, c, g, or t
  misc_feature (979)..(984): n is a, c, g, or t
  misc_feature (988)..(990): n is a, c, g, or t
cttcttcattcctatgtagatggctttagaaatttcatgagtgatatgagtatatgaccaaaatagtgaagactaactctcacgagtcgagttatgttcaaacttaaattctatcattctgtttggatacaggctagaaatacttttgagagtttttttaactggaaatataaaacttttcctggtagaaaaactctcaaaagcacttacttaaagttttgtatccagacaaagttcaagacgacattattttggtcatgtcactagtaaacacgagattttgatcttgtaacaaagttaaggttaactatccctttattgctcatgttctatacaactttgtacaggtactggcttccagtccaaagggtcttacttgtttggtcacttcagcatgtacataaagatggttcctggagattctgctggcacagtcactgctttctatgtatggacaaaatgaaaaaaaaaaagtttctatttttatttgcttcagccattgggnanaaggggaaggggacctttgttttgttatggtggaaattgggnagnnatcttcccaaaacgcggagcatgatgaaaaaaantttganttcttggggaacaaaacaggacaaccttactttnnnnnnncaaatgtgttccccggaggcnaggnnnntnnnnnnnaaannatntannnnnggnntnnnnccnnaaaaaaaaacnnnnaanncnnnnnnnnnnnnnnnnttgnntcaaatnnnnnaannnnnnnnnnnnnnaacccctnnnnnnccnttnnnnnnntttcnnnntttnnnnnaannncnnnnnnnnnnnnaannnannnnnnnnnnnnnnnnnnnannnnnnnnnnnnnnnnnnnntgnnnnnnnnagttcnnnnnaaaaatnnnntttaaaaagnnnncaaaacnnnnaaannnnnnnnnnnnnaaattcccgnnnnnnnnnntttaaaaatttnnnnnnaaaannnnnnaaannntccccccccccccccccc

SEQ ID NO: 6167 - DNA, 732 bp, Glycine max
  misc_feature (288)..(288): n is a, c, g, or t
  misc_feature (320)..(320): n is a, c, g, or t
  misc_feature (356)..(356): n is a, c, g, or t
  misc_feature (724)..(725): n is a, c, g, or t
tatgcatgattttcaggaaccatggtaacaagttattactccacttacaagaagagactgtttaaataaataaagggtataaaataaagcttataaataataaaaaaataaaaatattaatcatatttcttaatttacatcattatttatagtctgtataaatttgtaagaattaaaaaataaaagattagttttacaaggacgagtaacaaaaaaaaaatactaaattttaagaattaaatatatatatatatatatatatatatatatatatatatatatatatanatatatatatatatatatatatatatatatanatatataaaaaaagtaactaaacccaaaagaaaagnagttgaaggaactaaaatacaaaacaaaccttaacacgcttgcggtcgaagtctgaatctgaatctgaaaaaggtttcgttgttggtcgagcatgcacctctttgttgcagtctatgtcttcgatgacgatgatggagcggttggttgtttccctcatgactcgcatgagttccgagttagaaaacatagagcttagctccaaatcatacacatcaaacttcaagtagttggctatagcagcaataaggctagattttcctgtcccgggaggcccataaaggaggtagccacgtttccaaggcttccccaccttcttgtaaagctccttccgtcgcaaaaaccgattcaaatcatcaataatggctgnncgctcag

SEQ ID NO: 6168 - DNA, 348 bp, Glycine max
caactcgaccaatttgggaattttcatctgcgcttaactgtaataggactccttactatatgctttccgtctgtccaacgcaaatccccgaattcatactttctccgcgtagctgcactgcttgcttgcacaatgactttgaatgtcttcctttcaccaattttcgtgaaagtcaaggaaggtggcacaacggcaatgctatatccatttggcgagcgggtacttacagtgtatgtgcttggtggcccaacatttgtgactgtgcgagcaatggccacgggctttaagcgaagatttggcaatgtgattgaagggtagttcaagtcatttacgctgtgagaacctgac

SEQ ID NO: 6169 - DNA, 387 bp, Glycine max
gtatgctaactcaaattaattgcccatggtaaagcttgtgaaattgatgatttatacttctagcaggttcatcccaaaggagctgaaacagagttctgtgcccttcttttaggagagttatatgcttatattgggttgaggctttcttccactccgttctactatgaaattaatatagggaaattcaaataatcgttaagaaatgagaattcgataaacatcgagtagttctagtgctttatttctgactttcatcctcagtacttgatacagagtgaacaatgaaaatatggcatatctcgtttttaatcacatttttgtttggcaaatgtatgattagctatttagtatcctatattttgaacaactcaatttctgccatcctaa

SEQ ID NO: 6170 - DNA, 412 bp, Glycine max
tgtgtgttggggttggtgatcgtgggtgatgttgcctacgctcaagattcagcagaagactacgtgaatgcacacaatgcagcacgagcagaggtgggttctcaatcaccaagacaaacagtgattgttccaagtttggcttgggatgatacggttgctgcttatgcagagagctatgctaatcaacgcaaaggtgactgccaactgatccactctggtggtgaatacggagagaatattgcaatgagcactggtgaactaagtggcacagatgcagtgaaaatgtgggttgatgagaaatccaactatgactatgattctaactcttgtgttggaggagagtgcctgcactacacacaggtcgtttgggctaactcggtgcgtcttggatgtgccaaagtgacatgtgata

SEQ ID NO: 6171 - DNA, 714 bp, Glycine max
ttgccatattcacccaaacaaaaacatgtgcagttgatatctttttaaatcaagtgcaagtaaaatagctttttctaagagtggtaccttagagaaatcataaatgaaaccaaacttcccaatcactcaatgttctactagaaagcacatttacattgtgaccattaacattttgaactgttcttttgggcaggagggaatatattccatggtgctatggggttggattcccttttcctcatgcgacctgcaaagggatggtaagctaaattgaactggcttgaaatataatcttggtttattttttgacatataactgatcataaccatgctgttcccgttactgataattacgtgaatgttttggaacgtaggtcaaactacaagactccgcttaaagggttatacttatgcggaagtggggcacatcctggtggtggtgttatgggagcacctggacgtaatgctgctcgtttagttcttcaagaggttggagaaagaacttcagtggtgatatactgagttatgattctcgcccaaattattactgcttgcaaactggcttggaaagatggctctttcattggaattttatgcagtaactaatgtaaatttgcaatgcgtaagatagaagaatgaagaatcgtgacaatgattcatcaaattggatgagcttcataacaaagatacagaagctgtaatgtggatttcaga

SEQ ID NO: 6172 - DNA, 420 bp, Glycine max
aaaaggaaccatgaaattcttcactctccaaccgtgtcccttcaatcaacatggatgtgaaagccaatgaaggaaacaatgagcaacaactctcaatggatcacgagaggcagaataatagggatagctactccttcatggggaaccaaacaaacttcattagtggctttggacaataccctattgaggaaattggtaggtttgatgctgagcaattcacaccaaggttttcaggtaagaatggagtttccctcactcttggtcttcctcattgtgacacattgtcaggaacacaccaaagttttctcccaaaccaaaacattcaacttggaagagggttggacattggtgaaccaaaccagtttggtgccttgaacaattccaattctcacaattcagcagcatttgagagtatcaaca

SEQ ID NO: 6173 - DNA, 892 bp, Glycine max
agtgctttggctttgatggcctcagcattatccacctgtttctttatcttgtttaattccttttgggccaagataagctgcgtctccttttcaaatacattctgcaaattatgaagaaaaagcatgaaaatcattttccatgacaaaaatgtctcaagcaactgaattctattaactttctcatgaattaaaatctcgattatgtgtcatgtagaaattgatcaggaaccatagatatgtggtggtatcggaccatgcagtagtttctcctctatcctgatcctaggatatcttttttaggaaaaaaatggtatgtaatatttgatgcatacctctgatgatcttctcttgacagaaaatctgtctctagtgatggctacttcgccaaataaactaacagcagctttgacagattggaatggtgccctagtgtctatctctccaacctctccccttggagaattcaactttttgtggccattcattttctttgctctaaattggaaaaattgtctgcaagataaattgcaatgagattgaattctatgaattaagctgcaagacaactcttgatatgggtatatgaaactgcagaatatttaaactttctaatgttgccagctctgatattaatgattgtatcgtaccacattataaattttctgtaaatcgaaagcacaacttaatattttaagttaatgattgtatcgtaccacattataaatttgaatagcactcactacatgttattggcaccaatgaaggctacatgttaaactcaacgaaaattatggtaatattttaagttacaaaaccggagagcaatgttcttacgtgaaagaaacaaagatgaagcctgaagaatctctttcacttgatcaggtggaatcaa

SEQ ID NO: 6174 - DNA, 321 bp, Glycine max
attttattagggactttgatataaagcctaatatcatattatatcacacacatgttgtgcccaacaagcagaagcagaagcagaatattcagcaggctatggccaagaaattagaaccaaagtttcaaggaactgaaagacatggttgaacaaactataaaaaatttaagcttaaatcatttgctcgtgattagagatgaagatacaaatatatctctagatagtatatgacccataaagatcatggtcttaatttagtatcttgtagagctatttgtttctaagcctctctttttctgctgaacacttgaagcctttata

SEQ ID NO: 6175 - DNA, 795 bp, Glycine max
  misc_feature (788)..(788): n is a, c, g, or t
  misc_feature (790)..(792): n is a, c, g, or t
tttggcaatattcttaaagacacaaacaatggacccatactcatttaccccgtcaaccaaacacggtatatatatatatatatatttatatacggacatgacacaaaccaacgagtttaaatactttcaatcaatcagaaatataaaaaaaaagaagacaaatatgacttttaaagaacaaaaatgattgttgacaccaaacaacctatttaacacctatataagtataataaaattatatgacgtgataagaagaataagataaaaaagaaattatgaatgttaatgaggtagatagaatgtggggtatctaaatgtcattgttctttaaagagatattataaaagtgaataagcttattatacaaaataatttgtgattgattgatgcagtagaaatgtaatggtgcaaatattatactctattaatttttatgatctaagtcattttttactttttgttgttacaggtggaacagcaaaacatcattgattaccccagaggaagatattttttacctagtagcattcctatccttagctctcccaaattctaccggtgcagacagtttagaacacattctagcccaaaacaaaagagtcatagatttctacactggtgccaaaatgagagtgaagcaataccttccccattacagcacacaggaagaatggcaagtccattttgggtcacgatgggagacattcgtggaaagaaaaagggcctatgacccactagcactgctagcccctggccacaaaatctttcaaaaggctgtctcctcttcngnnntag

SEQ ID NO: 6176 - DNA, 1004 bp, Glycine max
gatcctctgcagtgagcccttctgctcccgctacacccccaatttattctccttctcacttagggttttcatctccatttccgaacctggttaaccggttcaaattttctgttttcgtgctgaattttgaagttgcagctcgatcttcgatctggggtttcgggtgaagtgacacggtaggtagccggtgacgttgcttggtgttgttggatctgttcccagaaaaaaaagaagggacaaggaaagaaagaaagaagatgcagcaagatcagctcaagaaggttgtttctttctccatgattgccccttttgtctgcagaatttgttacggtgctgtgaggtgacgtggcgcacggaggtgttgaaaaaattgaaaattggaaactggggtggcaggaaatggaaaaattaaaaacagaaactttgtttaaaagatggattgtgaatgtaacggtcaatcaccgagtgtgtcaatcaccgagtgtgatgaggcatttgttgtaaaaaaaaactttatctttttgtttttattctggtttctagatgtgaagtaggggtttttctttttttgtggttggtggatctcgtgtggttttggtttggagggttcaattttgaatgagcatcactgttggattggttttgttgattaacggtggatgttgcgactgaatcttgttagtatttataagaaatattacatgtattggagtccatatgagtatttgtataattagcattatattcaatgagggtgtcttgtttgaagtgatgatttgtggagtagtaattgtaaaattacatcgtgtcttgctttgtatatctgaatgattttgtcaacctagtatatgcatatgtggtttgctttgattctgattattttcaattggtgggtacgcgatatattgagtatgagattgagggatttattaatgtgcaggatatgaaggaggtagagtttttcactgagtatggcgatgccaacagatacaagattcttgaag

SEQ ID NO: 6177 - DNA, 518 bp, Glycine max
gtgctaaaatcatattcgaagtcatggtcatttaatgaagtgccccttctctgtttctgagatctagctaagaaaccctccactctcgagtccaaattctcctcccacccagaatggatgcaagggcatcatcttcttcaatgtccatgattcttttcattacagctattgtggctgcagcttattttcattcatcagaagcagctgtgtcaaaaggatcttttgaggacaatttcagcataatgtggtctgaggaccattttactacctctaaagatggacagatctggtatctctcactagacaaagacacaggtaccaaatgcatggcactaaaaatagacttttggttgaacatgcattgcgtattattgatttgattggataatttgaactgttagcatcaaatttgagatttgaggctgtttctgaagcttttactgtttgataggatgtgggtttcaaacaaaacaacgctacagattcgggtggttcagtatgaagctgaagttggtagc

SEQ ID NO: 6178 - DNA, 380 bp, Glycine max
tgtgtctcttggcctgtgtaccccatgcatgctacatccacgtgacctagacaagccatccctttctcatacaccagaggttggaagaaatcgtgtagcttctgttccttcggagatactctgccccgtcacttgtagtccatttccatctatggcaattcccttatgtacctgcaatgatggtccatgtccatcatttgaacccagagaagtagaaacacaggatggattacctcatcactctcaagcatcaacagtggatcaggataaaattgaagggccaagactagataaaacaacctgctctagcatgttttggggtagaagaagttgcagcagggagcaccaatgcaattcagaaataaatgcttgactcgcac

SEQ ID NO: 6179 - DNA, 383 bp, Glycine max
tcgttccatcacgagtgggatgctgaagctctcttagcagcatacccttcttctaattttaccataacctcatcatcttgtgctgttgctgcgaaaaaaacattaaaagatgaaggtttcatgcagaagaacacccagaaaaccgaagatatagtggtggaaaatccattagagtcgagggtgtgtgtggatctcgtttggccttgaatctttggttactctcatgtgtcctctacattgtaaatattgtaacttctttttgttagaaaactgatttgctgtgttattgtaaatttttattggtctttacattacattataccttttaatttttctttgtaattttgttcgcctttattagatgatgaaagttgaactcgtca

SEQ ID NO: 6180 - DNA, 844 bp, Glycine max
aggcatttgtcattcgacacccgacactcttgaagcacatgactctacctcatctaaagtaattaatttccttaccctacctctttcactaatatcttcttccatcatagttgatttcccctcatgtcattattgtctatcaatcagcaaatagtctatcagttgcacaaagaaacaaggagggtgcctttagtgtcatgcatatatgtctgtgtgtgtctttattcaatacttataaaaatgtgccttcatttttactttttttccgttttcatcttttttctttataagttcatcaaaacaggaaataaagtgaaaataaggtgggatttctgttaaagaaaacatataaattgaaaatgtaaacaaaaacgaaccaaatgacactggaggattttggggaattgattctttatgatgtcaatgtttaatccttacatttattgcaaattaatacagaaaaatacattttaaacatttaggaggtttgcatttcattggttgggactgaaattcatggttttcaatttcgtttggtcactggccagggacattactacactgtttaccagtttcatcttcaacaccgaagttgatgattctcactggcatattaatggcaatcattaacattgaggagttgaagcttgttgttctgttgcactctcccaatgttgactgcatcacaccaacgagagaattcatggaagtgaatcaaaccaccaaagagtgttaaaaatttgatccgaaccagtaaaaagggcttaaattgaatccaattactgtttggattgatcagcttactgtgcatagtacagctcattttggccggtgtacaaaatta

SEQ ID NO: 6181 - DNA, 918 bp, Glycine max
cccttgccttgaatttgatgaggttagcttcagataaatttagattattatgttgtagatttatgctttttctttaatttcctttggagaaagcaattatatttacattagaattgtttatattgattatctaaaatacgtataaaagactagcaattctcatgccatcgagaataaataaaacttacggatttgacttctgtcaagtaaaggaagtgcatctcagataataaaatacattaataaccattgattaaaaaatcagcagttaagatagtaactaaactcaaagtttatttgtacacattttattttattttttttgcaatttcaatggttgatttgttggtcaaccataataaatgcaatttattctctcaaatatatatttttttactttaaggggttggatgtaaaactttataattgttacgagctttgatctaatctaggctaggttgattctgtgtcgttgtatcatggagaattttatatatatttatgtttttccattgatgctttggttttataaagatggttgtatatcctagtaacatggaactgtgttgtttggaacatgaaattagttggggtgtgttcgtagagaaaacagccatatgccagggtactatgacggtaggtattggacattgtggaagctaccaatgtttgcttgcagtgactcttcgcaagtgctgaaggagatccatgaatgcagaagggtgtatccaaatgcatatatacgttgcttagcatttgataaccagcgtcacatgcagtccatggcttttatagttcacaaacctgatatcactactaccacttgagcctttttgctcttgttaatttatcttcatttccccaatttctctctctttaaaaaaatgtaatatggactttgctgtttacttatctagc

SEQ ID NO: 6182 - DNA, 788 bp, Glycine max
acttgggactatccttagtgcaatagtctcggggatagttgagagggacataaatgcttgttaagataaagcgtaacaaggatgtcattctcattgttctaactgtgagtatcaacatatcgttcaatatgattttgatttacataattaaatagcaagattatagataatgcacaaactattttatatgatcattcgaaatcacaaattatcatgtataataaatttattgatttttataataattatttcaaaaattataacaatagtaattcctaattaattgtgggtgtaaaactattttacttgtatgacagttaaactcatataaaaaggcataacaataattcaataaaaatacatatgctgatagaatatatgtaacgctatactacaggcactagttgggggagtgattcgtcctaatattcaagtatggttcactcgcatgaagggtccactttatgtgccacttttcaagccatttggtattgcatttgccactacttttgcagtttgcttcttttcaaacagccttcattatggaaggtactttgattctctttcatttgttgactccagatggatatttttaaacatcgtgtttttaaattaattatgcctaagaattttatgtctcctatataatttgtttttatttgtggaaaaaatgtgcagtgtgataggaacaactgtacttggaatggggtattatacagtaatgtatggacaactcagagaaaatgaagaagagacaagctgtgacgaaagctctgattctttggaca

SEQ ID NO: 6183 - DNA, 707 bp, Glycine max
  misc_feature (637)..(641): n is a, c, g, or t
  misc_feature (673)..(682): n is a, c, g, or t
atatataatttctctgtaatacaggatttgttgtttatgttcttgataaagtatgtgcaaggtaattatatcactttttctactttagatcctgctttttgaactatgaattcaattagaagctttgcatatatgaacagtaattaacaatacataccatttggcgtatcagtatgccacctgggcaagaaaagtttgtcggtatagcagaacttaagggatggggatactcaaacagtgacgtgcgtggatatcttagtgctctatccattttgcaggtaccgttttttgtttgtgttagtattcagacatgttataagacaggttgataaacatcttgttctgaggatcttttgtatatgtttgttaagatgttacacactatagttagaaatatggtcagaatcaatagtccttataagatttgaacaatgtgtgtgtgtgtttgcgtgtgaagttggaattcatacgttcttatatggttgtaattttttggaggcaggattactacccagagagattggggaagttgtttattgtgaacgcaccatacatctttatgaaagtgtggcaaattgtttacccattcattgacaacaaaaccaagaaaaaggttatgtttcaaattcagcttgtnnnnnaatgcatgatacatatgttggaggaaaatatnnnnnnnnnngggtttgacttgcattgcagatagt

SEQ ID NO: 6184 - DNA, 1025 bp, Glycine max
  misc_feature (599)..(599): n is a, c, g, or t
  misc_feature (672)..(673): n is a, c, g, or t
  misc_feature (705)..(706): n is a, c, g, or t
  misc_feature (717)..(717): n is a, c, g, or t
  misc_feature (721)..(723): n is a, c, g, or t
  misc_feature (727)..(731): n is a, c, g, or t
  misc_feature (739)..(745): n is a, c, g, or t
  misc_feature (772)..(774): n is a, c, g, or t
  misc_feature (776)..(777): n is a, c, g, or t
  misc_feature (781)..(785): n is a, c, g, or t
  misc_feature (801)..(808): n is a, c, g, or t
  misc_feature (816)..(821): n is a, c, g, or t
  misc_feature (824)..(826): n is a, c, g, or t
  misc_feature (828)..(828): n is a, c, g, or t
  misc_feature (834)..(846): n is a, c, g, or t
  misc_feature (852)..(852): n is a, c, g, or t
  misc_feature (855)..(857): n is a, c, g, or t
  misc_feature (862)..(871): n is a, c, g, or t
  misc_feature (874)..(878): n is a, c, g, or t
  misc_feature (882)..(892): n is a, c, g, or t
  misc_feature (894)..(894): n is a, c, g, or t
  misc_feature (896)..(896): n is a, c, g, or t
  misc_feature (899)..(904): n is a, c, g, or t
  misc_feature (908)..(914): n is a, c, g, or t
  misc_feature (916)..(919): n is a, c, g, or t
  misc_feature (921)..(923): n is a, c, g, or t
  misc_feature (926)..(937): n is a, c, g, or t
  misc_feature (943)..(943): n is a, c, g, or t
  misc_feature (946)..(966): n is a, c, g, or t
  misc_feature (968)..(976): n is a, c, g, or t
  misc_feature (982)..(985): n is a, c, g, or t
  misc_feature (989)..(992): n is a, c, g, or t
  misc_feature (994)..(1004): n is a, c, g, or t
  misc_feature (1008)..(1011): n is a, c, g, or t
  misc_feature (1013)..(1013): n is a, c, g, or t
  misc_feature (1015)..(1017): n is a, c, g, or t
  misc_feature (1019)..(1019): n is a, c, g, or t
  misc_feature (1021)..(1021): n is a, c, g, or t
acagaaccttcagatgcataggaggaggcacaaggtgccatggaagctactgaagagggagacaccagtggtgaggaagagagtgtttgtgtgtcctgagccaacttgcttgcaccatgacccatgtcatgccttgggtgaccttgttggaattaagaagcatttcaggaggaagcacagcaatcataagcaatgggtctgtgaaagatgctccaaaggctatgcagtgcagtctgattacaaagcacatctcaaaacgtgtggcacccggggccactcttgtgattgtggccgcgttttctcaaggtttgtaattcactaattttttgcttataatgattaaggattcttgattgattccacttatacatcaacatttgttttatttgtatatggttcttcttgattcacaaaatggttttccgttttcacaatttgataatgaacatgtgcggtagaatagatggatttatgtgtattaaaatttgggttggtgggggatgatgggattaattttgattgctttttctttctcctctttagctatttcatgtgctatacaaggattctttttatttttttattttctccattttttnatctcgtgattggtcatcaaatcatctcaacttgaacttgtgaggggtcttgttttacttgggatttgacttnnaaaaagggaaaaatattttttggaatggaatnnaaagtgaacantggnnnatgnnnnnaaaacctnnnnnnnaagaaaaagaaaaattccaatatttgnnngnnggannnnnttcccttttttttccnnnnnnnnaatttttnnnnnncannngnggaaannnnnnnnnnnnntcctgnccnnnctacnnnnnnnnnncannnnnactnnnnnnnnnnntncnccnnnnnnaccnnnnnnntnnnnannnatnnnnnnnnnnnntaaaancannnnnnnnnnnnnnnnnnnnnannnnnnnnnccgacnnnnaccnnnncnnnnnnnnnnncccnnnnanannncncnactt

SEQ ID NO: 6185 - DNA, 1650 bp, Glycine max
ttggaagagatgactcagcagcagaagtttgcggagactacttctatatggggaacaaagaaggatatagagaaggtattttctgactcatatttaacccttttgctagttgtgctaacaacaactactgatattaatgtgtggatgtgtacagaaattacagattagtaaatgtaatgactggtataaaacttccatttttttaggagtgaagttagaagaaccattagtacagttcatctcgtggaacaatttctagaattctagtccattctttgttactcttcgtataaacattttagcagtttattccactttacttagcagaatccaacctattttaaaataaactggtatcagactagataagcataaattattaaatttcaactcaaaattatacaatctcttagctttttaacaagactaagacatgcagtgtatttagatgataattatcactatactgacataggtgctgattgtggtaggaaaaaacaccaaaactgaacacgtgctagtttatgctaaaggaaatattagggttgaaaaatacaggaatcatgttgatatgaaactgagaaaaacaagaattttgtagaacatgacagccaagtttttcaggtcgaaggaactgaacagaaatttaaaatcatggattatcttttgtagttcctaccccaagaatggtattgagcattgatgagcctccaagttgttcacaattttaccctatcctcttccttgtaatttagctggtgaatgtatgagttgtgctttagcgagggatttaagattaaagcctttatcctgagttcctttctttagttgggtaaataatagtcttgatgccctcctacctgtgatggtattctgcagctgtttgtggagcatgcagtgtgctgcttatcatggcatatgtttgtgcttttccttcaggttttgctaagaggctagttcttagcaatctagttctatgcaaatcccaattcattagttttttcttttgttattttatagttcctacccaggccacttttttgttaaataatttaagatgcatttctatacttgctagttcctatatttagcctcacaagaatgcttgaatagaggtgctaatatacctattttatatttttttcattattgtacataattttaattaatcctttgagttatgcctcgccttataataaaatttatttagttatggttatatctccaaagctcaagtttagagttaacctattctcttgattcctcaatcataactatatcatccgcaaaaagcatgtgtcttccattaggtatcactcaataagttcagctcactttattacaatggttttaaactaatcttggaatctgtatcattttgcaggctaaaaagaagctagctctcagacaagatgaagatcctgattctcaaaggaatctggatgtgaaaatgaaaagtgttacagtaaacaaaaaggctcttgaaagtacagaatctcatgtttctcgcaatataccaccgtatgatgcttctgcaactacacctcaggaggcatatatattggacaaaatcatccttaagggagaatgggattatcttgaagacatttataataatttgcaacggggagaagaagcagacttcagtgc

SEQ ID NO: 6186 - DNA, 511 bp, Glycine max
atcccagtaagtcactaaacctatgttcttaaaagagaatttttttttgagccatgcttcccaattcaataatattgataatttcattaatttgttactcatgcatggcagatgggattcaaacatcagactttggggaatcgttaaggttccggaaggtcttgcaaggtcaagaaattttgggtgttaatactcccccctttgatggtattaatgctcagagtccctggttatacgagttagggaggtgctatcctggttcaaactgttctgggattcctccaacaggaaataacatcagagtgccgcatccggcatctgatttttcctgcaatggcataggctttagtgaatctttccggttccagaaggtcttgcaaggtcaagaaattcttccaagccaaccatatggaagagccttatctattgaggaggctcgagcaaatggtcgctatggattttatgatggctgtcagttacttaactccagaaatggatggtctgcacagat

SEQ ID NO: 6187 - DNA, 363 bp, Glycine max
catcaatcacagaaagcgcttcttctcctacttgcttcatattattgaattcgaaaaccgcgtctcttagcaattattagtatgtacagatctcgtcaccggaaaccaccgcgatcacacggcggcgatctccgctggatcctcgaagttcgggtccttggcgtccatagcaccgtgctccatctcgacgttctcgtagccgttgccgatccacgtgaacttcccgccgtggcctcccttcttcggcgatccactcagccccgtcgccgatttccgatccttccgcgtctccggcgacagctttgcattcgccttgtggctctttccggcgtccttcattattgttcttcttcttcttcgccg

SEQ ID NO: 6188 - DNA, 631 bp, Glycine max
ttgatagctgaagcatcttttctgtctttggctcgtagtggatacttcttttgatatagtgggaaatgtactggagctgctcttttcaccattttggtttgtcctcaatgttgtttggagcattggtaagtcatcatatgttttagttttctggtcatgtttgttaattgttaaatttagccttgtttttgccaacataaattgtcatatgatattctactaattgcttgcttttactctttctgatatatactgcagctacttgtatcttatatcctttattttgggttctctgggaattcctatatgctcctgttcgtcttgtcctggtgatattcggttttgtggcttccatatgttcacacatttgtaatatgcttggcaacacgtggcagtttgttagtaggattttccagtttgcagcatcttctgaagcaacagtcagtgcttctgaagtttctatgtggcgaactctttggaatgaccttttttcccaggttgtaagatggtatatcaatagtattttggatgtcagtgatttcattaaagactttcctgattgttaggttttttttttttttttttctttttccaaatttcccgggcccccaaaaaaaaatttaaggggttt

SEQ ID NO: 6189 - DNA, 461 bp, Glycine max
tggtgaatttcctcccgccatgtcaaccggctcatcccttcctttcaaactctgccatcaaaaagataggatgaaggattcaaataaatgtgaaagagaaggatgcaagagaatctatcacagtaaaatgtagaaatagaaggcattgcataaagtgcagaaaataagtgagaacatgaagcccaatacaattacatttcaaaatcaatattctgtacaagataaaaatccccagcgtcacctgagaaatgagtataccccattttaatcaatactccctgaatatgctgggcgtatttatagcagtccctgaattagaaaaatatcaaataaattcctaaaatttaaaaaatttattcgacatttatctaatttcaaggactactacgatagtgtctcacaaattcaggtactaaaataggatttactatgggagaaagcttcttctttttttttttttt

SEQ ID NO: 6190 - DNA, 332 bp, Glycine max
tctctgctaacaagatattcaagtggcagcagcatctccatagtagaaaccactcaaatgttccaaagggtcacatagtagtgtatgttggagaggctcaaaagaagaggtttgtggttccaatatcttacttgaaccatccttcgtttgttgacttgctaaaccgagtcgtggaagaatttggctacaatcatccaatgggcggtctcacaatcccttgcaaagaagaggcattcatcactctcacctctcaactacgtgcctcctgaacctgaaggatctatctatatatctgtcttcatttttcagcctgctgtattcaacatttgagt

SEQ ID NO: 6191 - DNA, 579 bp, Glycine max
acatttctttgattgaaattcatgatttgcggtccagactaagcatcattcctcaagatccaacaatgtttgaagggactgtaagaaccaacctggacccactggaagagtacacagatgaacaaatttgggaggtaatttggttttgtttgacactatgaaaaatttattcctatagtgcaagttatacatattaatttcttttaataaacatttcaggctctagatatgtgccaacttggagatgaagtaagaaaaaaagaagggaagcttgactccataggtttgacttctcaaacctttgaacataggcatatcatgtcttaaatgtcacaatcatatgtctaaatgtagtaatagtgtactattacttatcagtttgagtttttgcagttactgagaatggagaaaactggagtatgggtcaaaggcaattgttctgccttggccgtgttctacttaagaaaagcaagatcttggtgcttgatgaagctactgcatcagttgatacggccacagataatactattcagcaaacagttaagcaaaatttttcagaatgcacagttattaccattg

SEQ ID NO: 6192 - DNA, 390 bp, Glycine max
gatgagcggaagtgtcttcacaagacttctcagtaggttggtgtcagaaggccatgatttatctataccattggatcttaaggaatactgggcaagacatggaacaaatcgctacatcactatcaagtaacctgctgacattcacatatgtatcaagtcatgttcagttttggacctcttgcaatgactggcctctaaccttgataagcatggtatggttgaattttgcgaacactgatacggctggaccctacttttatccttataaatgggatagctgtgaagtatcatgtatgtacatgtgactttctaggtgactagaagtagatcccattgggtccctgcatctttttcagctttgtctgtccattatgaatacgttgcgtagga

SEQ ID NO: 6193 - DNA, 359 bp, Glycine max
agatcaaaaccaacatattccatgcaaacatgcagcagccaaaaaggatgattcttcgattcataaaactgtttcaattttctttaatttattgcctttatccataaaactttgtatcagagtagaagcattgtccaagtgttggggagatgaaaacgaagccacattacacacatgccaactttgaaaccaaatagttagtaagacgaggttgatgattgtaagcatagaatcgataaaatacactaagaaaatacaaatagtgttttgacaaaaaaaaaaaaaaaaaaaaaaaaaaattttgaattgcctttaaattggtttttccaaaaggggtttcggggaaaaccccaaaaaaa

SEQ ID NO: 6194 - DNA, 688 bp, Glycine max
aaaacttcaatcataatttattgatttaaatgcataaaagtgtccatcatattgacaattgtaaattggtgttaggtaatgtctttggtcaaaatatgtccatctaaataattgtttcaagtcaaaatatgccaattatgaatgtattttcttaagtactttatttacttttctgcatatgccatgaaaattgcaacaaattatgtacacaggttgttgcacctcgcacgttctctttagtttgttttcggctgctgccccatcccaattctgcagatcatgggaataagctaaatagtgatctactcgactcagtaaattcaactggaaatgctttcataacacacacggtgtgcataaattttcttaggagttttgttcttcattcattcattttcactcactttctttcccttgataataaccaatattgtgcaggttctatcaggggagtacattctacgttttgcagtaggagcaccattgacagaaaggaggcatgtcaatatggcatggcaaattttgcaagataaagccactgctctacttgagagtttataggatgaatctgctctcagcatcagcaattgcttttgtggacatccaatgtttcccaagactgcattcattttatgattttttcctctatacatgattccttctttttacaccattgtcatgtgctgta

SEQ ID NO: 6195 - DNA, 602 bp, Glycine max
tgaaaattgctatatgtgctgcacaaggtctaaccttcttgcacgaagaggggccttttcaggtacaactataataacactttgttttgtttttcatagtatggagcgaatgatttcaagtatgttatgattattaggttaattatacactttatctttgctgacatccttctttctgcttgtaggctatgtataatgagttctcaacagccaacatacagattgacaaagatttcagcgcaaagctttcaggatatggttgtgttggacatattcccgaagaagagatttcaagcagctcatctgtaagttctctaactgataagtgttttatgttatgttattcaatatatccagttagagtctattatattcagccaatattctctatattcttttcttcatatttgtcataaatatttatatttattcctttatatttgttcccattcagtatattcatgaatttatttggtgtcgtccaggctgttggaaacctatcaatggaaacactggagaaaggaatgctcactccaaagagcaacgtatggagttttggaatttttcttctggagctacttactggaagaaagaatcttgat

SEQ ID NO: 6196 - DNA, 433 bp, Glycine max
ggaatacttgcagatgaaatgggaatggggaagactgttcaagcaattgctcttgtccttgccaaacgtgaatttgaacaaagttgtgaaccagatcaatccataccatgttcttccagcctgaagcctgcgatcaaaggaacacttgtcatatgtcctgtggttgctgtcactcagtgggttagtgagattgatcgctttactttaaaaggaaacaccaaggtgctgatttatcatggggcaaatagagggaggagtgggaatcggtttgcagattatgattttgtgataactacatactctgttgttgagagtgagtacaggaagcatatgttgcctccaaaagagagatgcccatattgtggaaaattatatttgccgaataagttgatatatcatcagaactattattgtggtcctgatgctgttagaa

SEQ ID NO: 6197 - DNA, 532 bp, Glycine max
cttctccttcactaggtcattctccttctcgctcttttctttctctttatttctctcactctccaatgcttcatccaccgtttacttattcttccttcagttgacaacgcccagaagtttctcgaagcttccaagaaggggaacgtcattcctctcttccgctgcatattttccgatcacctcactccggtgcttgcgtaccggtgcctggttaaggaggacgagagagatgctccgagttttctctttgaatcggtcgagccaggccaaatttctagcatcgtgagaacgctttctatttttgtttttgtttgagaatgtgttggtttgtgtactgatttatgcgttgactgtaatcagggacggtacagtgtggttggagcacagccgtgtatggaaattgtggcgaaagagaacgtggttactattatggaccacgtggaagggcgcaggagtgaggaaattgtagaggatcctctggtgattcctcgtaggatcatggagaagtggacgcctcaactcttagatgaac

SEQ ID NO: 6198 - DNA, 469 bp, Glycine max
aatccttgcattagttgatgctattcatcttttccattccagatgggtgacattgtgaatgaacagtggattcaagttcagcatcttgagcaggctcttcacattaccaaagtatataaattttattttttagtttatatatttttggaaaccttaacatgattacatctttctgttcatgtttcatgtgttttttgagcttctcatttattttctatttgcccacttgcgtgtgtatgtgcaaagatgaggactctaaaggctcaaaggctaacaagtgtaacaagatgcacattcatgaaggtaaatttaagtgttttgaataactagtttgagtgattcaaacaaatttgttaatgtaaagataattaatacttaatccagtttgcagttgaactaagtacactcatccggtgtgacatttctgatttaaatatgtgagaaattgctaaagcttcctaacagtgag

SEQ ID NO: 6199 - DNA, 439 bp, Glycine max
aaaaaggaatgggaccatgtggaaattacatacggaggtatcatagagacctcactgcttaaagcaaccggaatccatgtattcagacaggatgatattcgatatgatgatccctatggcaagagaaaattagagcatgatctcaacagttctgaatcacaatcactcattaaaaagcctaggtatatgtggacaagcaagtgtcattattatcttatatatgaaaattatactgttaaattgtaatgaagttaaaaatggcaggttatcgaggtgggttggccctgaaagaattataaatcttctggggaatgctgcagatggagctttatttactaatcccctgaggagatataggcatacttctatggactcctcttgtccgcgatgccccgagttggaggagacatgtctgcatgctcttcgtgattgtccaaag

SEQ ID NO: 6200 - DNA, 563 bp, Glycine max
aaagcacggctcttctcacatatgcttcctggtgatggcatacctccctgcatgagttaaaaagcaaagtgacaagttttcctgtattagcagttagcacactagcaaaaacaacaaagcaccaacaggaaatataaacatatacaaccaataggacaccaaattatcaattccattagcacacacactttgagggggtgattaagattttagattatgtcaatcctcatagggtttgcaattaaatagacaactaatgtcttataactagtacctggatcttaacatatttaggagggaaggagccagcatagaagcttctggatgcatggctacagatttcatacagaccccaagcatataaatgagtttccccaagacaataaaatctcttccaagcaagtcaacaccttgcctttttttatcatatccctccatggcaggaagcatgaatgcagcagcatacatgggtaacttattatgagaatactccatctggttttgttgtgtgggagattgtaggctccaccggcgtgttttccctttcttgacctgattaggtt

SEQ ID NO: 6201 - DNA, 343 bp, Glycine max
  misc_feature (339)..(339): n is a, c, g, or t
gattggttggttctttgccatccattggtgagtagcacatcccacgctgcaaagcaaacaactcagtgaatggcaccaaaataaccacgaactagttgaatttgaagccatgtggcgacatggtgtgacaaaacccccggtctgccaccctttgtcattgtcaatgaatggactcctactgaccttgaatgttgaaacggtcaagtaactgggaaatacacacagcttttacttgagagattgcactcctcggataaattaagatgtgcatctaaatgtcaagcctttgcttgtttcacagccaaacttgtatctagtacatcatgcagctgacaaagngggg

SEQ ID NO: 6202 - DNA, 339 bp, Glycine max
tgttcttgcttgccactctctccacctttatgtctttttcttcagtgtaccaagtggagagagagccttcagctagggctacttggttcccgttatatgtgaatttgaagtggtcaagttcatcattccattggggtgtcttggtggcctcaagtgagaaggttttggagttgaagaggattccaagggcttggatccatgtgtagtctcggcttcttccttcaggcctgtgtccgatgaagcgtgcattcatctgaaggttggaatcggaaactaaggtgaagtgttcgttggtttttccgtggaagtagaagactctaccatctccaccaatgaaac

SEQ ID NO: 6203 - DNA, 390 bp, Glycine max
tactagaaggacatacaaagggaacttaggactctatccaaagaagaacgtaaaaggcagcagcttgctgtaacagatgtacttaaaagtgcagatgtaatattaactactttgattggggctttctctaaaaaactagacagcacttcatttgatttggtgattattgatgaagctgctcaagcacttgagatagcatgctggatacctatactgaaggtagtgtgaaaaagaatatgtcactgtacttgatgttattcataacactactgcattcagatttcagacttctttttatcttctgattacaagcacatgtcatgttttattgctgtttgaacacttcatattaccaccagtgtgtggtaggtgggagagggagggaaaatg

SEQ ID NO: 6204 - DNA, 357 bp, Glycine max
tgttctccccagtggcgttttcggaactgtgcaacccacaggacaagaaagtgctgctccaaatcaagaaggacttcaacaacccttacctgctagcctcctggaaccctaacaccgattgctgcaactggtactgcgtccagtgccaccccgaaacgcaccgcatcaactccctcgtcatattatcctctgttccccaaaccaatttatccggcccaataccaccctccgtcggtgacctaccttttcttgagacccttcaattccacaagctccctaaactcaccggcccaattcagcccactatagccaagctcactaaactcaaggagatctacatcagctggaccaatgtct

SEQ ID NO: 6205 - DNA, 572 bp, Glycine max
  misc_feature (388)..(388): n is a, c, g, or t
  misc_feature (391)..(391): n is a, c, g, or t
  misc_feature (397)..(398): n is a, c, g, or t
  misc_feature (405)..(405): n is a, c, g, or t
  misc_feature (409)..(409): n is a, c, g, or t
  misc_feature (413)..(413): n is a, c, g, or t
  misc_feature (418)..(420): n is a, c, g, or t
  misc_feature (435)..(435): n is a, c, g, or t
  misc_feature (445)..(445): n is a, c, g, or t
  misc_feature (456)..(457): n is a, c, g, or t
  misc_feature (492)..(492): n is a, c, g, or t
  misc_feature (501)..(503): n is a, c, g, or t
atagaattttggacttgcacgccgtcgtctcccaccactcaatcaccatgccttctccttctgcagatcaatcacaatcccaaccaaaacctaaccccaacctcctttccctcttcctcaagcccatcatcatgctccttctcacctccctcttcttcctcttcctcggcttcgccgccttcctcctcctcaacctcttcctcctcggtggcgccttccaccgccttcgcttccgcccctccgttacctccgcccccgcctcctccatcggcctcccccctcgtgatatcaacaacctcccccgctttctgctcgccaaaggatccgcaaaccgacccgactcccattgcgtcgtctgaaagatggcgaatgaacccaattagcatanctnttcggnnttaaaangaanaagngatannnagagaccaaacgtgngaaaatgggncacgtatatgnntcggaatttaacagcaaattgaaccatcaagacantggcaatgnnnaagccaacagtgatgatgattctaatgctgctgctggcttataaaggtgcattttttctgccagataca

SEQ ID NO: 6206 - DNA, 387 bp, Glycine max
ctcgttaagactccctattcctctcgttaaaacaccaccttctccctcttgttattattctcactattatcactatcgttatcgttatcgttgttatcatcctttccatcaccgttcccaaacacagagtcttatcgtctcgaagcgcggttccgccattgcgaagtgtcacgctgatagcgtgacacttcgtgatgacggagtctcgctcgcccaagagtcgttggagccacttccggcggaactcgcggcggagatgatgccgaagcatgtggcggtgataatggacgggaacgggaggtgggcgaaggtgaaggggctgccaccatcggcggggcaccaggcgggggtgcaatcgctgaggaaaatggtgaggctgtgttgcag

SEQ ID NO: 6207 - DNA, 405 bp, Glycine max
aaaaaatcatcaccaatcctcaagaatctctttagccattgtggcagacttcaatattcccatctctctttggacctctaaacctttcaaacctagcaccaaaaccatgaggttaaatgatgatgaaaccctttccaatctccttgttaatttcatagaagagatccttcattatggctccaacaagcacagtattattccctatatcaagttccccaaacttgattctgtttccaacttcaaagacattttcaaccttgcttttgtcaccctcttgttcctagtttgcatatatgaagccccttctgatcttcgttctggttgccttagcactttgaaagaacaattggcagggtgtcaatcaaggcaagcatcaaaatttctgatgaaactcttgggttccaa

SEQ ID NO: 6208 - DNA, 492 bp, Glycine max
attcgattccatatggcagtccactagcagagcggcgagtcaacctttcaagtattaggtgtccaaaagtgggcaatcctcgtagagatgaaaaaccagctccatatgctcgcgaagcaaaggagttcttgagaacacgcctcattggtcgtcaagtatgaaaatataatataaatatgtaatggcttatattgctatcattggtgaatactgttataattaatcgattacacctgttttcaggtaaacgttcaaatggagtattctagaaaggttggtccagcagatggatctgctgttccatcaggagctcctgaagctagagcaatggattttggatcagtattcctacccagcactgttaaggctgatggtgttgatgccccttcatctgttccaccagctggaagtcagcaaaatggggtgaatgttggggagttgatagttagccgtggctttggaactgtcattagacaccgcgactttgaagag

SEQ ID NO: 6209 - DNA, 1233 bp, Glycine max
  misc_feature (1225)..(1228): n is a, c, g, or t
tcctcgttgttacgtcgaaattaaacacacatacctgcaggttttttcttacttgtctttccttatatattcatcgtggttcgatttggttgtaacacttgttgttgttagggttttcataattcctgaaacaggggaaggaaatggcctcacaacaacacatcgagaagatgcagctccgccagaacttccgcaatctctggcactctgatcttttgagtacaattcaagctgacaccccttgtaagttctaacttgcaattgcactttgcaaacacccacgcagattatatatatggactatagtatctaacattgtttctcaatcttttcaattatatgcagattgttgcttttctctgtggtggtaagtcttctccaccttcctgcttgcaatttttaagtcatggatcaaagttgacttgcgttgacttatcctcactatcgaattctgcatcttttctaatttctatttggttggttatttatatttgatattttgaggtaacaaattatggttgagttctaaccaattttcggaaatgattgcctgagaaggaatttgacccccccaaaggattaattttatacagcgagccttttgggcaacatttaatatcggaaacagtgttactgtgtgtcttttgaggtgcttttgtgtctatcttttttatgagaatgcattcttcatacaaaatttcatggaccttacattttggtgttttgcgtctccaatgccttgttagttgaatcacaattttaatggaatttattcacggcataaatgtaattatttcttgtatttttcatgttaattttctgttgtcacgtgacagtgcaccgtgtgtatcatatctgctccgcaaacgagctctttacgatgatatgtcaaggtaataactgattctgtacaagttctcccagatttcaaaaatgaattatatggtttaaattaatgtgtgataacttatatggttatcttttgtttactccagatacacatgttgtgctggttacatgccctgcagtggtcggtgtggagaaagtaaatgtcctgaactctgccttggtgcggaggtatataacattttttttacatgttttgcttcattttaaaaggagtatctgaatatcttttatgttggtatctatgtcacattatatgtatattcggtgcttatttttcatggcgttttacatgtactctgtcattcatttcttcagnnnngtctg

SEQ ID NO: 6210 - DNA, 347 bp, Glycine max
  misc_feature (335)..(335): n is a, c, g, or t
gcatcatgtgacactagtatcaaagacgacaacaaaggtaagaagaaggaacaacaggatcttgctctcgacctcaaactcgctctctagtaccaatcatggaccttcaattgtgtatatattgcaatgatgcaattcgcaaatatctacaatttgtcatctatcaagttctttatgtattcccgtcacaaaaaaaagttatttatatgttgacgcatgacttgaccggggaaatggtttccgacgaataacgtacataagtacttttatagcagttcgattaatggtgtccggttaaagaaaacgtgtctgaaggtgttttttttttaatgttngaaatgtatttt

SEQ ID NO: 6211 - DNA, 675 bp, Glycine max
  misc_feature (661)..(662): n is a, c, g, or t
tgatgtgatatatggttggttaattaattaattaatttcatcctttcacgagtgtttcagtttctgggggtgtaatcaattttggttttaccttaaatttttctcttctttgtcaagtttacacctttgattatcctggttccattcctatctcaattcaccatgaaaaaaggagcttctttttgtcattttttaaatctttttgtgttgacttggctatgctaataattaaactatgtattacatcgacttttcaggaccaagctgaagcaaacagaggtggattgcgagttcctgaagaaatgttgtgagaaactaacagatgaaaatcaaaggctgaagaaggagttgcaagagctgcgtgcacaaaagattggaccaacaccattatacattcaactctccaaggccacaaccttgaccatttgttcatcttgtgagaaactgttgaagccaaatgaagggaacaacaaaggagccatttccaatgtgatccgaaacagtagcaacaaattgaagaacagcatagagttagggggtatctagaaactatgaggaactcataatttggtgaaggatattggaatgtcagaatgcaattagtatgaaacatggatagtttagtaaaaagaaaagtacacaccaccagtccccacatcgnntaatttgtatagc

SEQ ID NO: 6212 - DNA, 414 bp, Glycine max
caggggcagaggaagaggctccaacaccaccacaaggggaaaaatctgagagcagagaagagaaagaggatgtgatggatgacgaggaagaagatgaatttggcttgtctgatatggtgctttcagatgacttctttgaaagtttggatgagctgagccaactcactgctccttctgttgtcactggagactgcttcagtgaccccttttctgcaattgcaatcccttcttgggtggctagtggtgctgctactgctggtggatgtagatgattcttttgggggaaggaaatcatcacaatgcttttcattgatgacaatatggaccttttatttatttattgtttgtagaggaaatgaaacattttggaggaatctttactaacaatggtttgtgaattggaggaaccccccc

SEQ ID NO: 6213 - DNA, 366 bp, Glycine max
aaattactcttacttttattttatatattcatttatatgtatatgtttccacacttcatttaacaaatatgtaaatttcagtactctactggaactttcaggataaaaagttaagataaaatctttcttattctcttcaataatagggatgaagtcaagtgatttactcagttagggcctttggagaaagtaaaaacaaattaatatgatatgtatttcaaaatattatctgcctaaaatttaggtcattgtaatttcaggagttgaaagtgagcagaaatgcgattcttgtactggctttccttgcatcatctggacaactgggttttgaaatttttgttggtcataagctctcttgtagagggg

SEQ ID NO: 6214 - DNA, 469 bp, Glycine max
atgatatgagtagctattattccactcaaacgaagaaacatactgtcgaatggggttgaggcaaatgtcatgaaatgatcacttcgcatgttaaggtagttactatagatctttgtatgttactctcttgagctacttgagaaaatattcagcagttcttctttgttttgggaatgcagattttctcctgtgcctactgcagggcaattggctccagagggatagagttagagttagatattggtattggtaattggaatatgcgatttactctagtatgctatgagcaacttcaccgtacttcatgctttcattgttcccttgatcgacctgttcctatttaaatttaattagcattcctgggatcatcagaatttcctatctgcaccttagtagcaagacctatttgttactgtctgtgctactttctttttcctatattgttcaagaggagaatcagatgaattcc

SEQ ID NO: 6215 - DNA, 1220 bp, Glycine max
ttttagtttgtacatatagaatgctatgaactcatgatttgttgtttgaggaattagaaactgtatacctttgccccttgattatgttgcatggaatgggttgtagtatcccttttgaattatgatatggattacaacatctttaaaaaattatgggtatgacatggagtttcaaaaacttcaaaatagtaagcttttggttttgattccctaggtcttcgtagaggtaatggaaaatggaaatgactgaataatttactttactccctggatcattttcactttctgttgcaagcacatacgaagttatctttttcccaaatttttccattcattcctcttccactacgtcagctgaaccaagcttcaagcgtaccctttgtaaaatgtgtaccctgcttaaaccttttgaaactttgtcagcggcgaatattatttaagtgaggaggtgacatgcatgttgtttatcttccccttctttttaacatgtttgtttgtttcaagataaagcacgtcacaggaaccgacaccgttaagctatgtttcatcacaagatttataagagaagattgtcatagagaacatttttcaaataatgctcacagttgactttcaggtcaatttcgtagtaggtgctatatataattgaactgtaaaatttcatttccattctacctgcaaatatgatagtgttcagtacagtgggaacaaatggtttaatagagggtaatacattgtacgcatacgacatggttatgactctgatacaataactgccttttaaattcagtgtaaatctctttggtaggttttgttatatcactaacagtaactacgcggtaaattttacagaacctatgctgactattggcagcatcaatcctgtgatgtggaatgacgactggacagttgtaacggaagatggaagcctttcagcacagtttgaacacaccattctgataacacctgacggggctgagattatgactcaatgctgaaagatgcaacacttgttatttatggataaaaccacatcgagaaacttcattatttaaatgcaactgatttaattacttccagttcgtatctggaacatagtttatgctctcttccgtgctccaattgataatttttttttcattcttatgggggagaaaataagtacggtgtggcttgagcatgttggagagacggaaaaaaataatttctgctgagggcag

SEQ ID NO: 6216 - DNA, 319 bp, Glycine max
aaattagaccgagacaaaaccagctattttttttttagaaatggcgaatagagaagaaaacaacgagggtcacaaattcacagtgaaatatgttggactcaacggaatggaatgcgaaggcaaattgccgaggagggtggtgggagtgagaaatcactgttaccttttgaaatccaaaatcggagagggttcattctccgccgtgtggagagcggagcagagaccaccaaccggcgttgacgtggcggtgaagcaggtcttcctctccaaactcaaccctcgcctcaaggcatgtttggattgcgagatcaatttcttg

SEQ ID NO: 6217 - DNA, 422 bp, Glycine max
cgttcttctatttgcaaacactgattttccattcaattactgctattattatcaattattattattttgctgtgatcaaattggtttatcgtattaagaattttcattattattattactgttgagactttcctcaagtcttgcaccaaagaactgggttcccagttttctccaattctagggcaactttttcggctaaatccctttcttcccatcgaagcgagctctcattgcaaattaaacgcgctttgcgtgctgcgatcttggttgtgatggaaactagggcataaattggccgtgcagaagaaaaaaagcgtttaaagaatgttcttcagcggcgatccttttacacggaagcgtgtcgatttgggaggtcgaagttcaaaggaaagggaccggaaaaacctgttagaacaaacacg

SEQ ID NO: 6218 - DNA, 420 bp, Glycine max
  misc_feature (411)..(411): n is a, c, g, or t
  misc_feature (414)..(415): n is a, c, g, or t
agctgtgtggtggtaagtccaacttggcctagcgaagtttcaagttgctgttgtttgcaggagaaaaatgtggttcgtgtacgtgtgcgacgaggaagagaaggaacttggaaggcaacaagcccctgggtcgtgtccctactgtggagccaaagttgaagccatggatgttgagatccagtccaggctttgcttcttgcccctctgcttcaagatcaagagaaagtacttttgtacccactgcgctaggcgtttagagttgtatatggattactgaaacccaccccaaatcctcaaatctccaattcctatgcttaattacaacagggactttctggtaaatatactaagtctaggtgctcttcattttgtctccttttttttttttttccctttttaaattggggggtnggnnggggg

SEQ ID NO: 6219 - DNA, 620 bp, Glycine max
catctgtgagactgtgtttctacttttcacttcatcacaggttgtggacacgaaaagagaaggagatagcaattgtgacacatagtggattcttgtttcatactctgaatgcctttggaagtgattgccaccccttggtaaagaaagaaatatccaagcagtaagctcccatcatcatatacctctgacttagatatttgtgattcattttcctcttagttaaccgagttgaatatgcacgatttttgagaaaatatctttctgtttctttctttgaaaacattttatgatttattcctgatgtctacatttgttgaaagaaatcattactggctttgttatcacttatctatcttagatatgtagaaggtaattgccatattttgcacttgttatgtgaggcatatgttgttcttatgtggtaggggatcattttcctacaactgttaaacattgatgaccattgaccaatctagccaatcctgggtgatgttcatcagtttatattttgaagtaaatgattgattcgtttcacatgtccttacagctttgctaattgtgaacttcgctccatggtcattgtggatagagggtgagtttgtgaaaatatacataaaaaa

SEQ ID NO: 6220 - DNA, 400 bp, Glycine max
caacagatattcacatggccaaaaaagcacttagtgaagcactctcaccaaacaaggcatcatcatcatcatcaaccttgttagctgaatcaaattcaaacctctccaatgaaaatagtaccttctataatagtaacactaataaaccaacaacaacacaatctatgtgctatgcttcaagtgctgataacatagctcgtttgttgaaagggtggatgaaaaacacaccaaaatcagcctcatgtgctgcctcggctgtgactcaaaattcctgttcttctagtgaaggaattacaacaacaaagggaagcacaacaagcactagtactgttgaattgtctgagacttttgagtccttgtttggttatgagtctttcgattggttatgagtctttcgacg

SEQ ID NO: 6221 - DNA, 378 bp, Glycine max
  misc_feature (373)..(373): n is a, c, g, or t
ttgctactctaagatcttcagacagcttttctgcttttgcaatagcctctgacaaaccaaaaagcttttactttggcatacaaccaaagtgatatgacttacagaagcccagtgaagataggactctgttttctgtagccccaaatacttgtctgccaaaagattagctctgtattttcgtctccagctgatggtttaattagtaatcttaattctcaactcttcttttgaagccttatacaatacaagccatacacagttgatcacatggttctcagaaatccacgaacttgaactaggaagctattgagatttttcctaaatctctggtaatttattctatcaagggaggaagaaagctgatttgcacttntctta

SEQ ID NO: 6222 - DNA, 630 bp, Glycine max
ccttttttccgaagcgaaaaagaaaaggcttgacttgagagaaatagagcttcgaatcgaaactcagaattagaaaaaaacacaaatcacaatcacaatggcaaggtacgaccgagcaatcaccgttttctcccccgacggccacctcttccaggtcgagtatgccctcgaagccgtccgcaagggcaacgccgccgtcggcgtccgcggcaccgacaacgtcgtcctcggcgtcgagaagaaatccaccgccaagctccaagactccaggtaccactactcttatcaattcccccctttcctttcccttattaggttttttaatcggcaaatgttagttttgttagcagagaggattttccctcttcccttaaccatccaactcaccttatatctctgccgttcccttaataggtgtaaaccaaaaaaaaacgacgtcgtttcaaattaaacactgatttggtgtgtcgttttcgcaggtcggtgaggaagattgtgaatctggacaaccacattgcgctggcatgcgcggggctgaaggccgacgcacgtgtgctcataaacagggcacgtgtggagtgccagagccacaggctcaccgtggaggatcccgtcacggttgagtacata

SEQ ID NO: 6223 - DNA, 530 bp, Glycine max
tcccactaaatacagtacaggtttgctttctatttgtctctaactggtttgtgctccctcatttattcagaaggctatccttatgaactataccttcattaatttatcaacagcttctctgggtaaatcttatcatggatactcttggagcattagccttggcaactgaaccaccaactgattccctgatggatcaaagtccaaagggtcgaaggtcaattttttttccatcattttttttatgaaagcaagaaaattaaagagagaagaataatgtaaaagatcaaagtgatatatatccttcacaaaataccaaaacagcagggtacaattaaagtgagcaagtaataaaacattgatgcagtaaaaagttttgtgaatcactctcaaaataatcagcagccaaaagctatataaagattccagtgaatactgaattggttaagcttgcatggattttacataatgtgcttgtgggcaatcctagtgttgaagctccattaccagaacatcagatgcagtgccttttt

SEQ ID NO: 6224 - DNA, 411 bp, Glycine max
atcatttaaatgtctcactaatcgcttagggaagatttatctgcaggtagcctgttgcaacatttatggatgttgaaaggaaagtgtctcagtaattttgccccttcatgtttcatttaagtcggtgttggacagatgaactcatgttggatagaatttattaaacttttgttttttcccctgtaatggatgactagtgtggtcataacagactgcacaaagcatattaagctgaagagaccacacagttgttgccatggaagatcaaaattacagcctacaattcaacagattttcacgttgggttgaatggcccagacccagagggattccttttgaattcagtctttttgggttcttaaatccctacaaattgtttatttctaaatgttgtaggccaatgaacacatc

SEQ ID NO: 6225 - DNA, 360 bp, Glycine max
cacactgaaaccatgccaaatgactcaaacttcagtgtccccatcatagatctccaagatatagacacaaactcatcccttcgtgtgaaagcacttgacaagattcgaagtgcatgcaaggagtgtgggtttttccaggtggtgaatcatggtattgctgttgatcttttggatgagatgatatgtggaatccgtaggtttcatgaacaagatgctgaggtgagaaaaagcttttactcgagggatatgaataagaaagttagatatttctccaatggtactctttatagagaccctgctgctaactggagagacacaattgctttttttcgtactcctgatcctcctaatccagaagaa

SEQ ID NO: 6226 - DNA, 921 bp, Glycine max
  misc_feature (812)..(812): n is a, c, g, or t
tcgcaaggaaagttagtgacctcatccaccatccctagtattgattaagtcttcttggttgtccggtcatttgattgtcttctgcaatattttgtaggcactaaataacttggggagtatttatgtagattgtggtaatcttgatcttgcagaggcatgctatgagaatgcccttgcaattaggcacacaagagctcatcaaggtctagcacgggtttatcatcagaaaaatcaacgaaaagctgcatatgatgagatgaccaagctaattgaaaaggcagagagcaatgcctcagcatatgagaaacgatcagaatactgtgaccgtgagatggcaaaggttgaccttgatgtagcaacccaactggatcctttgaaaacatatccgtatagatacagggcagcaggtacttcacctatctttcattctataccatctgccatgttctttttaattggaaactgggacttagttaataactgggttatgacatactaatctacagttagtcatcaaacttgctttcatttactacagaaaacttgttaaacatgaagtatttttattttgaaacttgatgttctaattcagtgttttataacctgtttcctatgttactgacaacaaaacacttgttgtgtattggatttcttggcatggccaagccctgaagcctagaaatatgtaatgtgactatgttcagtctgtagtttgatttgtactttaaatactaagtccatctatgtttataagttgattccttcctgtatttgggtggtcctcaatctttgaagttgtcacgatcacacanctactgctattgtggttaaatacagattgagaccctttgcaagttttaatgagggatagagtatcattttcaacagaaaaatataaattccatgcatatttttatgatg

SEQ ID NO: 6227 - DNA, 463 bp, Glycine max
atatgctgcgagataatgatcgcgatcttgatccctcctctcggagtttgctttcgccacggttgttgcagcgtatgcttcctttctccctttcacacacacactctttctctctctctctcttcgcgagatctgagactgtgatttcatttatgcaggtcgaattcatcatctgcttgctcctcacaattctaggttatattcctggtataatctatgctctctatgctattatcttcgtcgatcgtgaccagtactttgatgaatacaggcgtcctctctatgcacaatactgatgataattttagtttgtatgcctatgagtgatgctcatgttgatcgtgtgcttaattactgacaatttaagctcgtgtgcttgttgaaattgatggtttgtagaatttattgtttacgctctcgaagcttcaatgacttttatgccataaggattcttctaagtgtg

SEQ ID NO: 6228 - DNA, 359 bp, Glycine max
cattaagaggtaggatcactcaaatattgaattggaaaaattactcatttagttgttactttatcagtttagtccttgcacttaaaaaccatctcttttgatccattacataaattttatcttctagtttttgtcattttgtatcgatagagaccaaaagaaatctgaaggtgcttttacatgaactgaaaatgatgatttttaagtgtaaggatttaaaggtaaaatttgttcaactatagggatcaaataattaatctttcttattgaattggtagtttggtacataattgagttgtagattagtcaatagctttgctgcttgtgttcaaatactgtcagcattcttcccacatata

SEQ ID NO: 6229 - DNA, 329 bp, Glycine max
cgtgttggatcgcgtacgagaaagtgtgccccaaaaacgcaccgttcaagcagtcacacgaaaagggcacgttgatccgtgtttggctaagaatcacgtttgggttcttaacacttgggttgtattttagaatctccgatgttggccttccgaagaggttgctaatgtaagtgaggtttgtgccgttccctaagtaataggaagctaaagcaaggttgcagccagtaacgcaactacctttgactcttgtaatcgaaatcaataactgaattaagagaaggaagaaaacatggggtggttttgattttgtagttgggtgtgtggtcatt

SEQ ID NO: 6230 - DNA, 497 bp, Glycine max
atttcaattattttcctatccatcattttctgcgaaaatatatatagtgagagtttctacgtcgatatttgagttatgaccacaaactctcagaaaataaattgggttacatgtcttttcttgcagctgccacatatccagtagattaacacagaaaagcgatgtttatagctttggagttgttcttttggaaataatcacaaaccaaccagtaatggaaaggaatcaagaaaagggtcacataagtggaagggttaggtccttgattgagaaaggggatatcagggccatagttgactcaaggttagaaggagattatgacattaactcagcttggaaagccttagaaatagcaatggcttgtgtttctcaaaatcccaacgaaaggccaatcatgagtgagattgctattgaactaaaggagacattagcgatcgaagaattagctcgagcaaaacattgtgatgccaatcccagacatttagttgaagcggtta

SEQ ID NO: 6231 - DNA, 397 bp, Glycine max
tactataaaattcgtgattatctctattcacagttttatttgctttagatttggttgtgctagtgcaatggcaaatcatgaacttctttccctctgccctgttttctctggacctgtttttctgataaggtagagaatgcaaaattgctctggtaaatacatggttttcaagactaaataggtctgagtagcagtgctcgggcagttgcaaactgggttaatttggtagccatttgaacaagattcacagggtccctcactttgatgttttcgatgaagaaatcacgtatcatcatttttgtgcctctgatatacatcaaccaccatagcttctggttgatgtgaacttcaagtgtgtttaatcttcaagtgtgtttatttcctggtaggctccaaa

SEQ ID NO: 6232 - DNA, 378 bp, Glycine max
cctcaaaatattggaaacatttcaaagcttaggcagcttgatttgtcactgaataatcttagtggagaaattccagtcgcctttgataatctgcgtagtcttagtttcttcaacgtttctcataacaacctctctggtccagttcccaccctacttgctcaaaaatttaactcgagctcatttgtggggaatattcaactatgtggctatagcccttcaaccacatgtccctccctagctccttctggttcacctcctgaaatatcagaacaccgtcatcataagaaattaggcaccaaagacataattctcatagtagcaggagtgctccttgtagtcctggtaacaatttgctgcattctgctattctgcttgata

SEQ ID NO: 6233 - DNA, 385 bp, Glycine max
tttgagttttgaatcccatcacagtgatgtagaaattgtcagacctgatgtgctaaaagctaaagcattcaagccgtgtgacatgaaatatactgattatacaccttgccaagagcaagaccaagcaatgaaattcccaagagagaatatgatctatagggaaagacattgtcccgctgaaaaggaaaaattgcactgcctcattccagcccctgaagggtacacgactccttttccatggcctaaaagccgtgattatgcctactatgctaatgttccttacaagagcttgacagtggagaaggctgttcaaaactgggtgcaattccagggaaatgtgttcaaatttccaggtggagggaccatgttccctcaaggagcagat

SEQ ID NO: 6234 - DNA, 383 bp, Glycine max
agatcatgaggggaacggctgttatctgaatgaggggaacggctgttatctgaatgagcctgagatcccacattagagttttgagaggtaaataagttggggtatgagaaatacgagtcgtcgtccattgaaggtaatctcttaggctggtgactcgaggacttgtcatccaatacacgatgatcattgggtagggaagaagcaaaatcctccttaagtgtctcaaaggagggaaaacttgatgaatgagagtctggggaagcataatgatcctggtgatgttcaacatcgtttccattatggacatcagagttacctgcagtattttgctcagtgaaatgcttttctattattgttggagattcattactgccaccagcata

SEQ ID NO: 6235 - DNA, 397 bp, Glycine max
gtggtggagatttgagggattgaatagttttgagggaagaagaagagtatgataaacgggacggttaggtgggaatgttgatggaaatgagagagagagagagtgtcggagagagaaaggggaaaggaaagggtattaggcagtgtgggcccacatgtctggtctggtttgtgcggttcgtccattgatgtttttgctttaacttgattgtacttttattattcctatactttctccttcttcttcttctagattctctctcgtctttttctttgtctacactctacactctggctcgttctaatcaagcacaattgctgaattgtaattggacactacacagtacatttatcgtcacttcccaatttctcatcctcgtaccatatcgcgaaataca

SEQ ID NO: 6236 - DNA, 365 bp, Glycine max
cagaaaaagagtatttagaatcgttgacgtgtccaagcttcaactgctactccaccgatgaactcccaggtatcgctcaaagcaggattcaaaaggacgacgcgtcgttttcggcctctcaaaatgacgaccctgacttcgagttcgccgcgtttcgagacgacgccttcgagttctccaacgacgacgccgttttccctctcttcaacagcgacgttgcgagggaccgccggaacagtgtctccggcggtctcgattccgacgcggcggtgctccggtttccgataaccggcgaggagcttcgaaggggtgagcacgatccgtcactgtcgccgtcgtcggagtcgtcgtcggaggcggatgag

SEQ ID NO: 6237 - DNA, 408 bp, Glycine max
cttctaataactatatcgttggctttgagaagaaaataaagcggttccgtgactatggtctctggttggtggatgatcatgcacatgagtcccctctaggaggattatgatccttggtagatgaaagacactagtttatcgttagctttggttcaagcatttggattaagaacatgctttctctgccaatttgttcatcctaattgcttggtggctgatttctgaagagattacaaccgttgctgtcaacatgcaacatcgactaaatgatgggttggaaaaaaaatggtcttttgctttcaattttgtgaaggaaaaaggtgcttacaaaatgtagattttatttcaaggccctaggaagaggaggatatatttttagttggttgttggagttgtacgtgacaagtg

SEQ ID NO: 6238 - DNA, 396 bp, Glycine max
acgccgcatcggaaactccttccaaatccccgccgcgtcgctcaccgtcttcttcgtaggaagcgtcctcctaacggttcccatctacgaccgcgtcatcacccccatagccaaaaaaatctcacacaacccacaagggctcacccctctgcaacgcattggggtagggttagtgttctcaatcttcgccatggtgtcagcagcactcattgaaataaaacgcctaagaatggcacagttcttctttgtggggtcgggggaggcatttacgtacatagggcaactagatttcttcctgagggaatgccctagagggatgaagaccatgagcacgggtttgttcttgagcacgttgtcgttagggttttttcttagttctttgttggtgactttggt

SEQ ID NO: 6239 - DNA, 466 bp, Glycine max
ggctccagtttgggaagtgtttcagaggagagggctaggcttgagtaagtaacagacttaatattttaccaaatttatgtgcttctgcacctgtcctaaactaaagttggaagtggaatatcagaatttcgtgttgctttggatgtctctttttttattggaaagcaataataatatatatatatatatatatatatatatataatgtcctgtcatgaaaaatagtgaactgaagaagcagagagagctagctgctgctgccaaagaggaggagaaaaagaagagagaagaagcaaaagcagcggctgccgcacgtgtgcaagccaagttagaagccaaaaaaggtcaaggaaagggtaaaggtaaagcaaagtaggaagttatcaaacatctacatgagtttggtatatgatgacaatcaaatagttatgtattatacacaattcagtatctcacttccccgttg

SEQ ID NO: 6240 - DNA, 575 bp, Glycine max
aaatgcactcggacgacagattctcattaatgcaggtggtgctttagagttaacagtttgtccatctaagtattctatggagttttcatctgtgctttacaaggactgggttttccctgagcaggcactgcctgaagaccttgtcaagaggtaaaccattcaagcaaaatgccattgctaattatggattgtttttattttctgaatatggttgaattcaacagatcatgcaatatttcaacttgtctagtttaaacaagtataaccagaataacttggatggtatcatattaatataagtgagaggaattttgttgttgatcagttgttgtatctttgcttctttcagaggagtggctgttaaggactcaacttccccgtatggccttcgattattgattgaggattacccttttgcagttgatgggctagagatttggtttgctatcaaaacatgggttaaggactactgctccttttactacaaggaggatgacactatcaagaaagatactgaacttcaatcttggtggaaggaaataagggaggtgggtcatggtgacaagaaagatgag

SEQ ID NO: 6241 - DNA, 316 bp, Glycine max
acagcaggcatggctccccgcagtttcgtcaccgccactgccggcatgcgccgctgccatctcggcgacaaaaacagctctaccaacatcggcattggaggcgacagtagcaacatgcagaggttctacacggatgatgcctcggggctgaagatttcaccgatggtggtgctcatgatgagcctctgctttatcgactttgtcaccgcgctccacgtgttcggcaaactctaccgctccaaatctggtggcaccgtttgatcttttggatatgtagttccgattcgtacccgatcgctttgttttcggtttttta

SEQ ID NO: 6242 - DNA, 395 bp, Glycine max
tagcagcccgtccttctccggatcatgatcatgatctggatctggatctggatctggagcgtcgattccaggccctcaaaatgaaaaccaaatctcaacctcaagatgatctctctgccagattcgatgccctaaaagccaaatcatcatcttctgttgtcacagcatccaattccaacgcccaatttgattatgctgaagaagacccagaggctcaagttcagaaactcatccagtgggctaaggatgctgcacgtctcgatccttctcccccctcagatcacgaccaagatatctagaaacctatcattacaaattcatacatataaacttccttttccttttcttttctttttttatatgatttggtgcatttgatctgttaatgtgtcagg

SEQ ID NO: 6243 - DNA, 1093 bp, Glycine max
gtcttggataagtcgccagggggttaggaagttaagtagaaataagcaaatgatggtatacaaaaccttccaggttgcaaattatgcaagatcagaaaggatattgctttctcggaagcaggttgggagtcaaccttggtctaaccacaaatacaaggttgatgacaagatagagttgctttgtcaagatagtggcatcagaggctgctggttcaggtgtacagttgttcaggtagcccggaagcagttgaaagtccaatatgatgatgtccaggatgaagatggaagtggaaatcttgaggtataatcaagcttaagatattcttaattcaattttctggttagtacttagtactattgtaaaatatgtggataaataaaggggtttcctatataaggttatgtagttttaggcttttagcaactagtaaaatgaataatgttctttaatccttgcagttgaagtttaagcaaaatcttaccaagtaatgaaataatgggtttctgtatagaattagaaatcattctagcttaagtttaaagtgaattaattagttatacttatactgaattaatcaaggatccggtattctactggaataaactattccctgtttctaataatctgctaaattataaggatctactgtgtaaaaaaatttcatttaaaattgaatcccatgggaataactaattgtgcttgagatattctttaacaatttgtttgatatctctgctaagtaatggctttgtaagaatggcaggagattatttaggcaggttttatacatggatgagttttctagcggagtactagaaattcatttttcttgttatatatttaaaaatgtagagggtaatgggatggctaacaatgactggattggaatgacagtcaaatatgatacaatttgagacttatgatgagttatctacataaataaagttataacaccaaatggaaagcagaatgttccaaagaaaagatttgttgattcacttatcgcatactttttcaccactcacttcttggttcataacttttatctcaatattttccatattgtaggaatggatcccttctttcaagcta

SEQ ID NO: 6244 - DNA, 406 bp, Glycine max
attttttgaacttctcccagtcagctagtaaggtttcaggtcctgtagccattattgctgttggtgctgaagtggcacggtcgaatatcgatggtctcttccagtttgctgcgatactcaacattaaccttgcggttataaaccttctgcctttgcctgctttagatggtggcacattggcattgatcctaattgaggctgccaggggtgggagaaagctacctttggaagtggagcaaacgatcatgtcttctggaattatgcttgttataattctggggttattccttattgttcgtgataccctaaaccttgattttatcaaagacttgttgtaattattgagaattctagttagtagtgggcttcaaaaagtatttcatgattctcatctgcaatgctgttg

SEQ ID NO: 6245 - DNA, 315 bp, Glycine max
gacagcaattcaaggaagacagagccgaggcagctgcaaaactcgcagcgaaagacatcggcgacatcaacagaacaaacgagcgcgacgaggggtacgacttgcacgacgaagccaacttcaagcaagcacgagctgaagcagctgcaaagctggcggccaaggatctggaggacgctaacagattaagagacaacactttcaacacatggaaagagcaacatcagcatgatgagaacaaacccggtgtgatagggtccatgtttagagccgccaaggaagccgtggttgggaagcctcaccacgaggaagttt

SEQ ID NO: 6246 - DNA, 604 bp, Glycine max
  misc_feature (460)..(461): n is a, c, g, or t
  misc_feature (585)..(593): n is a, c, g, or t
  misc_feature (596)..(598): n is a, c, g, or t
gagaaagatgttgaagcccctcctggagtagaaactaaaacagaagaagaaacaagtagtgttgtcaaagagagggagatagtggttgaagaagagaaaaagaaagaaaaaaaggaagaggaaaaaccacaagtaatagagacaagtgatgagaaaaaggtggaagaaaaaccagctgagacttctgcaaaaggggaagagaaacctgctgaagaagctgctgcagtagttgagcaagcagaaccaccaaagccttgaaaatttcgttcttaatagcttctatatatatgtagctgcttcatgaagatgcagaagatcatatatatacgtgtattcttagtttgcatatactccaaaattgtcacataccattcccttattcttttattcctgtgtaaaattggttttgtgctgcttagtttgatattgttgcagatttggtgatggatatatgcaacannagtaagaatacacgtatatatatgatcttctgcatcttcatgaagcagctacatatatatagaagctattaagaacgaaattttcaaggctttggtggttctgcttgctcaactactgcagcannnnnnnnnaannntctctt

SEQ ID NO: 6247 - DNA, 332 bp, Glycine max
ctgaatcttcctccttgattgaagacaagcaagaggatacagaagatgtgagcaaacgtaggaagaaagaacccgaagttactgtcaaatctgccctttctgcagcttttgccaaatattctggtagagttgggaagaggaaaagcacttcacaagtggaggaaaaagaagaatcaattatttccaaagaatcagaagctgaaacataaagttaccatgaagtttttcactggttcaataatttacccttaaacaatataacctcatgagattatttaatctctatgcttgtaaagccatggaactctattgggagtgtaaacgggaaacaa

SEQ ID NO: 6248 - DNA, 210 bp, Glycine max
ccatagtagctggttggattggaaaaaaagttgagaaagataagtagcttgtagtggtttccacccacagtagctcttaccccttctaatatgcttctctatatagtattttcaaatcaacatttattttccacacttttggtcatgtacatccttattattactttaccataatgaaaatgatgtttaataatgaaccgtctattcgcc

SEQ ID NO: 6249 - DNA, 409 bp, Glycine max
aagagttgtcaacatgcttcagggttgtagaagtgttgatgagtttgagagactgaacaagatagatgaaggaacatatggtgttgtatttagggcaaaagataagaagactggtgaaattgtggcattgaaaaaggtgaagatggagaaggaaaaagaaggttttccattgacttctctcagggaaataaacattcttctttcctttcaccacccatccatagttgatgttaaagaagttgtggtagggagtaaccttgatagtattttcatggttatggaatacatggaacatgatcttaaaggactaatggagggaatgaagcagccctttagccagagtgaagtaaaatgcttaatgctccagcttttagaaggtgtgaagtatcttcatgacaactgggtgctt

SEQ ID NO: 6250 - DNA, 696 bp, Glycine max
ccaaggtattttccgttttcgttttcaatttctttcttcgttcatcttttcttcttcttcttcattattccagccacgaaccatcttaattttctcacaatttccctgttcttgaagggcacagaagagggtttcttttcgtttcgtttcaatggggagcgaagaggagaacggcgaattctacctgcgatactacgtcgggcacaagggcaagttcggtcacgagttcttggagttcgagttccgccccgacgggaagctccgctacgccaacaactccaactacaaaaacgacaccatcatccgcaaggaggtttacctcacccccgccgttctccgcgagtgccgtcgcatcatctccgagagcgaggtaaccctaatttattaacaactccctcttgtttgtcatcattttgcgtattagctgtcgttttcttttggtttgttgttttttcattggcaaattttagctgttaggtttgttagaatgtcagtgggaagcaaatgttaattgttagtttggttcgttgtatttagttggcttgagtaattatttgtttgtttgacgttcagattatgaaggaagatgataacaactggccggaacctgatcgggtggggcggcaggagctggagattgttatggggaacgagcacatttcgtttacgacttcaaagattgggtctcttgttgat

SEQ ID NO: 6251 - DNA, 948 bp, Glycine max
  misc_feature (885)..(885): n is a, c, g, or t
  misc_feature (888)..(888): n is a, c, g, or t
  misc_feature (941)..(942): n is a, c, g, or t
cttccaatcaggaaacactttctcatcttccctttcccagtttcacaccctacctcatggaaggctctgtcaacgaacgtcttcattttgggaagattggatatgggtattctctttttctttggtctttccattcatttccatatcttcactcttttgttttgatgacagatgcaatcattacaggagaagatgcaggattcgtgctccctgctgcaacgagatctactcatgccgtcactgtcataacgaggccgcggtatttctttctttctcctttatttttacttcaaattatttgcctttttgcttttatctcatctgggttggtcttgttttcccaatcagagcttgttgaagaatccctttgatcgccacgagctcgttcgccaagatgttaaacaagtacgataatcactgtttttcattttttttctctaatatatctattcatgtaagtgatgaattggggttgatgagtgagactaatgcactttttacatctttttgccgtttcaggttatttgttcagtttgtgacactgagcaacctgtatgtttttttttttcgattttaaacttcaattattcatttacttattttttggtagaggggtggtttggataagctcctgatttcacattcccttttgttccttgtgaaggttgctcaagtttgcacaaactgtggcgtcaaaatgggagaatatttctgcaacatctgcaaattcttcgatgatgatgtaatgcttcactgaactgaataaatctgcagtgtccgattattttatacttcttgaatgtgattgatctatttctactttggcccttattttactttttagagatggactaactagactgaacatgttgtatggtcctcctngantttgattgtgaattattgttttagtgttttctgatgatgctgacatgcgtttnntgaata

SEQ ID NO: 6252 - DNA, 360 bp, Glycine max
agaggttgaatcatggagatgaaagtaaaggagaggattggtacagtattctgtaaactgtagttgattgaataatatgatagtacctatttataaaacaagagtgatagtcttctaattgctcacctaactaacatctaagttctaactaactcttctaaaagaatgacagctgcatgagttgagtatgttctctgatactatatataactataaattgcctaattacatgtataatttccacttatttatcaatgaaacggcatgcagaaaaaataaaagaccacagtaatgcagatgtaacggtagacgaatatcatcggtataaggtatagggtatatatatatatatatatatat

SEQ ID NO: 6253 - DNA, 346 bp, Glycine max
ccgttcaaaaatgggtccaaggacacgtcacacattgatgatgcccctgtggacttgaccaagcccagaaggagaaggttctccatttcctagatcagtgtttcttagtcaattcaaatctccatgctttgtgaaaagggttttgttagttattttttaagtagttacgttttcactcttgatcgttagttttatttatttatttatgaaggtgttaatttgtaattaaggaaaaagtgagacttgattggatttcttatgctagattttatcgtatctgtatgttataataaaaaaacatggaagatggatttgttcaggctggtttgtctaattctgcttacta

SEQ ID NO: 6254 - DNA, 393 bp, Glycine max
cagtgtccatactatctacagtgatactcagctctcagtgtatcaggtggataaggtgcttcttcctatgaagcttttcggcgcgacggcaccggctgctgcaccggcggaggctcctgcgccatccaagccggagaaaaatgtccgggcaggggctgctgatgcttcatctgggtcatcgggttcatcggttgatgcttcgaatgcagtgagtttgaatagaaagacagttaaaggttttatcatgaccgtggcaatcattgtttcttgtttgtggatgtaagtcttaaaatggcaacttttgccctgtattttgttctttttttttttttttttttttccccgaataaattttaaattgtttggggggggaaatcccgggaaaccccggga

SEQ ID NO: 6255 - DNA, 471 bp, Glycine max
caaggtgccccaaaatgtgagtgctcaaaactgtggttgtgctgaagggttatgttgcagccaacatgggtattgtggtaacggtgaggagtactgcggcacagggtgcaagcagggtccttgttattcgagcacaccaagtactaacaatgttaatgtggctgacattgtcacaccacaattcttcagtggcataattgatcaggctgactctggctgtgctggcaagaacttttactcacgagatgcttttcttaatgctctcaattcctataatgactttggtagacttggttcccaggatgactccaagcgcgagattgcagctgcttttgcccatttcacacatgaaactggacgtaagaattaccacctttcttaattcttatataaactttacttaactgctaattgaaatgattggtgacatggggtgcagatttttgccacattgaagagattaatggtgca

SEQ ID NO: 6256 - DNA, 591 bp, Glycine max
attcttctcctgcaggaaaaaaaatcagatctaccctctcacaatgttgcaggagatgtggaatgctcctcccggtctcagaccctccaagtctgcaccttgttctccggcaaagcctcttggggtcgttccaagaacgcgttctgagtccttccacgtggctcacaaggtcccagttggtgacactccttatgtcagagccaaaaacgttcaggtaaatttgccttttgatggattttttcattttgcaactaattttttttagagcaaaaaccttgtaaattgcaaaaaaagaaacaaggtttttgcctctattttttgcaatttagaaggttttttcccttttcaagtttttttcatgtttcaaatgttgagtgttgttctttcgttttgttttgtgtgtgtgtgtgttcagttggtggataaggatccggagagagcgattccgctgttctgggcagccattaatgcgggagatagagtggacagtgctttgaaagatatggctattgttatgaaacagcaaaatcgggccgaagaagccatcgaagccattaaatcgcttcgaagtagatgttcggatcaagcaca

SEQ ID NO: 6257 - DNA, 991 bp, Glycine max
  misc_feature (786)..(787): n is a, c, g, or t
  misc_feature (826)..(828): n is a, c, g, or t
  misc_feature (839)..(839): n is a, c, g, or t
  misc_feature (842)..(842): n is a, c, g, or t
  misc_feature (854)..(854): n is a, c, g, or t
  misc_feature (865)..(866): n is a, c, g, or t
  misc_feature (869)..(871): n is a, c, g, or t
  misc_feature (876)..(885): n is a, c, g, or t
  misc_feature (897)..(905): n is a, c, g, or t
  misc_feature (907)..(908): n is a, c, g, or t
  misc_feature (912)..(912): n is a, c, g, or t
  misc_feature (914)..(914): n is a, c, g, or t
  misc_feature (919)..(919): n is a, c, g, or t
  misc_feature (923)..(925): n is a, c, g, or t
  misc_feature (928)..(929): n is a, c, g, or t
  misc_feature (934)..(934): n is a, c, g, or t
  misc_feature (940)..(940): n is a, c, g, or t
  misc_feature (942)..(942): n is a, c, g, or t
  misc_feature (948)..(951): n is a, c, g, or t
  misc_feature (955)..(961): n is a, c, g, or t
  misc_feature (964)..(966): n is a, c, g, or t
  misc_feature (969)..(974): n is a, c, g, or t
  misc_feature (981)..(984): n is a, c, g, or t
gggtttgactgtgtggcttgtaattctcattgttgattgctttctcttatataggacaagaagattttacgacatgaattgatacaaagagtgagagaaatagctggagataagttgctagttgcggccatcaaatcttatagagacaacaaggtacgtcgattctctttttgatatcttttggggttgtaaacatagtgacatagcacatcaatttggttcatattcatccaatatagttttctttccttgaaattgatgtgcaatgcaatgcattgactctgtgcatttcaattctcgtcaaactgttatgagctaactaaacatttgttggttaagaaaccattattaattaagagcaactagaattttttccccttcgttcccatggtcattttttttataatgcatattcatttttactagttgtttctgaattaaatggggtaaaaagaatttcaatttcacctatcattgggaatattaaaaaataggaatagaagagcgaggggaaatatgaagttgtatcgagatctaagatggatgtatattgtatagtataccgttaattgttctttggggcttctggattatatattctggaaattccggaaggggaattagtttctgtgtgcacatagatctcataactataagtagtatattagtttaaggggttggaacattattgtcaaagaaaaagcaggtaggtaccaagaatatagtattattttacctactcctccaaccctatgggaggcgatagaagtggaaactgaatttaannattaaaaaactttagagtcacatcgtcattgctatctcnnntgttttattcntgngtttcctttccncctatgggaanntgnnnttgtnnnnnnnnnntcttgttgcctnnnnnnnnnanntgtngntcttncaannnaannaagcntttctnantcaagnnnnaaannnnnnnttnnnaannnnnnaaaaaannnnttctccc

SEQ ID NO: 6258 - DNA, 388 bp, Glycine max
agagagtcaatggtggccaagcaaattaggagagagctttctcatatgcttctcaccgataaagtcttgcagtatgctgttcttcccgaagcctccttaggagccgaccgttacctctcttctctcaccaccatcaccgacgtccaagtctccgccgacttgcaggcatgccatgcttgcttttcagcatcctatttctcactatttgtttctgattgaattccttattctacatatctatctatctatctatgtaggttgttaaggtgtatgtttctgtttttggagatgaaagaggtaaagaagtcgccattgccggcttgaaatctaaggctaaatatgttcgcagcgagttgggcaagcgtatcaagttgcgcttaactcctga

SEQ ID NO: 6259 - DNA, 364 bp, Glycine max
tttttatgagtctgatctttttgttctcagacttatgcatcttcttgtgctaaaacaaaaggtctttggtctaatttcttcgagctgagaagatcgatgcacttcacgagggattcaaaagcactgacacatacatgcttacaaacaaagttttttttttccttgcttcaagatctttttcaatatttcgctctccagctcgttttctgatgatcaacgaagttgtttctccttgaaaagtgttataagttataatctttcatttgagctagtgtatatatacatacccttttacaagatctcttgtttccttgactccaaaaaaaaaaaaataaaattgacacatctatgaaggatctgagcc

SEQ ID NO: 6260 - DNA, 403 bp, Glycine max
tgatctgataaggtggcaattttaccttcccaccgagtgtgaagccggtcatgctcatcaggttctaagaactgcaacaaagttacaaggctcagggataagctttgagaaaggtgatgtgaacaagcggttactggaaatagccttcaagaagaccccaattctgagttcatttctttgctttggttgctttccattgtcgaagctcttcaaagcgcgtttgaggattccccaattgaaggtagaccacacaactgaacgtgtgttcaagaacctcgttgcttttgagcagtttcactatccagacaagccttacttttgcaactatgtttctttcattgactctctgatacacactcagcttgatgtggagttgctggttgagaaggaagtgattgtgcat

SEQ ID NO: 6261 - DNA, 346 bp, Glycine max
atcagctcgttgctctgccatgcagcatcagagaaggaattggaagaagaggtggagaactctgtggctttgaaattgcggtagtatgctgtaaagggtgcttttgaccaatcagttttcaccaaaccacctctggtggcccagtcatcagcgttccacaagctagaatagattctcatgggttggttcttcgggaaaggaacgccaatagtctcagcattcttgaacacccttatgggaatgttatcgaccaagaatctgcacaacagataaatcgatttgttttgttaattatcgatatcaattaatgagggaaaaacgagagataaagaaagatttttttttt

SEQ ID NO: 6262 - DNA, 352 bp, Glycine max
agatgtaaatgaaactagcaatgctgctcaaggacctcctctccttactattctggctggattctttgtcctttttgttgtttgttggagcatttggtccattataacgtggctgataagtttaatagttaatgtacctgctccaaaataaattttattgtaatgtttgtttgtattttaagccactgcactagtccttgtgctcttggtcatagttttctttttatgcatttggacttgatagtatatttgagtggtaaaaattctgaagtgagccaaaagcaggataaaaaacctgagccctgaggaattggcaaagcctaatatatttgttctgggagagcttatggta

SEQ ID NO: 6263 - DNA, 335 bp, Glycine max
caggttatcaacttgtttgatgacttctctaaaaacgcagttgatccacctgccaattctatttaagcatactattcatttgattgatcaattgtcaagtatttgggttacacatatctttttcacttcaaaggattaaaatcaagggcatcagaatcaagctcaagttggactcccttagaaaccaagatcccaaaacaagtggaccttccccaagtatccattctttagcaatcagatttagagcattaatagtagccgccaatctacatgtaaaactaatcatccactgcccaaaacaatctctgtacaagcaacaatacaagatttgcagc

SEQ ID NO: 6264 - DNA, 385 bp, Glycine max
actgttccacaagcagactacatttggaggataattgttatggtgggagcactgccagctgcgttaacttactactggaggatgaagatgccggaaactgcccgttacaccgctctagtcgccaagaacacgaagcaggctgcagcagatatgtctaaggttctgcaggttgagattcaagctgaaccgcagaaagaggagcagaaggctaactcatatggcttattttcaaaggagttcctccgtcgccatggactgcatctacttggtacagcaagcacatggttcttgcttgatattgcattctatagccaaaatctattccagaaggatatcttcagtgcaattggttggatacctcctgcaaaaaccatgaatgccattg

SEQ ID NO: 6265 - DNA, 397 bp, Glycine max
gccctcattgaatagtgatctcctctatgacatattacgacgccttgatggccctacgttggctagtgcagcttgcacttgtgcatcattttcttccatctcaaaagaagagagtttatgggaaaatgtatgttcttctgtgtggccttcaaccaatagggaagatgtcaaaagtttaatatcttctaccggtggattcagaaaattctatgcagattgctttcctcttattataaacaaggaggtaggagagtatcaatggagcagctatcttgagtaccctgatgattggactgaggccaaatattatggggacatgattgaatttgaaagcatctctccatcagattttgtttccattgtggatatcaggtttaaggagaaaccaatctgctcc

SEQ ID NO: 6266 - DNA, 1500 bp, Glycine max
  misc_feature (394)..(397): n is a, c, g, or t
  misc_feature (404)..(404): n is a, c, g, or t
  misc_feature (609)..(618): n is a, c, g, or t
  misc_feature (622)..(627): n is a, c, g, or t
  misc_feature (630)..(637): n is a, c, g, or t
  misc_feature (642)..(646): n is a, c, g, or t
  misc_feature (650)..(650): n is a, c, g, or t
  misc_feature (652)..(653): n is a, c, g, or t
  misc_feature (659)..(664): n is a, c, g, or t
  misc_feature (666)..(668): n is a, c, g, or t
  misc_feature (672)..(672): n is a, c, g, or t
  misc_feature (674)..(680): n is a, c, g, or t
  misc_feature (683)..(698): n is a, c, g, or t
  misc_feature (700)..(710): n is a, c, g, or t
  misc_feature (716)..(719): n is a, c, g, or t
  misc_feature (721)..(724): n is a, c, g, or t
  misc_feature (730)..(730): n is a, c, g, or t
  misc_feature (737)..(740): n is a, c, g, or t
  misc_feature (742)..(746): n is a, c, g, or t
  misc_feature (749)..(749): n is a, c, g, or t
  misc_feature (754)..(763): n is a, c, g, or t
  misc_feature (769)..(769): n is a, c, g, or t
  misc_feature (771)..(777): n is a, c, g, or t
  misc_feature (779)..(780): n is a, c, g, or t
  misc_feature (784)..(784): n is a, c, g, or t
  misc_feature (786)..(788): n is a, c, g, or t
  misc_feature (791)..(792): n is a, c, g, or t
  misc_feature (794)..(794): n is a, c, g, or t
  misc_feature (796)..(800): n is a, c, g, or t
  misc_feature (803)..(813): n is a, c, g, or t
  misc_feature (820)..(828): n is a, c, g, or t
  misc_feature (830)..(836): n is a, c, g, or t
  misc_feature (839)..(844): n is a, c, g, or t
  misc_feature (854)..(863): n is a, c, g, or t
  misc_feature (865)..(878): n is a, c, g, or t
  misc_feature (881)..(882): n is a, c, g, or t
  misc_feature (887)..(897): n is a, c, g, or t
  misc_feature (900)..(902): n is a, c, g, or t
  misc_feature (904)..(906): n is a, c, g, or t
  misc_feature (908)..(913): n is a, c, g, or t
  misc_feature (916)..(918): n is a, c, g, or t
  misc_feature (930)..(939): n is a, c, g, or t
  misc_feature (941)..(942): n is a, c, g, or t
  misc_feature (944)..(948): n is a, c, g, or t
  misc_feature (950)..(958): n is a, c, g, or t
  misc_feature (961)..(961): n is a, c, g, or t
  misc_feature (963)..(966): n is a, c, g, or t
  misc_feature (968)..(968): n is a, c, g, or t
  misc_feature (970)..(976): n is a, c, g, or t
  misc_feature (979)..(981): n is a, c, g, or t
  misc_feature (983)..(983): n is a, c, g, or t
  misc_feature (986)..(992): n is a, c, g, or t
  misc_feature (996)..(1000): n is a, c, g, or t
  misc_feature (1002)..(1009): n is a, c, g, or t
  misc_feature (1011)..(1021): n is a, c, g, or t
  misc_feature (1026)..(1027): n is a, c, g, or t
  misc_feature (1029)..(1046): n is a, c, g, or t
  misc_feature (1048)..(1050): n is a, c, g, or t
  misc_feature (1053)..(1063): n is a, c, g, or t
  misc_feature (1065)..(1068): n is a, c, g, or t
  misc_feature (1075)..(1082): n is a, c, g, or t
  misc_feature (1085)..(1085): n is a, c, g, or t
  misc_feature (1088)..(1090): n is a, c, g, or t
  misc_feature (1092)..(1092): n is a, c, g, or t
  misc_feature (1094)..(1097): n is a, c, g, or t
  misc_feature (1102)..(1114): n is a, c, g, or t
  misc_feature (1116)..(1140): n is a, c, g, or t
  misc_feature (1143)..(1145): n is a, c, g, or t
  misc_feature (1147)..(1147): n is a, c, g, or t
  misc_feature (1150)..(1157): n is a, c, g, or t
  misc_feature (1160)..(1161): n is a, c, g, or t
  misc_feature (1163)..(1168): n is a, c, g, or t
  misc_feature (1170)..(1170): n is a, c, g, or t
  misc_feature (1173)..(1194): n is a, c, g, or t
  misc_feature (1196)..(1196): n is a, c, g, or t
  misc_feature (1198)..(1202): n is a, c, g, or t
  misc_feature (1209)..(1212): n is a, c, g, or t
  misc_feature (1217)..(1218): n is a, c, g, or t
  misc_feature (1223)..(1247): n is a, c, g, or t
  misc_feature (1249)..(1253): n is a, c, g, or t
  misc_feature (1255)..(1265): n is a, c, g, or t
  misc_feature (1269)..(1277): n is a, c, g, or t
  misc_feature (1281)..(1283): n is a, c, g, or t
  misc_feature (1289)..(1293): n is a, c, g, or t
  misc_feature (1302)..(1302): n is a, c, g, or t
  misc_feature (1304)..(1305): n is a, c, g, or t
  misc_feature (1307)..(1307): n is a, c, g, or t
  misc_feature (1311)..(1316): n is a, c, g, or t
  misc_feature (1320)..(1320): n is a, c, g, or t
  misc_feature (1322)..(1334): n is a, c, g, or t
  misc_feature (1338)..(1343): n is a, c, g, or t
  misc_feature (1345)..(1360): n is a, c, g, or t
  misc_feature (1364)..(1371): n is a, c, g, or t
  misc_feature (1373)..(1384): n is a, c, g, or t
  misc_feature (1387)..(1392): n is a, c, g, or t
  misc_feature (1397)..(1406): n is a, c, g, or t
  misc_feature (1408)..(1410): n is a, c, g, or t
  misc_feature (1413)..(1421): n is a, c, g, or t
  misc_feature (1423)..(1431): n is a, c, g, or t
  misc_feature (1435)..(1450): n is a, c, g, or t
  misc_feature (1455)..(1458): n is a, c, g, or t
  misc_feature (1460)..(1469): n is a, c, g, or t
  misc_feature (1471)..(1475): n is a, c, g, or t
  misc_feature (1478)..(1480): n is a, c, g, or t
  misc_feature (1484)..(1484): n is a, c, g, or t
  misc_feature (1489)..(1492): n is a, c, g, or t
  misc_feature (1496)..(1497): n is a, c, g, or t
gatctgagcatttgcagcacaagcagggcgaatcaataggaggtacggtgcctgatgaaaaggtttccatgccttcaagtgaaacagcaagccgtgaagatgctggcattgttggttgattagaggttctatgtcgctgctacttgaatcagttttcctgtttataaccatacacacaatccctgaccttaaaatactgattgtgcagaatttgtggatcatattcgcatcctaattttgttttgccactgatagatgcagaagtattataggagggaaagtatagttctaaggcaaagacgtgctagttcatctagttaaatctcattgtcacctgtctgttggcatttgcccttttccgttcccccttgaagcttcttgttcccgtaatttnnnntgaggangcagtattgagaatttacctgtaagcatcaaagatcttcctagtcttaaaaagcttaccttgactgagtgcaagaaacttcggtctttaccaagccttcctccatccttggaagacttgtccttaaatgaaagtgatattgagtgtttatctttaagtatcaaggatctttctcacttgaaaatacttaccctaaccaactacannnnnnnnnntttnnnnnncannnnnnnntcttnnnnnctcntnntccccnnnnnntnnntttntnnnnnnnttnnnnnnnnnnnnnnnntnnnnnnnnnnntccttnnnntnnnntccctntctctcnnnntnnnnntcnccacnnnnnnnnnncttttntnnnnnnncnncctnannnctnntncnnnnnctnnnnnnnnnnnactaatnnnnnnnnntnnnnnnnctnnnnnnttctccactnnnnnnnnnntnnnnnnnnnnnnnnctnnctgtnnnnnnnnnnnccnnntnnntnnnnnnacnnnctcccaccaccnnnnnnnnnntnngnnnnnannnnnnnnnctntnnnnancnnnnnnnctnnnantcnnnnnnnactnnnnncnnnnnnnncnnnnnnnnnnnccctnncnnnnnnnnnnnnnnnnnntnnntannnnnnnnnnncnnnntcccttnnnnnnnnttnccnnntnannnnactannnnnnnnnnnnntnnnnnnnnnnnnnnnnnnnnnnnnnacnnncnctnnnnnnnnatnncnnnnnncnacnnnnnnnnnnnnnnnnnnnnnncnannnnntcaccannnnaatcnntctcnnnnnnnnnnnnnnnnnnnnnnnnncnnnnncnnnnnnnnnnnaaannnnnnnnncttnnntacatnnnnncacccgatncnncncccnnnnnntctntnnnnnnnnnnnnnctcnnnnnntnnnnnnnnnnnnnnnnacannnnnnnncnnnnnnnnnnnnccnnnnnntcccnnnnnnnnnntnnnccnnnnnnnnncnnnnnnnnnactnnnnnnnnnnnnnnnnaatcnnnncnnnnnnnnnntnnnnnccnnncaanaccannnntctnnctt

SEQ ID NO: 6267 - DNA, 642 bp, Glycine max
  misc_feature (595)..(620): n is a, c, g, or t
  misc_feature (622)..(624): n is a, c, g, or t
  misc_feature (626)..(638): n is a, c, g, or t
cgtagtttctcaacccttgttcttctccttcttacatttttttttgaacggtttttttattttggtttttgtgcaaaaacaacaggtctaaaagattaaacagattagcacttcattcgcttgtattatccaaagcctcgccgagaactttcactattaaagcaaaatattggtgcgattcggcacacaaattcctcaaacactgtgccgatgccggaaacattgaagcttgctatactttaggcatggttagtactaataataatactaattaatttgtaaaagactgtgaagtgttgagattttgttgtttgttattgttattgacaaatctaaaatttgttgatttgtgcagattcggttctactgtttgcaaaaccgagggagcggcgcgtcgttgatggcgaaggcggcgattaactctcacgcgcgggctctctacgcgctggccgtgattcagttcaacggaagcgggggcacgaagagcgacaaggacctacgcgccggcgtggcgctatgcgcaagagcggcgtttctcggacacgtcgacgcgctgcgcgagctcggccactgcctacaggacggttacggggtnnnnnnnnnnnnnnnnnnnnnnnnnncnnncnnnnnnnnnnnnnttct

SEQ ID NO: 6268 - DNA, 615 bp, Glycine max
catgatgaaacaaaccgatccttatatctgcagaggaaaggacattcatttcagcaaaacacatgaactttcaacagtgttatggcatttcatcaaatatgtggcagataactcacaatttaagaccgtcacgaacgaaagggataatgcgaacgcagccgaactgaatcgccaattccctcacatctaatttcatcctgaaatcaccaaacaaacacttcgttgacaaaaagaaagaaagaaagaaagaaaggttgaacaaatagaaagagaaagaaaacgaacttgacaccaaggccgttgtggagagaattgtaggatctgatgtaagctctttcggacattccgctgagcctcacagcagaagatcggtcaaagagaacgccgagtctagtggcggcgatttccaagcatatgagagattttgcaacctcaccctgagaacgcaaaacaaagagcttcagaatcgaatcgaatcgaataaaagggaatgaaaaggaaaggaaaggggctgacgactccaatgacggaggaatcgaactggacatcgcagaggcgacggagctcggcagctttccggacgaggagtttggaatcggagagaccgagcttctt

SEQ ID NO: 6269 - DNA, 713 bp, Glycine max
  misc_feature (694)..(696): n is a, c, g, or t
  misc_feature (700)..(702): n is a, c, g, or t
acaccacccatcggcggatggcggttgtgtacgatagtgatgaggactaaacttccttaagctagattttcatggtgagtagtcttggtcttaagaattcaattaatttagaatacagtgtatggatttttctacagtcatcccatgatagatatcatatatgatatgataagattgttgacttttgtaattattattttaatagtcatatctaaagtgattttttagttggtagaaagtttagaatcttttatactctggaggtatatgaaaattaaactctaatcttaaatatgaaacataccggtgattttttttgctttcttgaaccatatgttttgtccttttacccctccccccccccaccccattatttttgcattttattattggttggtaaattatattttattttagatttgcaagctttcaaaaagaataagaatttcacaatgatttttgctgtgatgttccagggaagtgcagctatctgatgcagcaaaggcagagatggctcttagttccccccatatatagctacatttttaatatttcatccttatatacataaagcagagcctgggacactaaagtagtgtttattctcaggtcacaatatatgtttttttgactgtcttattaatggtgataaaagaaattcagtgtaaataagtttgtttttctgtattttccnnntcannnaattttcgtcc

SEQ ID NO: 6270 - DNA, 350 bp, Glycine max
tatcagctatggatgatccaaaatgctgggatcaatgacgttctaatgatcaaaggtgcagatcatgcagctatgtttagcaagcctagagaactattcaattctctccagaagatagctacaaaatatgactaggctataggttactttcatctgtacgttgtgtttgaatttgacttgtgttacaattataagatctcgtttagaaacatgactcccatgagacaaataaataaagccatagtcttgcaactactgcgtcatttccgatccatacacgcagggatctgtataaattttatttgataaaaatataatgatatgaagttgtgttagttcttgtcaattca

SEQ ID NO: 6271 - DNA, 369 bp, Glycine max
atgaaacagtggattttaccaataagaacatagatgatgattcccaatacgatcctatagagatgcatcattctagtggttcccctctaattcaaccccaggatcagcctatttggcaggattcatgtgatggaaaagttaaagaagattcatgcacatcatcagatgtaggagttgcctcacaggagactaaggtgaatactgagaatggtgatcattggtgtggtaactataatggggtaaacaatggttatagccaaggatatgttttggagcattgtgatgcaaaagtgtgggattctggatttgtatcatgctctaaaaataagattgacttcgtacctacatgcaacatgatagaagaggttt

SEQ ID NO: 6272 - DNA, 324 bp, Glycine max
caagatacatagttgcaacaggacaaaaactgatggaaattcagtccaagatactttctggctttgttggagtggcagaagagatggggaaaagttcaggcattgacatgaaccggtttgccgacagcattagaaatctgttccatgaagttcaaagaggtctagaagttaggacggctagaattataggagaccttgagggaactctagctcgtgaaggaatgacatgtttgagaaggtagcaacggattcttgtggtctagaatggcctttatgtgtttatttgtctatactatacttatattactgtagttattaataaca

SEQ ID NO: 6273 - DNA, 680 bp, Glycine max
atctgaacgggacttttatgaagcccttttcgagagatctgaagcaagttttgtgccacagcttctgatttgtgcttggatctgaataacaacctgtttcacttttatcaattttgataaagtctaaaaatctgttaatagaaaccgttctcaaacctagtttgttctagtaactgttaatagttttatgtttggcacgttaactgccatgcaactcttgaacttactatccaatgcaaacaggttcaatttgatcagtatgttgcacaaggaaaggttcttcaccattatgcaaatatccttgacctactaatgcagttgaggcggtgttgtaaccatccatttttagttatgtggtaggtgtggcaaacacattaaaatgctcttactgtttccctttaccaattcttctgcctctaacaagattttcccttgtatatgaagcggaagtgatacccagaaacgtgcagatttaagcagacacgcaagaagattccttcagactaatactgaatgccccgaagaaagcaatcaaaatgatcctcggcagcaagcagagttgaacaaacttgcaagtagattacttctaaaatctgcttcttcttcgcactcgttcaacctcatgcatacattgccgaggttttggaggatattcaaaagggtgacatcataaaatgctc

SEQ ID NO: 6274 - DNA, 369 bp, Glycine max
  misc_feature (361)..(362): n is a, c, g, or t
cgctggttcgtggggctcatactttcagtgtccaaccttggtatcactagctggactaggcttcctatccatgatgctgactttggttggggaaggccaatattcatgggacctggtggaattgcatacgaggggctatctttcataattccaagctcaaccaatgatgggagcctatctgtggccatagctcttcagcctgaccatatgaagctgtttaaggatttcttgtatgacatttgaagaatcattgccttcaagccatatggaacgccacaatgtttctaggtggggttttctttcccctcgtacctttgttatctgtcgatgcttttgacaaacggtatgcaactgttaacgnnactcctt

SEQ ID NO: 6275 - DNA, 391 bp, Glycine max
gggcttagtgaaggattgaagtgatgaatacttttattatagacttacgaaattgggcctcaattttgcacaaacatggcaggatgagcttatttgtttcttcatttactatgtctgttaatttgcaatcttggttattaagaaagaaatggtggtggagttttaattgttctttgttttattcttgtgttattcttgtttgaatggtgaaaattctgttgtgtccgtatcctattatccagttttatcgatagagaaaaacctgtgcctggttatgaggttgttgattcatcagctgaaactgaataaagtgaaaaaccttaggcgaggcattagagtctctgtataaatttgttgccttacctttggtatgcgagattaaaatccacaa

SEQ ID NO: 6276 - DNA, 388 bp, Glycine max
tttgtccaaagactacatggaatcaaacaagccagcagctgagcttgtgaaactcaaccctacaagtgattatgctcctggtctggaggatacccttattttgacaatgaagggtattgctgctggcatgcaaaacactggttaagaagctgcatgcctgtgttgccttcctatacaagtaacttaactttggatacacacattttaacctatgttgtctgctacagatgtggaccagcattaaataacaattacgctatctattatcgttatcatgtaataaaaacggattttggcttatgccagcttggattttaactggattctcttctgtttgatgttatgtgtttcttatattatttctcatagggattagtgtgtcttccaa

SEQ ID NO: 6277 - DNA, 324 bp, Glycine max
tgagagtgggagtggcaactccaaaaccttgcctccatccctcaatcttcttattctccctttctctctctcacaacactcacactctcacctctttccccagaaccttccgtttccacccactttcactccctctttcaccctttgtgctcttcatgcctcccaaagcaacaggtcttcattctgtgcaaacccccttaatgcttctttttctgaattttgtttctgattgcattatattatgtctcatcactttattgtaagatggcaaaaaaagaaaatcataaaaagatgcagtttttcataaaaaaaaatgtttttttt

SEQ ID NO: 6278 - DNA, 791 bp, Glycine max
  misc_feature (84)..(85): n is a, c, g, or t
  misc_feature (754)..(754): n is a, c, g, or t
  misc_feature (780)..(783): n is a, c, g, or t
ggaagaagctcattacctgtacatgcagctcctaaagcggaagggcaatactctgagcaacaatcttctcaggtatgtgacttnngtgattcatagataagaagttaaggtgaacaattttcttatgaatttattcaatgattcattgttagcatttgaatttggatgcaaaaattattgtaaggtcatatctttcgagattctgtattttgaatagccttacatttggttgctaaaaaagctagtataaccttgaagaaaaagatgtcaagaaacttcagaattgcataatattgcctgtttcttaaataaactctgaatttaacattagattatgtgtatggttagatatacttaattgaataccctttgtggatgaattaaggtgatagactagttttaaacttttaatatacttttgaaatgaagatttacgtcagtgaaacgtgatggccctgcctactattgctgatatttaaggatttggatatttgactttgacatatgtagccagcttctgtccaggtgctggtagtctgcatcttcacaaacatgtctatttcaccgagtctctctccaagacagtacccagatcgttacacctttcatgtgggtcggaacttacccgacaaggaatttcgcgtcatgctataaatgtttcatatctttagtttgaaatatcatcactaagtggataaatttatgccttatacgcactgccaatgaaccaagtctcttcattcagtatttcagnaatatttatgtcagtagttgatttcnnnnccatcttt

SEQ ID NO: 6279 - DNA, 375 bp, Glycine max
ggaatgatgtagttgctctagaatgtggtagggaggaaatgtcagatgctcatagcatttcaaatgaagaaagttcttgctgtttagaaaattcttgtcccataatggtcaaggatcaatcatctaatagtgagatagtggaggtaaatgctgaagttaaggtaaatattgaacagaaaaattgtggaagtcccagtattgtacatactgttcctgcatctgttccaattggacaattgagtggtcaaggcagaagaagtgtgcgactttatgagctacttcagatggaatcttggaatgaacaggtgtcagaacaaggcaaggattctgtggttcctgcggaaatagcacaagagaggcagatgagattctgct

SEQ ID NO: 6280 - DNA, 1101 bp, Glycine max
  misc_feature (434)..(434): n is a, c, g, or t
  misc_feature (439)..(442): n is a, c, g, or t
  misc_feature (449)..(455): n is a, c, g, or t
  misc_feature (461)..(464): n is a, c, g, or t
  misc_feature (467)..(470): n is a, c, g, or t
  misc_feature (475)..(478): n is a, c, g, or t
  misc_feature (490)..(491): n is a, c, g, or t
  misc_feature (497)..(499): n is a, c, g, or t
  misc_feature (506)..(520): n is a, c, g, or t
  misc_feature (526)..(526): n is a, c, g, or t
  misc_feature (529)..(535): n is a, c, g, or t
  misc_feature (539)..(541): n is a, c, g, or t
  misc_feature (544)..(558): n is a, c, g, or t
  misc_feature (560)..(572): n is a, c, g, or t
  misc_feature (577)..(583): n is a, c, g, or t
  misc_feature (585)..(596): n is a, c, g, or t
  misc_feature (600)..(600): n is a, c, g, or t
  misc_feature (605)..(605): n is a, c, g, or t
  misc_feature (609)..(611): n is a, c, g, or t
  misc_feature (614)..(632): n is a, c, g, or t
  misc_feature (653)..(654): n is a, c, g, or t
  misc_feature (659)..(668): n is a, c, g, or t
  misc_feature (673)..(675): n is a, c, g, or t
  misc_feature (679)..(679): n is a, c, g, or t
  misc_feature (681)..(681): n is a, c, g, or t
  misc_feature (683)..(692): n is a, c, g, or t
  misc_feature (694)..(697): n is a, c, g, or t
  misc_feature (702)..(704): n is a, c, g, or t
  misc_feature (708)..(712): n is a, c, g, or t
  misc_feature (714)..(714): n is a, c, g, or t
  misc_feature (716)..(718): n is a, c, g, or t
  misc_feature (733)..(742): n is a, c, g, or t
  misc_feature (744)..(749): n is a, c, g, or t
  misc_feature (751)..(752): n is a, c, g, or t
  misc_feature (755)..(761): n is a, c, g, or t
  misc_feature (764)..(768): n is a, c, g, or t
  misc_feature (771)..(784): n is a, c, g, or t
  misc_feature (788)..(792): n is a, c, g, or t
  misc_feature (794)..(797): n is a, c, g, or t
  misc_feature (807)..(811): n is a, c, g, or t
  misc_feature (820)..(820): n is a, c, g, or t
  misc_feature (822)..(826): n is a, c, g, or t
  misc_feature (832)..(834): n is a, c, g, or t
  misc_feature (837)..(844): n is a, c, g, or t
  misc_feature (848)..(856): n is a, c, g, or t
  misc_feature (859)..(860): n is a, c, g, or t
  misc_feature (866)..(866): n is a, c, g, or t
  misc_feature (870)..(873): n is a, c, g, or t
  misc_feature (875)..(879): n is a, c, g, or t
  misc_feature (885)..(885): n is a, c, g, or t
  misc_feature (890)..(893): n is a, c, g, or t
  misc_feature (895)..(901): n is a, c, g, or t
  misc_feature (903)..(922): n is a, c, g, or t
  misc_feature (924)..(929): n is a, c, g, or t
  misc_feature (931)..(947): n is a, c, g, or t
  misc_feature (950)..(958): n is a, c, g, or t
  misc_feature (964)..(969): n is a, c, g, or t
  misc_feature (972)..(979): n is a, c, g, or t
  misc_feature (981)..(981): n is a, c, g, or t
  misc_feature (985)..(985): n is a, c, g, or t
  misc_feature (987)..(987): n is a, c, g, or t
  misc_feature (989)..(990): n is a, c, g, or t
  misc_feature (993)..(1000): n is a, c, g, or t
  misc_feature (1002)..(1002): n is a, c, g, or t
  misc_feature (1004)..(1012): n is a, c, g, or t
  misc_feature (1014)..(1014): n is a, c, g, or t
  misc_feature (1017)..(1022): n is a, c, g, or t
  misc_feature (1033)..(1033): n is a, c, g, or t
  misc_feature (1035)..(1035): n is a, c, g, or t
  misc_feature (1038)..(1044): n is a, c, g, or t
  misc_feature (1046)..(1063): n is a, c, g, or t
  misc_feature (1065)..(1080): n is a, c, g, or t
  misc_feature (1082)..(1092): n is a, c, g, or t
  misc_feature (1094)..(1095): n is a, c, g, or t
gtatgcatctaaacacctgtaagtctcgttgcatcttagcttgtactacctttcgtcctatttataagaaacaagtgattgtgtattttacattataacttgtttcttataaataagaccagaccggaggtagtactatttctttttctggaatttcgcaatctaaataattgcatggagagttaagtgtcctcgtgtcacagcaaagtgaacgaaagtataattttcaactacatagtttttatttttaagacgacttagtgtctgtttattttaaatattggtagaattgattttgaattgttaaacatgaaatattgactactgttatggaatcttaatcaccccttgcactctttttgccaggcttttcgaccacaatcaactagagggtggtattcctgcctcccttactactgtgagccccattgcanttagnnnnaagcatnnnnnnngaccgnnnnaannnnactannnncacaaaattttnntatttnnnttttttnnnnnnnnnnnnnnnttaacntgnnnnnnntctnnngannnnnnnnnnnnnnnannnnnnnnnnnnnaattnnnnnnntnnnnnnnnnnnnaaanaattntctnnnatnnnnnnnnnnnnnnnnnnnaatccctttatcttaattttnnttctnnnnnnnnnntttcnnncccntntnnnnnnnnnnannnnccccnnntttnnnnntncnnnctttttatccttttnnnnnnnnnntnnnnnntnnctnnnnnnnccnnnnnaannnnnnnnnnnnnntttnnnnntnnnntcttcctccnnnnncctacatcncnnnnntccccnnnatnnnnnnnntatnnnnnnnnnttnncccctncctnnnntnnnnnccttcntctcnnnntnnnnnnntnnnnnnnnnnnnnnnnnnnncnnnnnnannnnnnnnnnnnnnnnncannnnnnnnnacattnnnnnnccnnnnnnnntntctntncnnccnnnnnnnncnannnnnnnnncnccnnnnnncccccttcctntnaannnnnnnannnnnnnnnnnnnnnnnntnnnnnnnnnnnnnnnncnnnnnnnnnnnanntttttt

SEQ ID NO: 6281 - DNA, 354 bp, Glycine max
atataacacattattttgaacattctttaactgttgaaatcaaactcagttttttctcatttgattcagtgagaccgtgagtaataaggtacataaggagaaatgggggggtagtggaaacatcaacagaacaaatgtcttactattaaatcttacaatgagaagagtttaatagtaactcatcttgcttccaccattgtatctgtgatcaaattcaaagaaaagctttctggcatgctagcgggcaatattgaattttgattacctctcacatttagaaatgcaggtggtttaggagaaggaagggccacagtatcgttcccaatcattgatacaacatcagacatggttggt

SEQ ID NO: 6282 - DNA, 380 bp, Glycine max
tctttttctcccaggaaaatcctaactggccttaaaacttgtacagtgtactgggctatgtttattggagctgggtctttttttttatttcatttccctcgtatcatatcatacgaatgaagctctgctgcttggagaagttgctttagcctcctaaatgcagagagatagtgcagagtgtacagtgatttgagcgggacagaccacatataaaatgggcgttgaaatggttgcttggtaaactgattgattgtcttgggagtgtgttcaaacttcagtgttgggaaggaaatgatggacaggcctaagtgttagccaactctggtgtaatttttattgatctcattcacatatgttcaatggtgtctgtcttttcagag

SEQ ID NO: 6283 - DNA, 480 bp, Glycine max
attgcatactctcttgcccacaaggtaagcatagactgagaaaatgtgcaatcttttattattcctgcttatattaagaaacatgtgtaatccttggcttttgcagcaatggagatcaacccccatctctaattcaagagcaaacgccgctctcaacaatcacgagatggacaaggcgaactggggatggagttggttggaacgttggatggcagctaaaccatgggagagtagattaatggaacaaacccatcatgctgatgccacagagaagacccctcctcctcctccaccaaagaaatgtgttgactcctccaattcaaaaacatcagaactatgcaatattaaaatcagaaagaacaatgtcagcacaaggatttctgctagacctccccatattggacaagctactcgcttgtcgtcgagtccaagttctgagtttcactatgatgagagctgctctaattcatcctcaatctg

SEQ ID NO: 6284 - DNA, 747 bp, Glycine max
tattcgttttactgggatataaccagagattgggatttaaggtaccaaatctatcatctttccctttcatattgataatatcagacctcacaatttccatagatacaagtattacatctacaaaaatttaaattttaaattttacgaagaaaaaaaatatattaaagaaagtttgatcaagctttgattcctccctgagagaggtgcctatgtttagtgctcaactgtacctcaaacacgtttgcctgtgaaggatgatatatacaggaaataaaaaaaaattgccctgggtgtctagatgttagttttatgctgcacctactttttatgagttatgacaagtaatcaccctgattttactttatatctatttttattttaatctgttttcctttctcttacagtggcttttcccgcatattcaagttcaacaaatcaaatccaatctccaacctgttatacggtcgacaatgggtaagaagctgaagcatcttagtatgaagatgtaacacatgttcatttgatttgaaaaatctaattcctgagctgcaggtatacttttgggtgattggaagcaactttgttctgcgctgctcttggacatacaaattatctgcccatctccgccataactacctgacagtgtttactatcactcttttggagatgtttcgacgcttccagtgggtattttttagagttgaaaatgagtggaataagatcacgcggtctggtgtcaactcacag

SEQ ID NO: 6285 - DNA, 373 bp, Glycine max
actattgttcttcagatgtaaaatcaggctcagcaggcttctgcagcaacatgggtgatattctctctggcaccctggccttccttgtgccatttctacgtaaaagtctaagtgcattagctgcaaaccttgaagcatatattgtggcacctagacttggtgaactaccacctgctttggacaatgcatcttgcagcctgttctcctcttccctaagagactcttccagcttctttttaccatagcgcctccacgctgcttgtatgaaacatgcagcccatgtacgccattgttgcgaataaaacctgaaagtgtggcgaagctgcttgctatgaaggcgccggaattgagatgcgacgaacttcaagtcata

SEQ ID NO: 6286 - DNA, 592 bp, Glycine max
  misc_feature (497)..(499): n is a, c, g, or t
  misc_feature (572)..(574): n is a, c, g, or t
tcgttgttggtatctttccactaacaacaaaatatttttacatcattatatgataacaatgcccaattaaatcaggcaaacaaaaagcaaagtcagaaaataaacatacatttgcaagttcactctgacgtctaatggatgatgttctccagccaacaatatctattttttttataaaggaaaaccataaaaaataatatgcaatgaagaaagctgaatgcacctagaattagtttaaagaagaagcaaataagacggatacgatcatagtccacatttgaatatgcaaatcggcgtttgaaagcacgcaatgcagacctgcacaaagaaatcagaagacgtgaagattctttaaaggaatcaaactcaacaaattccatatataaaaggaaaataatgtaagaagcaacaaacatacatgaaatacaaatcaccgtagtcttgaaccatgcgtttaagcaatggaggttttccttcatcatcatcagtaaggaaannntgccgacctgttcttctaaaaatgaaatgaataacacaactagcaaccttctcaaaagcaggtacccccaaannnaatggaccctgcttattt

SEQ ID NO: 6287 - DNA, 735 bp, Glycine max
agaagtggccgccgcgatgatgtgcttagtggtttaaataggtaactggtccttgcttcatttcataataggatattgtattctaatatggaatgacatgacgatatctcacccttctcatctatatgtctgtatgcttttttctttctccttccccctttctaatgtcctgccttctgtggttaggattgccgtgccgctcgttacgaggagtacacttgaagttgttataccagagtatgcagtaccaaagcttatagctaaatccaaaagcaaacttgctcaaataagtgaggtgtgtgtgattagatctattagtccctcactttaatatttgaattgtaaagtgctagaaaaggcattcttataccaagtagttgaacttggagcctacaagttcatgtttacttttatctgctctctgacatcattgaagagctcacccctcaacccaccccaaaaaaaaactgagcaatttaattactcttagaactagaatcacagaatttgtttttacaaatgatatatgggttggtctttacgttgcttgacttctggattatctctagatcatactaaatgtttttttattttttgttctagcttcaagaatgaaaagcaaatctctcaacaacttcccaatatttcttggaattagatctagattctagaaattattttcattgtattactacatttactttcaactgatagccatttcttttcactcatctt

SEQ ID NO: 6288 - DNA, 739 bp, Glycine max
ctcataggactcttctagttagattttgtgggatttggattcttaattgctcaaggttgttttcttgtctttaccttgattaattattatgctggtgggagttttcttgcttataacttctgaaatatgatttcttgatctaatgcaagtgctcaaagtagaactagaacctagcaacactgggaaaaaatagctatggatttgcgggttattattgtacgctcttttttggaaattattgattatttattgccatatatcttattttgggataactgaaggaccctaattagtaaaaccaactctattcagtgactgataaaacaacaacaaccaagccttttcccactaggtggagttgactacatgaatcagaaaatgccataatgttccattgtatctctaaatcttttttaattcttttgcttatggtttttcttagtctccctctgcctctagtgactaggctatcctccatctgatctactctccttactaaggcttataagatcatcctcacacatgctcaaccctctaaggcaagaatctaccatcttttttacaacaggtgctaccctaactttttacccaatgcattcatttgtaatcctatcttttccagtatgtccactcatgtaatgccagcactctcatctctactacattgaatttgttctcttggttttttgctgaccaacatctagttccataggacatcactggtgttatagttatgttg

SEQ ID NO: 6289 - DNA, 599 bp, Glycine max
gttttctcaccgctgctgatggacagaccagtgtagagatcaatgtccttcagggggagagagaatttgttagggacaacaaatcacttggtagcttccgcttggatggtatccctcctgcgcctcgtggtgttccccagattgaggtgaaatttgacattgatgccaatggcattctatccgtcactgctatcgacaaaggcacagggaagaaacaagatattaccatcactggtgctagcaccttgccttcagatgaggtatccactatctctgactatattacttgtataatagcctgtgtatgttgtgtttctttttattattattattattgttattattattattattgtctgttgcttgcttcttttatgatgaaagaaataaatggcaatgcggatgggacatttgatgtaggaaattttttatgatgcttataactatctctggaatgaaatacaggtggagagaatggtaaacgaagctgagaaattttcgaaggaagacaaagagaagagggatgctattgacacaaagaaccaggcagactctgtggtataccagacagaaaagcaattgaaagagcttggagacaa

SEQ ID NO: 6290 - DNA, 813 bp, Glycine max
atgagtgcatggttcttgacatgaagcactctatgacatttgcttcaggaccttaaaactcaccactcctagttgtaagtaccacttccacttggatctggatctagattctattctatctactcattcttcatgcattcacacgttcaccaattcgaaaatgtggatatagatttttcacacattcagtaactgtcggataaagattggactgattcccactcagatccggattccctgcattcatttttccacacaattcaaacatttagcaacttgaagctgttgcataaaagattggactagtcatgtttaatgttgctaaatcagatttaaaacatgtattcaaaatttgaaccgtccaattttcatccagcagttacaaatgtggtgttgactcaaaagaaatcactttaacatgatttgaaccaccacgtagttatggtctctgccaatatgcttgagacaagtaattgaatttttttttatacttgcagttggtgatctgaaccacctgatttctgcgacaatgagtggagtgacatgttgcttgaggttccccggacaactgaactccgacctgaggaagctagcagtgaacctgatcccattcccacgtctccacttcttcatggtggggtttgcacctctcacctcacgcgggtctcagcagtacgtgtccctcactgtccccgaactcacccagcaaatgtgggacgccaagaacatgatgtgtgccgccgatcctcgccacggccgatacctgacagcatcagccatgtttaggggaaagatgagcaccaaggaagtgga

SEQ ID NO: 6291 - DNA, 364 bp, Glycine max
ttggaggacagtgtttgtgatcataaccactgttatatcaatgttgcttccattcttcaatgatattttgggagtgattggagcattggggttttggcctctaacggtgtactttcctgtggagatgtatatcttgcaaaagaggatcccaaaatggagtatgagatggatttctctggaattgctgagtgtggtgtgcctcatagtaacaattgcggctggtcttggctcaatggttggtgtcttgcttgacctccagaaatacaaaccattcagttcagattattaaacaccacataatctatttgcctccttggggatgtaagaaactctgagggtggtgatggttgtgatctctattgta

SEQ ID NO: 6292 - DNA, 415 bp, Glycine max
ggtctgctctttcaggttgttgatgacattctcgatgttaccaagtcatctcaggaattggggaaaaccgcaggaaaagaccttgtggcagataaggttacttaccccaaacttttgggtattgagaaatctaaggtgtttgctgcgaagttgaacaaagatgctcaggatcagcttgttgggtttgaccctgttaaggctgctcctttgattgctttagccaattacattgcttataggcagaactagattgtttgtttaggaaagtttagatttatgaaatcatattggattaacatttacttattggctattgcaatgcaactagggattataaaataataatacccccttgcccttcttctatgtgccttagtcaggagcctcccctgcccttcttctatgtgccttagtc

SEQ ID NO: 6293 - DNA, 630 bp, Glycine max
cgaggaatcggtggacacaggtctaagttttctgaatttgtttaaagcggcggtgccgccgtgccggctctcactgtgaactgcacgtatctcttctctctcaggcctgcaccttcgtctccgccaacaggtactcttccctctcctctcacccccccactaatcacttgggattattatgctaatcgctcatattagcactttaatatgcgaaatgggccattaatttgttcacgatatcattctcctttttcactttgtgtgtaacagttgttcaccaccacgcaaccaaagatggcagattcgatttgcagaacactgagggatggagcgttggagggagagcttgcgcctactctcacaatcaaggactccctcgcttcacctttcgcctttcatgtattctctcacattctacttcaactctcgtcacacgtcatagcacaaaaatctcagtcacagtcagtttactattcccaaaaatgattacgaattcttttatcttgtagttcttatttttaatctcaattttttcttttataggggtatagtaattgttgcactttctcggagtccatcgtcttacacttctttgttaaagatgaatgggatggatgttgcttcttctaa

SEQ ID NO: 6294 - DNA, 704 bp, Glycine max
actgctatcagattcagagctgataatccaggtgaagatttcaatctaatacgtgtttggattaaagtttgcaaactttagtttgccttaaacttaagtttgcaaactcagtttgtaagagtatctcaggtcttgctttctcaaaactcagtttcaggataaaattttactctcaaacttacttttgaaaccgtctcaacaatggaaatccaaacatctcctcaattaattgtgtttgaagaaactatgaggctacaatatttatagtaagattaaaggatttgcatgtcatgtcacattttttttcttatatgttattattttattttttttgttaggtgtttggtttatgcattgccatttggaaattcatacaacttggggattgaagatggcatttgtggtggacaatggtaaaggaccaaatgaatctctactaccacctccaagtgatcttcccaagtgttgagaagaggactaatacacaatcttcgcttaaagaggaagagggggaaacatgtaaagaaaatataatttccaaagggagtgtgtaccatcaaggctaataacaagattttcttggagcaaataaaaaaggataagctgctaatagggaaaataagaccaattaacatgtcttcactttctatgttttttccctgtcattttttgcattatttgtacttctcatctctctccttgaa

SEQ ID NO: 6295 - DNA, 511 bp, Glycine max
atgaacaacattagtgctcgtgcatctgtaggagccggtgttggtctttctggaaatacccctgaaattagttcacccaatttcagaatgatgtctctgcctaggcatggttccttgttccatggaaatagtttgtattctggacctggagcaactaacattgagggattagctgaacgtggacgaagtagacgacctgaaaatggtgggaaccaaattgatagtaagaagctgtaccagcttgatcttgacaaaatcgtctgtggtgaagatacaaggactactttaatgattaaaaacattcctaacaagtaagaataactaaacatctatcctagttgtgtgatcaaatcaatatactaacaatttagtaaggactgtaattgatggatttcctgatgactgagctgttgtgattgcttttaaggtatacgtcgaagatgctgcttgctgcaattgatgagaatcaccagggtacttatgacttcctctacttgccaattgacttcaa

SEQ ID NO: 6296 - DNA, 906 bp, Glycine max
gaggatgccatgctgtgagaaggtagggttgaacaaaggaccatggaaaaccgaagaagatgagaagctcgtggcttatgttgaaaggcatggccctggaaactggcgttcagtgcctgccaaagcgggtaattaataagttaatacaacttctgtataccgtttcctcaatctgagtctgaatgtaaatggaggaatattcaaagtttgatcaattcctaattttatttatgttgcatttatgtatgtataggtcttcaaagatgtggcaagagttgtagactgaggtggatcaactacctaaaccctaatatcaaacgaggaagcttcagcttggaggaacatcgcaccattgttcaactccactctcttctcggaaacaagtgaacttcagtttcttttggttttgaaattattttatttttagcatggttttaaattacagtccgtaactgtaacagtgtcatgactgcaattgcagttgaattagtcacattttccagcaattatctataatgtaaagattttttcactgatcggtcataaccgtaatttaaaaccatgattcttagatcaaatggttaatcatatattttttagtttcttttggctttgaaattttttattgttagcatgattttaaattagggttcgtaacataagtatttcttcgtcttaccgcaactgcatcacgatttcaattgcggccgaattagtcacattttctgatgacagatcgtaaccgtaatttaaaaccgtgattgttagatccaatggttaatcttatatatttctttgtatcaagggtgtcattgtatttacatgtctgtttatgtttgtattgcgcgcacagatggtcaatcatagccgcgcacctgcccaagagaactgacaacgacatcaaga

SEQ ID NO: 6297 - DNA, 787 bp, Glycine max
  misc_feature (347)..(394): n is a, c, g, or t
  misc_feature (398)..(424): n is a, c, g, or t
  misc_feature (427)..(429): n is a, c, g, or t
  misc_feature (431)..(437): n is a, c, g, or t
  misc_feature (442)..(447): n is a, c, g, or t
  misc_feature (449)..(450): n is a, c, g, or t
  misc_feature (458)..(467): n is a, c, g, or t
  misc_feature (477)..(481): n is a, c, g, or t
  misc_feature (489)..(489): n is a, c, g, or t
  misc_feature (491)..(494): n is a, c, g, or t
  misc_feature (496)..(522): n is a, c, g, or t
  misc_feature (524)..(524): n is a, c, g, or t
  misc_feature (528)..(545): n is a, c, g, or t
  misc_feature (547)..(548): n is a, c, g, or t
  misc_feature (558)..(561): n is a, c, g, or t
  misc_feature (563)..(565): n is a, c, g, or t
  misc_feature (568)..(576): n is a, c, g, or t
  misc_feature (582)..(586): n is a, c, g, or t
  misc_feature (589)..(592): n is a, c, g, or t
  misc_feature (594)..(602): n is a, c, g, or t
  misc_feature (604)..(606): n is a, c, g, or t
  misc_feature (608)..(614): n is a, c, g, or t
  misc_feature (625)..(640): n is a, c, g, or t
  misc_feature (642)..(642): n is a, c, g, or t
  misc_feature (644)..(644): n is a, c, g, or t
  misc_feature (646)..(650): n is a, c, g, or t
  misc_feature (652)..(674): n is a, c, g, or t
  misc_feature (678)..(686): n is a, c, g, or t
  misc_feature (690)..(693): n is a, c, g, or t
  misc_feature (697)..(697): n is a, c, g, or t
  misc_feature (702)..(709): n is a, c, g, or t
  misc_feature (715)..(721): n is a, c, g, or t
  misc_feature (724)..(729): n is a, c, g, or t
  misc_feature (737)..(746): n is a, c, g, or t
  misc_feature (748)..(748): n is a, c, g, or t
  misc_feature (753)..(766): n is a, c, g, or t
  misc_feature (773)..(775): n is a, c, g, or t
  misc_feature (777)..(779): n is a, c, g, or t
  misc_feature (781)..(783): n is a, c, g, or t
cggcaccgtctacaaagtccgccacaaggccacctccgccacctacgcgctcaagatcatccactccgacaccgacgccaccaggcgccgccgcgccctctcggaaacctccatcctccgccgcgttaccgactgcccccacgttgtccgcttccacagctccttcgaaaagccctccggtgacgtggcgatcctcatggagtacatggacggcggcaccctcgagaccgccctcgccgccagcggcacgttctcggaagagcgactcgccaaggtggcgcgtgacgtcctcgaggggctcgcgtacctccacgcgcgcaacatcgctcaccgcgacataaagcatnnnnnnnnnnnnnnnnnnnnnnnnnnnnnnnnnnnnnnnnnnnnnnnntttnnnnnnnnnnnnnnnnnnnnnnnnnnnttnnntnnnnnnnggggnnnnnntnntccccctnnnnnnnnnnctttttcccnnnnntccccttncnnnntnnnnnnnnnnnnnnnnnnnnnnnnnnntntacnnnnnnnnnnnnnnnnnncnnttcccccacnnnntnnnctnnnnnnnnncatatnnnnnccnnnncnnnnnnnnncnnntnnnnnnnccccccgtccnnnnnnnnnnnnnnnntncncnnnnntnnnnnnnnnnnnnnnnnnnnnnncccnnnnnnnnnttcnnnnctanttacnnnnnnnncccccnnnnnnnaannnnnnattaacannnnnnnnnnantattnnnnnnnnnnnnnnacttttnnnannnannncccc

SEQ ID NO: 6298 - DNA, 401 bp, Glycine max
gagactatattcttatcaatatttttgtctcaagtttcaattttgtgaagagatctcttggattggatcatatgggtggaatagtgggcaatgctgcattggttgcagttagcatgatagctttgcttcatttacatcaggtaactaatcatgagcagccatttggacaagaaaatactgttcacagaaacagtaccgtgagaagaacgagattggttggttcttcatccgaagcccattccagtaatttggatgtattgttagctagaggttaggattaaacctctatcccataatgaaatgatgagtgggttatgttttcagtgtgttctttttttctccttttttgtgctcttggtccttttttttcctcggttacaaagaaggcatgaaacctaaaa

SEQ ID NO: 6299 - DNA, 394 bp, Glycine max
ccaaacggtacttttaggtcctagctgcataatggtatgtgaaaagtgtgcccaatggagagcaacttgcaagagaatcttcttgctgatgtttggagagtcaaatgacaaatgtgcctatttgatttaaaatttagtagaatctatttgatttaaagtttagtagaattaatttagcactcattgggggtgtaagtaccaattattcttggtgatatctttatggtgtggagaaatgattctaaataagaagtaaatagggtcatcaaattctcgctttataagttgaataaaattgaattgaggcagggatgagttgaacacgtaccgggaaacttcattagtccattgatgttctgatatttaatttgttgactcttgttcttacattccg

SEQ ID NO: 6300 - DNA, 911 bp, Glycine max
  misc_feature (898)..(907): n is a, c, g, or t
ttctatacatcagttcatttttctcatgcccttttgctaaaaaaggtgtgtggcaaacattgtgatgcactagactactagcttaaagtcatttggttttgttttttaaattattggatccttaacttgattcatgtgttacttgagttataaataataggtttggaatcggaatatgatgcgtatgttacctttcccagagatttataagacttgatgggaaattttattccacaaattttgattgatagatgttgattttaatttgtatgaataatgtatctcaagaatcagtttgtaagtgtattgccattcacaagatgggatatgtatgcaatttccttgatacacatttaattctttatagcttttacatgactcgatgtgcagttttcattgcctttaccccaaggtgggagggatgcagtgacaaagaacctcattctccgtgaagatcaacttcctcaaagggtactttatcctaaaatgaagaaagccaataagcaggttgtgtgtgtgtgtctgtatttaaactattgataatagccaactgatccatatcccttgggaatatggtgttctttcatttttatcccgagtcaatttagttagtttcataccaacccgagcttacttaattacactttgtaggatgatgacttctttacaccagacagtgtcttcagccaccacatagacaagaaagctcctttccagcctcctgtaaggaaagcaatggcagttttcagtgggaggagaaatccaaatgacaatcactactcacgctctaaagcataagtagtggatctccaaaattttgactggcttctattcccccctcaattttgtttttcattgcttgactttgaaagttaactggaaattgtttaagtatacnnnnnnnnnngcct

SEQ ID NO: 6301 - DNA, 377 bp, Glycine max
cctgcttcactaaatggtatccaagtgaatcaaaatgggtttgcaacatctccaaccagttcaactgattcagcacaagttgtatatgttgaaactgatcttgaaaacaaaagtccaactctggatgaggaaaataaagatgcattttcaacagatgtaagttctgaaaagaagcatgttgaccaaaatcctaaagaattatctgccagcagtgaaaatcctgaagtagaagaaaagcaggaagatctcagcctcccatctggttgtagtaaagatgataaagtaaccaacaaggatgcagtagatgagaaaaagccaagcaagtgttggggagattacagtgacagtgaagctgatatgattgaagtcacgaaact

SEQ ID NO: 6302 - DNA, 384 bp, Glycine max
cttcttgaaagcttacttgcatgatgataatgaggacttgttgaccataagagacaggcatgtgagtctaccagtggagatcaaatttgattcttttctgtgaaaatcagagaagatggtggggagcatatatttctgttattatcatgacacatatgactgaacttttcagttacacatacacatgcattagattaaagttacaggtgaagtgcatcatgtgcaagatattaataaagtgtcccttttttgttgttgcatgtaggctatttctggaagacattaaaaccattgaccatagatgattgtacttgaagtaatatcgcaactcttttactttaaataaaagtttgaagaggtgccagaggtcatcagcatactaaa

SEQ ID NO: 6303 - DNA, 949 bp, Glycine max
  misc_feature (892)..(892): n is a, c, g, or t
acagtccccgtcgcaggccgttgccgccggaattttccagatcaacaccgccgtcgctactttccggcgactcgtcgatggcgttggaaccgttaaagacactcccgaacaccgtcagaaactgtaccttccccttcgctctatttcttgtttctttggttctttgtttttttcttcttctgtttttttaccatggcgtgtttggtaggcacaatacgaggcagagaatattgctgctggtgaaagatagttctgctaagctcaaatccttgactgaatctgatcgtgatgctaatgccaatgtatgcttcacttcttttctttcttttaatttgatgcttcatgtgtgactaagaattttcattacctacaatcgatcatattcataaatcaattagatcaattttctccgtaaatacttataaaaaaagattatactacaaactagaattagtttatgattaagttttcttatggaaaaaagcctgtttcatttttacttcttattttcttcttctttaagtgtttattggtaagtcatgttcataagaaaagagtgagaggaaaaaataaaagaacctggattctagtttctatttggaaattttccaagaaattcaacccttgttgaaccacaggaaactaatggttgcgtgccgtgtaccaaaagtcaatcgatcatagccttgtgatgctttctagtattgaaaatttggaattgacttttttgtttggccttgtatttggtgctccaaactttctgtttctttttctatgcttgaaaactgtgaatgctaaatatgaattggatgttagttaaccctcccagtttttcttcatctaaacccaggctagtaagaaaattgaggatgctaagcttgcaagagaaagncaaaccacattgcaagagttccagaaagtacaacagcttcctcgagcgcgaatcagc

SEQ ID NO: 6304 - DNA, 639 bp, Glycine max
  misc_feature (544)..(550): n is a, c, g, or t
  misc_feature (554)..(560): n is a, c, g, or t
  misc_feature (563)..(565): n is a, c, g, or t
  misc_feature (603)..(607): n is a, c, g, or t
ctactacagcagaaggacacaaaatagggtcactggcaatggttattggatgccaatgggaatggaagagccagtggtttcaagctcaagcaataagagagttggcatgaagaaatattatgtgttccatttgggagaagcccctgatggtaacacaaccaattggataatgcaagagtatcgtctattagattctgattcctctagcagatcatctaaaagaagatcacaacctaaaccggttagttagtacgtagtgcacacataatttacggaacataattaacaaaaactaacaactatcattgatcagctaaattttgatatgaaaagttatctttgataattgattgtattttaactttttttactttgttgtttgattcaggaccataataaatgggtgatatgtcaagtttatgaacaggataacgatgatgatggtgatggtacagaactctcttgtttggatgaagttttcttgtcattggatgatcttgaagaaataagtttgccaaattagatgattatgcaagtgatctannnnnnntgcnnnnnnntgnnnttttcttgtcattggatgatcttgacgaaataaggttnnnnnattagttgatgcaagtgatctagttagctgca

SEQ ID NO: 6305 - DNA, 851 bp, Glycine max
tacggacccgaccaaattcacgtttcctcactgcaactgttcgtggagtacaacaaggttatttcttagtcacttattttagatagagcttctttactattgttttatggcggtgcttttgagaaagttatgtcatttgtgttggaattaggaaataatatttacatgattgtttcacatttggatctatcttgattgtattaatagccctgccctgtcttttaattaatatattttgtgagtgctgggtatacccattagtgtgaaacaatttttattcaattttcatttccgggggtaggaaggagttaggagggaaacaacttactgttgctaggtgataaaaaaatttcatgtgtatacttcaatgcagcttatttactattgcaatgagtcagtgtgactcaagtgcaagtggttccatactgaattttttcttcaattctataatttttgtgacaggatcataatctttctatttgtgaattttgtacagcaaataggatgtctatatgttgagctgatagtttatgtatattaattatattgaattgaatttcttgtggtattttctaccagcaaatcgagctgtggaagtgaatgagatgtggcgattgaggcaaaaagagctcgagctggataaacgtgttaaagaaaaatccttgggtaaaagcagtagagatagaagccatggggatgataactcatcaagaggcacaggaagacatgctagtattgataatagcacttcaacctcctcctcttcaaggtcaggtaaaagagagtatgagttggataaatgggttaaagacacatcaaaagataaaagcagcggtgacaggagctatagg

SEQ ID NO: 6306 - DNA, 411 bp, Glycine max
aaaggagagaaaaatatgcaaatcaggttatgaacaaaattacaaaaccatgaagccattcattcaaaagtctctatacatcattgggcatgattgcagatttgcaggtcaatcaatagtacagttaaaactgctaaggccaaccactaaatatgaaaaataattaacacagccaacaataaacaaataaaataaaaaagaataaaagaaacattgatgtacatataatttaaagacaacaaaagtaaagagacacaaggatgaaatccggaaggagaaaaggaatttgaagccctcagatctcatagcttaacacaatcatctacagcttttgtcactggtttcattcataaccttattgcacctttcagatcagggtgttgctagcattgcatcccgtatacacaaaca

SEQ ID NO: 6307 - DNA, 932 bp, Glycine max
  misc_feature (866)..(868): n is a, c, g, or t
  misc_feature (890)..(892): n is a, c, g, or t
  misc_feature (922)..(926): n is a, c, g, or t
tggttttgtctcaggttcttttcaagaagcctaaggcttggggtgttgagtctgccaagaatgcttatgcaaaacttggtgctgatgggaatgctcagttgcttgatataagggcactggtggagattaggcaagtggggtccccagatgttgggggtctgaagaagaaagcagtgtcaataccttataagggtgatgataagccagggttcttgaagaagcttgctttgaagtttaaggagccagagaataccacattgtttattctggacaagtaagagtagtacagaacaatttcatttgtagtttattttttatctattttgttgttataatccatgttgatgatatagcatattgagaattgggaaaaacccatgtgacatgtcccacattgacttgagattatacctgataggaggttataaagcttaggcacccactaccttacatgttaattttgtgaggatgtgttaggcctaaatctgaatttttgctattaattaatggtgaagggaaaattgaagaattctctttagcattcaagctcagtttttgtgaggatgatgagttaggcctaaaatctaagattaagtcaacacacttttgctattaagtcatcacaattttgctattaatggtgacaggaaaattgaagaattctctttaaaattcaaactcagttttgtgaggatgatgagttaggcctaaaatctaagatttagtcaacacacttttgctattaatgctgaggggaagattgaaaaattctcattgacattcaaaggttgtttgttgtgttattttatcatggatatttgatgtttctaattgcactttgcaagagaatattcttgaatctgatnnngtgaacttgtgatggaagccannntttgatgggaactctgaactggtgcagagnnnnnaccgta

SEQ ID NO: 6308 - DNA, 411 bp, Glycine max
tggctgcatcatttcatggatatttgtctacttgaaagttcctgaaacaaaaggcatgcctttagaagttattattgaattctttgctattggtgcaaagcctggtactgatcctgccgcattgggaatcaaaggttgataccttagtgaatactgataagtttataaattcagaaggttctgattcctcctaaaatgagttgagaagtatggaaaattgaaactatttggccttgggacatatgtcagcatgcagcgacttccccttttgtgcttttaggagaaaatgagtataatctagtaatttatttatactcattatgattaatgtttaggatattccttgtattcttttatattttcattccttagcatttgccgtttgatttttcaccatgctttgaaacaggt

SEQ ID NO: 6309 - DNA, 409 bp, Glycine max
aagtttcagaagtgaaaaaggtacaatctttccaagtttgaagggtattactattatggcacagttcactacgcagggtcgcctgaagctgctcttcaatggggagggtgtgtcttctgttttggagcacaacaaggacccttttctctacaacaagtgcagatcagttcaaacccacaagagaagaacaacaaggtgcataggttcttctgccagaatttactatgtatcatcatctctaagtaacaaaacccacctttgtaatgcggaggcatggctcacttctggcaatgggagtgttcatgatgaatatgatgatgatgtggaggatgatgatgatgatgtgtttgaccgagatgggttgtcttgtttccggggtttggtgttggacatagcttacaggccagta

SEQ ID NO: 6310 - DNA, 697 bp, Glycine max
aacatcaatactcaaggcagtatggtaattgtaatgtttgttattgtttaatgtctttcttagcatttgacttttcactttgccaaaacaggtcaggaaggaaacgctgttggagccatctgaccttcgtttcttccaaaatcattcatcccagatggcagcattggattatcttgtctcgttagagagtgatatttttgttcccacatatgatggaaatatggccaaagtggttgagggccaccgcaggtatagttctgtacaaaattacattatttgtaaactttgaactacttatcagtgactacacaaactgtattttttatatttctttaggagtgttggcatgtgtgttctgttaaaatactaaaaacacttcatgttcaaacaatttctggcttagtttaaagattttggactttccagtagtacttatctgttaagtgagttgactttttaccctcttcaatgcttgtacagatatcttgggttcaagagaacgattttattgaacagaaagctcctagttgaattgatagatcagtacaataatggagtgctaaactgggatgaattctcttcagcggtgaaggaagctcatgccgatcgcatgggtagccaaacaaagaggtttgtaatccctgagaggccaaaagaagaggattatttctatgccaacccacaggagtgtttggaa

SEQ ID NO: 6311 - DNA, 392 bp, Glycine max
cccgacaactatgtccagtgggatatctcaattcatctatacaattcagaaaatgcaatctgggtgacgtctttaacagaagttttgatggggtggagaggtggtaatgagagtgtgatatgcaatgagatgctgtactttttagtttattcaactgggggtggtcaatcagaaaaccgtcatgccctagttgcgtataacatgtccaatcattcatctcaaggtagtttaacaaggaacttcattccggtaccttgttctctaacatgtggccgtttgatgaatctgaaggagaagcttgtaatggtgggaggaattggtaaaccagatcgacctgacataataaaaggaattggtatctggcttctaaatgataagaagtgggaagagat

SEQ ID NO: 6312 - DNA, 712 bp, Glycine max
  misc_feature (54)..(54): n is a, c, g, or t
atttcattcacgtgaaaagaagcccggcaaggcttttgttgatggtttgcttcntaactttgtgtaataaaaataaacattttcttggtgctacatgaatggtacccaatcttcataaggtttcttactgcttatgttttaatttcatgtgcaatttgcctaaaaggttagagtaattgaaaagcttgtattcatttactattcttgattggtaccaccaatcctaggtttgattttcaatttcttatgagattgtggatatagaactaaagttctaatatgcattctcatatatcatattggtgaaattctagtgcattttacttggagagtgctattggagtattgatattatgtaattgatctctcaaatttggaaaatgaaaacatcacccatgcatcattgaagaccattttaaaactcactagattatctcctattgcaatgctttcaataggtttcagaaattaactgatatttctcttatttgttactcagttggtatctttttttctgcttacatattggatgaaatgtaccttgcttcccagccaagaataattgaaacgtgcttttgttgctatatccaaacatttataatttttcatgtgatagcagggaaaaaaattgacttcatcacagctggtggcagggtatgtcattctgaacattgccattaattgttttttataattatactttatgtatttc

SEQ ID NO: 6313 - DNA, 590 bp, Glycine max
gttccacaccctatcacttcttggttaggtataccaaagcctccactccgtctgacaaagaggtatattttggtagttggttgttatgttaagcttttgtgtttttttagaagattccagagtggaatggcctgatgaatgtgcctaattttcatgaatgtagatggagaacatggtgtttttccttgctgaacttggattgatgcattatcctactgtaatcttgtaccgtccttctctgattgctgcttctgctgtgtttgcggctcgatgtacccttggaaggagccctttctggacaaacactttgatgcactacacaggctactctgaggagcaactaaggttaatattttcttggaccagcaaattggtattttaaaaatgcaagtagggtagtgtgttttttcaacattcatgaagtgactcttatttatttttactgccagggattgcgccaaaatcatggccaaccttcatgctgctgcaccaggaagtaagcttagggcagtttacaagaaattctctaactcggatctttctgctgttgctcttctttctccagcaaaggacttgtcagcactgtcttg

SEQ ID NO: 6314 - DNA, 385 bp, Glycine max
ttaaatggatagttgggtatgcccatggatcaaatttcatcagtgctgaagtgttgaaattcatattcagactaattgattttcccttgcattgtgatctttcaatattgtgcggtacattggtggactgagaatatgtaatttcacccgtgcaaagcaagtctatattcaatttacaattagcatactttaggctgagacattttggttggatagatataagtctatattcgatttacaattagcatactttaggctgagacattttggttggatagatataaggttcattttggattgttaagaaattctatggactgtagaatgtaattagtgggtacgtgggtgaagaaaagttgcaggaaacagtatgtgttggaatggg

SEQ ID NO: 6315 - DNA, 406 bp, Glycine max
cggtgtcggcgtgtgccgggatattcggaaaaggtgcgtatccgggctacacgggtaacgttttggtggataacgtaacgggagctagctacaacgcgttggatgtgcacggtcgcaagtttctcttaccggcgatgtgggaccccgtcacatctacatgcaaaacgctcgtttgatagtttgatatttatctctctctgagcgtgaccaaaaagaaatgtttcttggctttttgaagaggatattgatttattctacatattcaatatttagtattgttattatcatgtttacaagataaataaaaattacaattgatttaggatccacattagttgtgtttttctctctttgataaggcaatgtcttgttgcataatcaagatgcttgaggatcaatatggagg

SEQ ID NO: 6316 - DNA, 1401 bp, Glycine max
  misc_feature (523)..(523): n is a, c, g, or t
  misc_feature (578)..(578): n is a, c, g, or t
  misc_feature (583)..(583): n is a, c, g, or t
  misc_feature (619)..(619): n is a, c, g, or t
  misc_feature (672)..(672): n is a, c, g, or t
  misc_feature (675)..(676): n is a, c, g, or t
  misc_feature (681)..(685): n is a, c, g, or t
  misc_feature (687)..(687): n is a, c, g, or t
  misc_feature (693)..(701): n is a, c, g, or t
  misc_feature (705)..(706): n is a, c, g, or t
  misc_feature (710)..(714): n is a, c, g, or t
  misc_feature (717)..(725): n is a, c, g, or t
  misc_feature (727)..(727): n is a, c, g, or t
  misc_feature (729)..(730): n is a, c, g, or t
  misc_feature (732)..(738): n is a, c, g, or t
  misc_feature (742)..(749): n is a, c, g, or t
  misc_feature (752)..(752): n is a, c, g, or t
  misc_feature (754)..(761): n is a, c, g, or t
  misc_feature (763)..(775): n is a, c, g, or t
  misc_feature (777)..(782): n is a, c, g, or t
  misc_feature (785)..(794): n is a, c, g, or t
  misc_feature (796)..(813): n is a, c, g, or t
  misc_feature (815)..(824): n is a, c, g, or t
  misc_feature (826)..(829): n is a, c, g, or t
  misc_feature (831)..(841): n is a, c, g, or t
  misc_feature (843)..(860): n is a, c, g, or t
  misc_feature (862)..(867): n is a, c, g, or t
  misc_feature (869)..(871): n is a, c, g, or t
  misc_feature (873)..(875): n is a, c, g, or t
  misc_feature (878)..(881): n is a, c, g, or t
  misc_feature (884)..(888): n is a, c, g, or t
  misc_feature (895)..(897): n is a, c, g, or t
  misc_feature (899)..(903): n is a, c, g, or t
  misc_feature (906)..(912): n is a, c, g, or t
  misc_feature (921)..(921): n is a, c, g, or t
  misc_feature (928)..(932): n is a, c, g, or t
  misc_feature (937)..(939): n is a, c, g, or t
  misc_feature (946)..(946): n is a, c, g, or t
  misc_feature (948)..(977): n is a, c, g, or t
  misc_feature (979)..(979): n is a, c, g, or t
  misc_feature (982)..(988): n is a, c, g, or t
  misc_feature (990)..(990): n is a, c, g, or t
  misc_feature (995)..(997): n is a, c, g, or t
  misc_feature (1000)..(1003): n is a, c, g, or t
  misc_feature (1009)..(1009): n is a, c, g, or t
  misc_feature (1012)..(1013): n is a, c, g, or t
  misc_feature (1018)..(1020): n is a, c, g, or t
  misc_feature (1022)..(1023): n is a, c, g, or t
  misc_feature (1025)..(1039): n is a, c, g, or t
  misc_feature (1041)..(1041): n is a, c, g, or t
  misc_feature (1043)..(1049): n is a, c, g, or t
  misc_feature (1059)..(1063): n is a, c, g, or t
  misc_feature (1065)..(1068): n is a, c, g, or t
  misc_feature (1071)..(1091): n is a, c, g, or t
  misc_feature (1093)..(1105): n is a, c, g, or t
  misc_feature (1114)..(1118): n is a, c, g, or t
  misc_feature (1121)..(1122): n is a, c, g, or t
  misc_feature (1127)..(1130): n is a, c, g, or t
  misc_feature (1132)..(1135): n is a, c, g, or t
  misc_feature (1137)..(1148): n is a, c, g, or t
  misc_feature (1152)..(1159): n is a, c, g, or t
  misc_feature (1162)..(1169): n is a, c, g, or t
  misc_feature (1171)..(1176): n is a, c, g, or t
  misc_feature (1178)..(1180): n is a, c, g, or t
  misc_feature (1182)..(1182): n is a, c, g, or t
  misc_feature (1185)..(1190): n is a, c, g, or t
  misc_feature (1197)..(1205): n is a, c, g, or t
  misc_feature (1208)..(1208): n is a, c, g, or t
  misc_feature (1213)..(1233): n is a, c, g, or t
  misc_feature (1237)..(1239): n is a, c, g, or t
  misc_feature (1243)..(1244): n is a, c, g, or t
  misc_feature (1249)..(1249): n is a, c, g, or t
  misc_feature (1255)..(1255): n is a, c, g, or t
  misc_feature (1259)..(1266): n is a, c, g, or t
  misc_feature (1269)..(1270): n is a, c, g, or t
  misc_feature (1272)..(1277): n is a, c, g, or t
  misc_feature (1280)..(1283): n is a, c, g, or t
  misc_feature (1290)..(1303): n is a, c, g, or t
  misc_feature (1305)..(1305): n is a, c, g, or t
  misc_feature (1307)..(1328): n is a, c, g, or t
  misc_feature (1331)..(1331): n is a, c, g, or t
  misc_feature (1333)..(1337): n is a, c, g, or t
  misc_feature (1342)..(1345): n is a, c, g, or t
  misc_feature (1347)..(1349): n is a, c, g, or t
  misc_feature (1359)..(1361): n is a, c, g, or t
  misc_feature (1363)..(1363): n is a, c, g, or t
  misc_feature (1366)..(1375): n is a, c, g, or t
  misc_feature (1379)..(1379): n is a, c, g, or t
  misc_feature (1381)..(1384): n is a, c, g, or t
  misc_feature (1388)..(1390): n is a, c, g, or t
gcagctcatcaaatagcagagcagttcgccatccccatcccttaggagctttaggtataagagtgcctgtttgtttaaagcttccaaacaccgtcatttccctcttcgatggaacagtcaactaaatgttaaaaacagaacgatcccaaaattattaatcaaaatgatagaacatcatgaaacaccaaatattaataatgctgtaatccattgctgatattacctggtagcgtgcagtcaccttttcacgcgagtcaacatacatatgcacctgataatacatttcatagatatagaaatcaaagctaacatctaattgaccatctatatgtacgaaggtaatcactgcaatcagctgtctataaaaaaggcgctgtactactactaaaggcattactctatattaatattaatgaaataaagaatttcaaacttaatagcataatctaattccaaattatctttaggccccaactcattcaaatacgaaaacagtccagctaacctttctatgtatatcagntatctctgccttccgacggtgaagaaacaaccctgcattaacattaaaaataagnttccngacagacaaaaaagattttctttatttaaataaatnttaattcccctcccaaaggtgggaatttcatgtattaaaacattaccaagggntcnncgccnnnnngnggtctnnnnnnnnnaaannttgnnnnntgnnnnnnnnntnannannnnnnnaatnnnnnnnntancnnnnnnnncnnnnnnnnnnnnnannnnnnatnnnnnnnnnnannnnnnnnnnnnnnnnnncnnnnnnnnnncnnnnannnnnnnnnnngnnnnnnnnnnnnnnnnnncnnnnnncnnncnnnccnnnnccnnnnnaatacannngnnnnnctnnnnnnncacacctcnccacccnnnnncctannntccatcnannnnnnnnnnnnnnnnnnnnnnnnnnnnnntnccnnnnnnnanacacnnnccnnnntccccncannccccnnncnncnnnnnnnnnnnnnnntncnnnnnnnctctaatccnnnnntnnnntannnnnnnnnnnnnnnnnnnnnannnnnnnnnnnnncaccctctnnnnnccnntcccnnnncnnnncnnnnnnnnnnnnctcnnnnnnnntcnnnnnnnncnnnnnncnnncnttnnnnnncctccannnnnnnnnatnacccnnnnnnnnnnnnnnnnnnnnncccnnnaatnnactcntaccanatannnnnnnncanncnnnnnnaannnnactaccnnnnnnnnnnnnnnancnnnnnnnnnnnnnnnnnnnnnnccntnnnnncactnnnncnnnacctcctaannncntcnnnnnnnnnnttantnnnnttcnnnactccatactt

SEQ ID NO: 6317 - DNA, 412 bp, Glycine max
  misc_feature (9)..(9): n is a, c, g, or t
ccgcccgtntcactccatacccgactcgaaacgccgcgtttcaagcgtcaaatgtatctcctcgtcgcggaagccggataacacgtttagtttgcagtccccgtgggaggttctggcgagcacggtgtcgaacacgctgaaggcgctgaagaaaccggccatagctgcggtgttggtggggctgttattaatgtacgatccaacttgcgccttcgcggcatctggagggagaatgggaggaaggtcgttttcttcgtcttcttcttcgtctaggagttattcagtgccgaggacgtcaagctcagggttctctttttcggcgccgtattacgggccttctccgttcggtggggtttatgtgggtcccgccgtgggggtcggagtcggtgctggctcgagtttctttctcatc

SEQ ID NO: 6318 - DNA, 644 bp, Glycine max
tgctattttgttgacattatgattgagcaagttaatagaggaaataggattgaaaatttatacaatgaggaagcttggatgcacatggtccaagcatttaacgctagatggggactccaatctgataagcaggttctaatggatcaatatttctgcttaatgaaaaaacatgatgacatcagcaatattctgagtcacagtgaatttgcatggaatgaaaccctacaaacgataaatgctgaggatgatgtatgggatgcatacatcaaggtttggtcctctctcctttgacagacttctttgtttgatatcttctatcttgcagttatctatattttttacttctgttagttctctaatactcctgatcctccccactccaagtatctcattttcttgatcagatgtgtctgcttgcataggggcctatggtggaataggttgctactactatttcttccaaatctttatgattgcaacttatttctgaatgatatttgcaggatcacccagatgccatctcatataaaaacaattgtttgtatcgtttctgtgatttatgcaagattttcggaaacaaattaatggaagtaccagatgtaagagtgagtgatctggagcagcttcacttgatggaagcaaat

SEQ ID NO: 6319 - DNA, 720 bp, Glycine max
cggtccgtggtactgtgagttatgtgaagatttgtcctctagaagctctggggcagctgctatcaatttctgggagaagtctgttgtagaatgtgctctctgtggtggtactactggtgcttttagaaagtcttctgatggtcaatgggttcatgccttctgtgctgaggttaattattctactttgattactgtgggattgttctttcttcctttgatacctaagtttggctaagtgttaacttgcttgtatttgcattatgtaccagtgggtttttgagtctacattcaaaagaggacaaatagatgctgttgaaggaatggtatgtactaattccttattttggttccaacctccttgctcatgcatatctactttaaaagaaggattatctttcttttctaccacctatctgtgtatattattgaatgccaggaaactttgcaaaaaggagttgacatttgttgcatctgccaccacaagcatggtgtatgcatgaaggtaatttaacataaaaaatgatttttcttctctaccccttggatcaatcaactagcttttggatttaacatttctgattgactagttaatgttaatggtgaatgcagtgttgctacggtcattgtcagaccacattccatccatcctgtgctagaagagctggtttgtacatgaatgtgaggcctactggtggcaaggctcaacacaaagcttactgt

SEQ ID NO: 6320 - DNA, 485 bp, Glycine max
aaatgaaaaggtagagcaatatagtgcaacagatgaaaaatttaagaaacccaatcatcatatcaaatggaaggacatcccaaaagttgaacctaaaacagtacattcagatgatgatttgactgccctcttacaggtgagagtaggctactgactactctgaaaaatgactttttcatatatacaaaactgagtaaaagtatatatcataatttcaggaagaagaagaccttgtaaatacgcaccggaaacaagtagaggagaccatgagtattgttagagaggtatttaaattgactctgtttttcctttttacattttatttgttcatataaattttatgttaagtacgtaatagggcatacgtgaaaccttcgaaacttgtgagatgtgactattagttagtgtaggctgttgatggctttaatataaaatggtgggtcttcaaaacttagcttctaagcaaattgctttttttttttttt

SEQ ID NO: 6321 - DNA, 898 bp, Glycine max
cgtgagtacttcaggtacaatcccacccgaaaaatcaccttcaccgatgtccgcaaaacgctcgtgggagacgtcggttccatccgaagagtcttcgatttcctcgaaacttgggggcttatcaattaccatccctcttcgtcgctcaccaaacccttgaagtgggacgacaaagagaccaaatccgattctgcctccaacaccaccgaatcttcttccgctcccgccaaagaaaacactaagagactctgcagtggctgcaaagtcgtttgtaccatagcttgttttgcctgtgacaaggtacctttttttcctttccttttcgttttttgtttagatgcacttcaatgtgtgcatttggtgttattagcttattacaattctagttttatctccataatttacataatgtatgtttacattaaatgctagttagttttgtacttttgttagaaatgtcacttggcggattcgaacacacaacctctcctccccctcccttcaccaaccattggacaccttatatctcctcattaatggtcattattaattatacaagtgaagctttaatttaattataaaatactgtagtactgaaaacacaagtaattattgtatggttagagaccaccaagtgaccatagttttgactatttagatgtgaagtgtagtggaatttttcaatttacaaaaaagaattaataaaacttgactatgtgtcatgtgatgataatgatttatgaccatggtggtttggactgtataataatttctcaaaacacctaaacaacagcatctatgttttgtctggtatttgatggacggaaaattgacgtgtgtagtatgatttgactctttgtgcgaggtgttatgttcgtggcaattatcgagttggtgg

SEQ ID NO: 6322 - DNA, 571 bp, Glycine max
tccttgggcctgtttgtaactgagggttgatctgctatgttactatcaacacccccttcgtcgaaaacaaccttgtccgcaaggttgtgaagatcacgtaagtcgtcccaaagttcccaggacgcctcctccggaggaagaccctcccattgcaccaaaacacgttttaccggcgtcatgcccgaggagtcgagtttccagtcgaggattgcgaaagggtgtacaatggggtgattatgcctcactttctacttggattgaaatgtcattcaaaacttgttgtttaattcgagaaacatttaataattctcgttttctattcagattgaaggagaaaatagggagttttcttgtgtgctctttctctgatctacttgcatactaaaaatagaaacttggtcttggttctaactttttgattaactgaacccccagtggctttgtgattgcagttttcatggagttcctgcagaggagcgtctacactggcgttctttcttggttaaactaggagctgacaatcttaagggtgtaaaaaatgaagaactcctagttgcttgccataagtcag

SEQ ID NO: 6323 - DNA, 735 bp, Glycine max
gatttggattgcacatttcaaacaagtttaatttgaatgatgcaccaagttaatgttttttgccagatattctcgcaacataatatctatgaagcaggacagaagaaagtggcatttaagtaccttactgagaaggtttgtctagttcttttgtttagcgccaagtaaagttttagcttgaattggaaaccgcatattatcagcaatgtttcaattgatcttgcaaaaatgaagtatgaatatgtggctcgggatattgattacttcgattttatattggcttctatctgataattttacagtttgtttagctggcttgatgtgctaatattttttctctgacacgcaacagatgggtagtagtacatcaattatgctagttgtttgttcgtcttacactaaattgcattattttttttcttttctagattgtctctgacacataatttagatgttattactgttatctatgccacaatctcttcattacctgcttttagatatgcctgtgaaagtattgcatatagcaaaggtgaatgttatttaaggccccctggttcgttagattcaaaatcatttttatggctatttcatagacaatcccatcattgagttcctacccttatcaaatttcggaattccttggccttgcacctgtacattttacactttcaactctggttcatctacatggggcattgtttcaccagcattgtaacagttgtaagttgtaat

SEQ ID NO: 6324 - DNA, 368 bp, Glycine max
ggtatatatcaaatgtcaattacttagtagttaaactggcaatgtggcaacggtcacttctccattcccatgtctccattattagcatttggcttcacgagttctcctgaacttgagactagggaactgcatcgttttcctatttaacagtcatgccatttgctatcgttggaagaatgtattagttacacagtccttgttttgattcagaaaagaatacaaagctgtgaatttgatagattataccgaataagatgctgaactaactgctctgcaaataaacatttgcctttcacggcattatctttaagagtagtttcaaatgtcattttttgtttttctgccgctacgcaattgatgactaataa

SEQ ID NO: 6325 - DNA, 360 bp, Glycine max
ttaggctttaggacactgtcatggttttatgggagcagaataacctggtacttagcattcaaggctctttggttttgtcgttatatgagtgactttgccagaaacataggggctttgtctggtacaaaatggacattcataaaacaatttcaaggccttggattcctagaataacatgcagaagattgaagcatggagttagatgcataatctgagccatatcctgctcacctagaagtatgcatcattactaaattcatgatagatgtcaaacattcttgacacatgatgttccgcgagtttgtacatttacacttttagtatgtcaccgatttaagagtggtctgtttgtagagtcgg

SEQ ID NO: 6326 - DNA, 540 bp, Glycine max
cacctttgaaggttaatacctgaagtattctatcacattgataactgttgcagggattaagaaagctaagccaagattttcattagcatcagtgttatgtaaaagtgggggcattgatcattcaatctccaatattgagagctttcctgaaattataaaagctgttgatcctagagcttctgcaaatttagatggaaatcatctagatgatgatgacagaattgaaataaattccgacattgagcctgctgaaacagaagctttaccacatgaatttaatatggccccaatagctgatctttttgacaatctccaagataaggctcatcaggtgggtggaaaagtagaattgcttcccatactctggcctatatatttaggtctttcctgaatgagatctttctcgcttccatattccaatattttccacataattgtcaaaaagaggaaatacggtgcagctttttcagaaaaatagtatatcccactttcaggagacagtcattgacagtgaagattcccccgagtctgtggatagtg

SEQ ID NO: 6327 - DNA, 361 bp, Glycine max
tccccggcatctacagctagcaatccgtggggacgaagagctggataccctgataaaaggaacaattgctggaggaggagtgattcctcacatccacaagtctcttatcaacaagtcttccaaggagtagattactggtgaatgatagcagcttgatggaaaatttctctactaattgtgtatttgttgcatgacacttgaaaaacacagtagggccttcttctatttatgactgagttgctgctgttgatcatggatataatatttagtgtttctctttgttaatttagtatgtctctatcactgaaaatcttaattgaggataattcaatctgatggcttgattccacactgtgtttag

SEQ ID NO: 6328 - DNA, 335 bp, Glycine max
gggtgtggttcgtttagtggtgtcaagtcttgcgaacgtgagggtgcatgagtggtaatcgggatgtttttgttgcacggctccatgcttgcgcatgcaacgtgtgacatgcatccttttcattgtcaccttagccttcgtggcttaggtgctgacgattggttcctgtgttgcctacctaccaaacggtattcgtgtggctagtcagacccattccatccaggcctctttgttggggacgctggaggatttcaaagtcccacacgtgaaccacgttagtcgtccatcataacggcttcctgtggcacacgtgtggtgattgttctctcggataa

SEQ ID NO: 6329 - DNA, 899 bp, Glycine max
  misc_feature (768)..(771): n is a, c, g, or t
  misc_feature (794)..(796): n is a, c, g, or t
  misc_feature (806)..(806): n is a, c, g, or t
  misc_feature (818)..(818): n is a, c, g, or t
  misc_feature (820)..(823): n is a, c, g, or t
  misc_feature (836)..(840): n is a, c, g, or t
  misc_feature (843)..(846): n is a, c, g, or t
  misc_feature (850)..(852): n is a, c, g, or t
  misc_feature (856)..(858): n is a, c, g, or t
  misc_feature (871)..(881): n is a, c, g, or t
  misc_feature (885)..(892): n is a, c, g, or t
ctttggcttatcttcatgaagagtccagaataaaaatcatacatagggatgttaaggcaagtaatgtattgctcgacaaggattttaatgctaaagtctcagattttggtttggcaaaacttattgaagatgagaaaacccacattagcactcgagttgcaggaaccatgtaagttcatattttgctactatttctcttgttttcatatcaaaacatggcattgcaatcttgataatagtttggaggaaagcttcaccactggtttgccatgaaaaacaaaagaataaagtctatattgccaaggacctatatctctaacacatcccttcatgcaaaaagtctttttgggcttggaagtaggaaaaacatgtctactcaatcatgtgccaaaattatagctagattagagacacataagcagcaagaacatctcattcaaggatcattttcctaaaatcttaagaaatggaagcccttgaatagtttatatgtaacatatatattatctgatggtttccatttgccataatgaaaaaatacacattaaaggataaagtgtgcacttgaaaaaatacccatttttaatcaatagtggagattatggtaaaaatcaaatgcatgtgtatcatactttgaagttagttatgatttcaaacattaaatatttaacccatggttattgatgtactttattctgtaaagtatactcttagtcaaatccattattttaacaatgctaaatgcttttttttttttgaaggggaaannnngccccggaaaaaaaaaggggggnnntttaaaaggnaaaaaaaaaggntnnnntttttgggggggnnnnnccnnnnaatnnnccgnnnaaaaaaaaaaaannnnnnnnnnnaacnnnnnnnnttttttt

SEQ ID NO: 6330 - DNA, 383 bp, Glycine max
ggtaccaaaaattcattgggatgtggcatttcttcgatgagacgaggctacgaattgaaagatgaatgagattacataatattatttgtcgtgagacttcaacgacaatgacatgcacatggtggcgattgtcattggcatgtgcttgtcgttagcatctatgttggggtatgccaactctgacatcctcatcatcgttgttggcgtggtgtccctcaacattggaggcatggtggtgttgtgtggggtcacccaccactttctcttggtggagcttcgacactcctgtggttggaattctggatccacaccgccatagatccaagaaggaataactttgaaaggagaggtttttggatggaagtgtacatagggaaagatgg

SEQ ID NO: 6331 - DNA, 408 bp, Glycine max
  misc_feature (19)..(19): n is a, c, g, or t
  misc_feature (359)..(359): n is a, c, g, or t
tctggagctggtgttcttnaatgccgcaggggtgtcatgtgttaatatcaaacacactactacaaccaaaagagattaaacccaattggaaaaaaaccaaagaatactttaaaaaaaatgaggcagagaaaagcataaaggaaaggaagaaagaaaaagtttccttcctttttcctcttattattgcgttgttataaatgtactactgattgagtttgcacatgcagcaacacctgtgatcacaaccgttgtttgttttctcactactagttagatatatccgggaggggggggggacactgtacattttatttgaactgttatcaaattgataacaaatgattgcttgcttaaaaggnatttcttccccctttcacaatatattgtccacttgtgcgaaaaattaaa

SEQ ID NO: 6332 - DNA, 1244 bp, Glycine max
  misc_feature (1219)..(1220): n is a, c, g, or t
  misc_feature (1230)..(1232): n is a, c, g, or t
tggaggagctcttcaccgacttcaatcgaagaagatggattacagtgctggttcgagtctgtttccgttgcaccgttgcaaaaccattcacctggttggtaatattcactctccttcttcaactcaacgcacacgcgacttctcattcgtatcaatcattgattcgttcattcccctattgcaggtgaggcacgcgcaggggattcacaatgtggagggtgacaaaaactacaaagcctacatgaaccccgattacttcgatgctcatctcactcccttgggatggcaacaggtttcaaaaaaattatttttttaccaattccttcatttatttttatttgctttgttctaatttgtcgtttctccattgtgcctctgtgaacaggttgacaatttgcgtaagcatgttcgcgactctggccttatcaacaccattgatctagtcattgcatctcctttgatgaggtttttctctctaattacataatatgctaatatagatgtcataaaaatgtacttttcgaatataatgtgtttgagtttatgtacaatttgatccattaaagttgcaacttggtttatttggtcccggaaagtgtgtgcttatacaatctggttgctgtaactgacagcataacaagtttatcttatattcagctagtgtttgacagatataatggaaatgccaaattgccaatgtggaatgttatgtacgcatatttgatgttgtttgacaactaggttacttacttggaatccttaaacaatgtcatcactttgtatgattggagaagactgaaatttctcacccattatgtcccaaacaaacatttttttttacttgtaaattccctaatctcttgaatcaatgtaatgtatcatttagggattccatgtacggaaatctagttggcaaataatgttgtgtgtgtgtgtgtatagcactctacattggcgcttccatgatgtctttttgaccccgagtgatggagggattcacttgatatgaagttgtcactttttgaggaccaatttatatagatgtgctttataaggaacacatttatggatcaggttgtatttaacttcaatatgaattttctctcatgaatcctaaaggtatttaggttatattctgcttgggaaaattggcatttatctgcatcaaggcaaaacatggcctttgacttgtatggtacaatttatgtctttaggactnnacaaacaacnnnggggtattggag

SEQ ID NO: 6333 - DNA, 752 bp, Glycine max
cagaaaaatgggtctcttgggtttaggtccattttcatgcatgccgatggcaaagatttgtttcttatggttttaggtactattggggcagttggggaaggcttgaccacccctctagtgttgtatatcagtagccgcatgatgaataacattggaagttcctctaacatggatggaaacactttcatccatagcatcaataaggttcaatttttcatatctctctttatacacacaagaaattattatatagtcccatatcatcatataatcttaattaatctctatgtcatgtggaaattaattgaaaccatagatacgcggtgatctaaagctatctaataacttttcatcacatggaaagaacttaacacgaaagagaagcttactgataactttgttagctttcttggctttattggttatgcagaatgcagtgtcttggttatatttggctggtgcctcttttgcggtttgcttcctcggtgagtttcggttatgcaatcatttttccttttccttttccttttctctttcaattcacgccaggcaaattaaagtaatgatattgttgtatcatcttttttatttctttaattattaatattaattattattatattctggttcagagggttattgttggacaagaacaagcgaaagacaagcggcgagaatgagatgcaggtatctgaaagcagtactcagacaagatgtagagtacttcgatttgcatgtcacgagcacctcag

SEQ ID NO: 6334 - DNA, 541 bp, Glycine max
  misc_feature (420)..(426): n is a, c, g, or t
  misc_feature (428)..(441): n is a, c, g, or t
  misc_feature (447)..(450): n is a, c, g, or t
  misc_feature (457)..(464): n is a, c, g, or t
  misc_feature (466)..(472): n is a, c, g, or t
  misc_feature (474)..(474): n is a, c, g, or t
  misc_feature (479)..(487): n is a, c, g, or t
  misc_feature (489)..(504): n is a, c, g, or t
  misc_feature (506)..(509): n is a, c, g, or t
  misc_feature (515)..(527): n is a, c, g, or t
  misc_feature (529)..(538): n is a, c, g, or t
ctgagcaggtacatcctgacatcggcatttcgagcaaggccatggggatcatgaacagcttcatcaacgatatattcgagaagcttgcgcaggaagcagcgcgtctcgcgaggtataacaagaagccgaccattacatccagggagatccagaccgctgtcaggttggtgctgcccggggaacttgccaagcacgctgtttcggaaggaaccaaggctgttacaaagttcactagctcttagggttaggggttttttcgtttaggtattttttttgtaaagcttagtcgtagttagtggcttcatttggtattctatatgctaatgaaaatttttatttaaaagtattcgtgcctcctgacttagttgatttgacaagtgaataatgctcgcataacacgaatagcattaggtattagtnnnnnnncnnnnnnnnnnnnnnccaccnnnnccctccnnnnnnnncnnnnnnntnccctnnnnnnnnncnnnnnnnnnnnnnnnncnnnntctccnnnnnnnnnnnnncnnnnnnnnnncac

SEQ ID NO: 6335 - DNA, 349 bp, Glycine max
acttctgattatgttaagttgctccaatccctgtcacttcaggtattcaatatgcctaagtgctgtctcattatatatatatatatatatatatatttatataatgattgtttaagttttgttgaatttttgtgtgtagatagttgacgttttgttgctatgttaacttgcttgctatgtaggacatcaagtcagaagattggtctcgctttgttgctccattttggccagcagtgatacgctcagccttcacatggaagggtctatcttcactcttgagcagtggtaagcttggaatttatattgcatttcaaaaacaaacccccccatcttctattgcaacttgcaa

SEQ ID NO: 6336 - DNA, 728 bp, Glycine max
ctcgcagtagtcgattatctaagtttgttgatcatctccgcaacttggatgaaaacactgatgaggtgttactactgaatgcttcttgaatatgattctattcttatttcagttcagtttaataaaaatgttatatttttattcacagtttgatgtccatctcatgcttgtttctcttgaccaacaaagtacatcaagtttgcagcaaccttacctttgctgtcgaccaactttgtctgtcaggcacctttacgaagtaagattctctgtcttttgatcacttgtttcttctggcagtgatagttcttgttcaacttgatctaagtttgtgtagcctccaccataagaccaagtattgttttaccccatagttgtgaattcagtacctgactttgtttttcttgctcctttgtcagatgctttattaatatatagaccgtgttattttctgtcccatcttgataaaaaatacaatgattgcataatatgctttttgttaatgagccaaagttagttttcttgcttgattgtctaacatttatgtattttttctgcatagcacgttgctcgtcagacacatttgccagttgaaggaattgagatactggcagtcaaaggatgctgcagtacaaaccgtgacaagtcaaccaatgagaattcagacctggcatacgatgagctatcaacgctggttatagatccacacaaagagaactgaaattgcaaga

SEQ ID NO: 6337 - DNA, 554 bp, Glycine max
gacattttgctgagcgtatggctgtgaggaagtcatggatgcagcataggctcatcaaatctggagcagtggttgctcgtttctttgtggcactggtaacagttattacttcacagattttttgtatttagagttaagatcttatttctgatattcagttggggtttcttactatttgattgaaatcttggcagcatgcaagacaagaaattaatgcagagttgaagaaggaagccgaattttttggtgatattgttatagtgccgtatttggataactatgaccttgttgtgttgaaaacagtggccatatgtgaatatggggtgagataagatatagattattaaaaattgaattgtgaaatacaaattcttcagtgatatataagatttgcttcttattgttcataggtacatacggtttctgctaagtatgtcatgaaaggtgatgatgacacttttgttagagtggatgctgttatcgatgaagcaaggaaggttccagatggtacgagcttttatattgggaatataaattactaccacaaacccttg

SEQ ID NO: 6338 - DNA, 404 bp, Glycine max
cattgggagaacggtgcgcttcagctttgcgacgctcacgatgcgtgggagagtggttgggagaagaattttgaccggcttgctgggaagaaatttgcggcggctaggaagcgaattcagtctatgaaaatggaggagtgcgttaaggattttgttcaattgaggaaacggagtgcgcattggagtgcgcctctggtggatgagatttgtgcattgggtttgaatccaccctgaacaccgtttctttctttctgtcacacagtttagtaaagtcactactggattttctacttttctttggcggaaataggagaaatatcaattcttttttcactcgttggaatatttatttttcaaatttaaatatataactatatataagtgggtgtgaatatggcactcta

SEQ ID NO: 6339 - DNA, 403 bp, Glycine max
gatgatttgattcgtgtttggttggaattttatgattctttttgttctttgtagactggaaatagattctatacattgacacattcgttcaggcattcatgaattggaacggttgactgaaagataagatggttcacattttggatacatatgttaagtttgttacatttaggatgaaaacctagatgcagcttcttatgcgcttttggcgatgttttccaatcagaattagaggtttaccttggtaatttatgttgctgacatttatttcgaatctatatatatattatgctaattactgaggtgaatctccaattctgacgggagaataacgctgataccactgaagatttgtatattcattcaattgttctgaatagctgaatgtgtgaattctggagtt

SEQ ID NO: 6340 - DNA, 1004 bp, Glycine max
  misc_feature (939)..(941): n is a, c, g, or t
  misc_feature (989)..(991): n is a, c, g, or t
gatatcctgcatgaaaaacatagttgtattaaaaaaagaggaacactaatgcaaaagcaatgtcaacccggagacacatttgatatgataaataaagtaaactgtaaactaattaacctttgttttaaaacaaataatgtaccagctcactttcttctaagttctgatgaacacaaaacatagcagtactagatcggccaaaagaacatatcagaactacaaagcatatcttacatataacatcttgtccacttaggtggttaccgggtcccaccgaaaacaatcttcattatgtgaatgtagtgaaaaatgaaactatactttttgtctctattcaactatgtatgacaacaaatgtatgttctctggcagtaataaatttctgcagccaaagctgcttgcacactcgtcggctgcatgcccctcgtattgaaattataggcagggtcaattagaagattgtgggaagaattcccatttagctgtcagccatattattattctttgtgagttttaccttatataatgtacaattttcatgatttctgttccaagaaataaaattcagtataagtcagagagaatatggaaatgaaagaagtataaaacaaatatatcataataacaattttagtggataagttggtggagctgaagaagcatcgctgttttaacttttaagacaagcaaaaagatgattaagcgagtgagaaagaacactcacagaagcaaaatggttcacatctcgatggtgagcctcatcagcacgaatgactgttataacatctttcaatctggcatccttgggaagcctccaatagtctattgcaatggcaggggcaggaacattttcaattgcaccactttcaagatccttcaagtactcagtgtaagaatgtatagcctcctcctcaagatacccaactattctatgagctnnnttaagggagagtatgtaaagcacgaaaaacgcatgaagaaaactcccnnncagcaagaaccag

SEQ ID NO: 6341 - DNA, 406 bp, Glycine max
gtttgtattttctaagaagacaaagcaagccatctcaatcttgaatcctccatcagatctccctgcgaatgctgctgcccaagaaaacaacccaaacccaaaacgcacccacaacgcagaaaacggcgtcgtatgcaacccccaaatgaagtgcaagaaacatacctctgaccttagcagcaccgttggcgtctgcgcctcctgtctaagggaacgcctcatagccctcgtcgccgcccgagtcatctcacgcgcctccgacgaatattccagaaactcagaccctaaccctccgccaccgttaatcttccctcgctccgtttcgccctacgtctctcgccggaagcccgactacgccgccgcctggcacgacgaccgccgcgacaggctcttctacagcactcca

SEQ ID NO: 6342 - DNA, 388 bp, Glycine max
agcggaacagcgtgaaaatgctgatattgttacagatgaaagcaatgaaataaaaagaggaaattagtggctgtatgtttagtattgcagagcataactattgttgcaaggatagtgatttgtgagactgctttctgcgaaattatatattgacccaaagttctggaaatgcaggcaaaacaattaaatttgaaggcaagttgcttccatcactagcaaatgaagacaagtgcaaggttacttggtaaatcttaaatttcaacatttttgtttaacacccctatatgttacgtgttcaattaatgtatcatttttctgtccaatggcgatgattttgttatagttttcttgcaagacataactcaatagtctttccacgttgtgacaa

SEQ ID NO: 6343 - DNA, 391 bp, Glycine max
acacacataacacgtaacaaagagaatgagagcgctaaattcgcacgtgctcctcgtagatcttcactcccaccatcacgtgcccacctcaaccctctcctacctcagaaactcccgcttcatatcatccctccgtcgacgctccccaagaaccggaatccgatgtacggcgtcgccggagattcgccgcccctccgatcgcttctacggctcctcgccgtcgacgtcgcgcccggaggacctcaacctcttcctggaactgctccctctgaagatgcgaagggaactctatcgccaccgcgaaatcggaggcctcatagagattgtcatggatttgggaagaaaacctctcgccaggttcccttccggtgattgggtcatctctgaacaa

SEQ ID NO: 6344 - DNA, 377 bp, Glycine max
catatttaaaattgtctcagattttatagaggcttgaattcaattattacagacgttatataattaactcttcagtttgtaagagcagtttctgttgtaaaagttaaattttgattctgtgattggttcaaggtattttgaacgtagatcatattaattcactaatgttacatctaaggatcatatgagaactgatattagaattttgtgtagaacgttgtcattatcatccagttttttgttcttagtgtccgggggtacgtattcactgaataagtatgaaactaatatctcaatgtgtgatcaagcgctaaagtgaaggtccttcccaacaatttttttctttcagacgcgtgaatctcaacattgaactcaaa

SEQ ID NO: 6345 - DNA, 343 bp, Glycine max
gttcattctgtgccctcagttcaagtgaagccagcggagcagaaacaacctgcgggtgagtagaatgatataatatcctttatttgctgcacccctgtgcttgcggttatcaaagaagaaaggtatatagcttgagtgaagcatgtgaattggcatgggattttgaagtgcaagatggggtccctctcaaatggtgggggtaaaatgtcatgttgttatgttgatgatggaatgccgtatgtggaaaaagcaagcaagctggatggagtaggtcacggccaacgaagatagagatgatttggattcctcaattttggaagagaaatcgaccagaccattgata

SEQ ID NO: 6346 - DNA, 405 bp, Glycine max
aatttgtcatccatggattccaacggtgatgagtccttggccttcattttggagttgtctcacatatctccatcccaagaacaaatcttggccactgctccatttgtcggagcagaacaggacaccgccgcctccgcctcccatgacattgacatgctgtcgttgccggactccgtccccgaagacgtattccacacgccaccggaggagtcctcgcttccctcctcctcctccgacaaccattgcgtcgttaattacgccgtcgtcgacgtggatgatgtggatgctgggaccgatttggtgaaggattctgagttagggttttcggatgttcacatggaagaggttaacggagaggacatgggaaatttggaaacccttgttggggatgtgagcattagggtg

SEQ ID NO: 6347 - DNA, 371 bp, Glycine max
aatacatagagattgtcactgaggacaactttgatttctggtttatgggtgtcttaaaatatcagaaaactttcaaatatcttgagcaggcagtttctcaagcatagtagagatacttgagtagcaaaatccaccattcaaacttgaagattcatgttgtcaggacaaacacaaagatacaaaggacgatcagaaacaaactaaaatttggcggctctcatgaagatgttgagcttcgtctctgataaaagggatttcacttcattgtatatatccatcctactggacacaacatttgacctgtgataatagcgaatggatgtggttcatatcagttgaattgcagacttggctttcatcatatctcgttg

SEQ ID NO: 6348 - DNA, 399 bp, Glycine max
atggtaatgctgttgccattgctggtcttagtagccaaaatccaggaactatcactattgcaaatgctttgtttaaagctaatcctcctatttctcctgaggttctcaccaaagccttccaggtggacaagagcacaattgattatcttcaaaagcaatcttggtatgacaacaataactagatttgaaatatggacgattatttgacgctaattatggatatttgattacttcaatatgtcaatcaccgtaggcaattgacctacaaatagttattattgtaataagtaaaatgtctgtggtttgtatttctttaccgtgtagttgttctgttctgttttgtgtttgatatagttcaatatattgtttgagtttaatgaaagaatcatatgcctccct

SEQ ID NO: 6349 - DNA, 487 bp, Glycine max
tggtcttcgcgaacgcgctgctgcggcggcgcgtggtggtgggcgagctgggtctggtcccctgcgccgtgggcggcaccgccatgaaggagtgggcgcgtggggaggaactgtacgagaacatggtgaagagggccaaggaaagcgtgaaggagcgcgagaatagcagcgagatcaaagcggtgctgtggttccaaggtgaaagcgacgcgatcaacgaggaagacgctgcagcttacaaggtcaacatggagaccctcatccacaatgttcgtcaagacctcaatttgccatctcttcccatcattcaggttaatttcaaacatttctaccttccttcttctttgtttattatttgtgtagagtgtcttcttttgcaacattgtacgaatgaaataagcaaacttagagcttaattaagtctcaaatgtgatgatataattgtggaacgtgtaggttgcattagcctcagggtccgattacatag

SEQ ID NO: 6350 - DNA, 795 bp, Glycine max
atttacttgtttttctctagtattcatggtgctcgctggtaaacttagtactgaacttggggtgaaagcatccgctaccaaatggttcaacctcttaaccacgcaacttcaccatgttcagaacctttgtgaaagagtgcatgaaaccaagctgcatgatggtgatgactggcacggtgttggtaattcggttaaacactggacttatgtcataggtacgtaatcaattatgcttctaattcattaatatgctaacaaatattatttgataaaggttttgtttaaataaactaaatgaaaataaagaaatattaacaacatactttcgaacctattttctttaatttattgattaaaatttattaaaaatataaaattcttgtgagttttataacttatttaataattctctagttatcttataatttttaatcaataaaaagaaatgtattaattagcatatgttggttcacataggcttttagtcctctaggtcgtacttcagcaaaaaaagaaatcagagtgtgttagataatatattcattctttaaaataattaagtagtccttattttttttctataattctcatacacaaattttatgttatatataataaattgcttgtgaaataccagacggcaaggtacacacatgtcaggagagtattgaagccattgatgaagagaacaaaacaatcaaattcatgctcttcggtggagatattagtcagcactacaagagctttaagctgatctttgaagtgactgataagaacgatggcggtgctgctgtt

SEQ ID NO: 6351 - DNA, 484 bp, Glycine max
ggaggaattattctagcaagtgattacaacgaccacagttatttccatggtctcatgcatccctgctccctatcacattcacatacaaaagccatcgattcaaggtatagctatgcatgcacgttttaattgattttattcccaatattttccatggttttgcaatctaattaatctatatttgcaatatatatacctatctatcactaggcgccaacaatggtacttcaataatcatcaaccttttagaagaccaagttactttagcaacgaagttgtctcctcaactgccttacaaacgcaaggaagatcattatcttcaaaccaaattaacctaatggatgccaccagcattgcacccatgagaccaagccagtttcttgaagagaaaaagtggcctcccttagatattatgaacaaccatcactggaagaaaaggttgcctgccaatattacttctaatgctgggtcacaacctattgat

SEQ ID NO: 6352 - DNA, 359 bp, Glycine max
aaattctgtcacaccagcagcatctcctgaagattctactacttcacctgcagaatctcctgaagtcattatctcctcatccccaagtccattgttccagacacatctagaaagtcctacattctctccagtcattccttccactgaatttcctgcttctacttcacctctagcacaacattcatcagacttgtcagcttcatcaaccagtaaaggaaatctacaagcctatgtcgcagtagtgttaagctttctaatcatgcttatgtccttctaaggatgggaaaaatctcactcaaccgttgcttctaagtttattacatgtgaaaatttattttgctgctctctttctcagtttg

SEQ ID NO: 6353 - DNA, 338 bp, Glycine max
tttggaattatctgggaagggttttctctgggtttgtgtctgaacattttctacaaaagtacaagttccctcgtcctcttatgcttactttgactctgctcttatcatgtgttggtcaccttctgattgcctttgatgtgccaaatggcctttacgtggcttcggtgattattgggttttgttttggtgctcagtggcctttactttttgccatcatatccgagctttttggacttaaatattatgcaactttgtacaattttggaagcgtagcaagtccactgggactatatgtgcttaatgtgaagatgactgggtatctgtacgacaaagaagca

SEQ ID NO: 6354 - DNA, 407 bp, Glycine max
tcaagcctcaacctaatgcaaaagataaatgggtgtggctatgggaagggtcaggagaattctcagttcgctccgcatatcaggccagatttgatgatggtgttattcatgaagaagatcaggtatttcagcatgtgtggaaattaaaaattccaccgaaggccatgttctttatatggagattagttgttgatagattacctacttgtgataatctcattagaagaaatattatactgcctgatatatataatgattctcaaacgtatattaatctaaagttttcatagtctaaaaacgtagatacaagaattagaaaaattaataaagcaactaaagttttcatagtctaatttagtatattaatctaatctcgttcaaatgattctcaaacgtatgggttgtag

SEQ ID NO: 6355 - DNA, 485 bp, Glycine max
cttccaccctgactccgttgctcctttcgcttccagaggtcatgagtcctatcttgggtgagcattttacccattttcgattccgaatttaacagatactgtaaaatggtatttaggtctttggaatttgggaatgtacctcacttgcagtgtagtctcaatttaaatcatgtttatgtttcagtgtttgaattacttaaatgagaaaatttagatttagttcctttggtgatattttcctatcagaattggagggtcacttcaatattctgcataataagggtttgcgttaaaggtcagcatagggtacctaagtgaaatacaaattctattcgaagaacaacactaaaagtatctaaggaactgtatctaagtttggtacttattcatactcgtttacgttagtctttagtagaggtagcttaaggaataatgcaggacacatttgaataatttaagttctcttgttctgtaatttaaatcaa

SEQ ID NO: 6356 - DNA, 1212 bp, Glycine max
  misc_feature (16)..(17): n is a, c, g, or t
  misc_feature (1202)..(1203): n is a, c, g, or t
aacttcactaatccanntgtccagcaggttagttttgctttgtaagggttaacaatgagttgtttctgaatgcttttattgtaggacctcaatttccttatggatgatatttaaatataccatttagatagactcataaaagaaaagactacttttctcctcttcaaacttcagatctattgtccatgagagaatggtcccttgttcacattatttcaagatcttgttttttacataattctgccttgattgaatttgttgcctctttttcctttattttatatttgcgagggaggctagtatttttcatttgaaaatcctttctttccatgttgtccaaaggtttcaatcacttttcaggagtcaccaatcttattttatatgatctcacattaatagaagtgtgagcacaatctgaaactgaaaatgagaaatactttctggtcatacagacagaaactataaaatatgcaaattgttcgttcacttaagataccatggaactaggtagttggaaaagaatttgtgctcaagccaaattgtggtgtttagaaaacgatggataaagtgaatgatagagtggatgaccagaaacagcgattaatgcttctgaaagtgtatcaataaaaataatagccaacagatgttagactcactcatgtgattccatgaaagtaaactggacatgatgacaatgtgtaacttggtatgtgtttatgggaagcagatcactcggtcttgtgcaagattgtcataccattgagctatgccagatagttggatggttgaactaaactgaacttccttaaattataacgctttcccgtgaacttttattgtttatcacataatgcaatcatctctaaactatgatgttaataactgttggtgttattttttgttttgttgtggcagtttgcatccgggagcctagatggtcctatcagatattagaacaatactgcaattgtaaactagataacatatggattatggctggtcttggctactaccatggagtgtgcagataagaatgagcataaaattggttgcaacaaggattaacgggcttgtcaagttttggtattaaattccaatttgacttttacagaattggccgtcttcattggattagaagcccccggcaagggcagctttttttttctcctttttaagttagaggacagcttattgttactgannctaaattca

SEQ ID NO: 6357 - DNA, 565 bp, Glycine max
atcagagaaggtcttgatatgttcactaaactggctcaaaatattttccatcatggcttctctgcggatacggtgtcgcttctaaatattgaaaaaaacaaatactaaagagactcaggaatcaaaagaaccatagacagaaaagtaaagatagagaaggtaacgaaagaacctgtgcattggctcctgagaggttagtaagaatatgtcttttgaccgttttgtgaaattcattgtagtcactagtggcaaccatacatttatcagaagagagaatcttgagtgcattggatagcttccttgttgaaattgatgaaaatctggtgaccattgcctgatccaatatactaataagcaataaatgaaatagcaaaaagaagaagatgtagatttaattgaaaagagtagggagtgacctccttagcaaggtggggagagttgagaacaatgagagtggaagcaccggttcggatggaatagatgggcccatgtttgtgagtcatatgtgtgaaggtcttgtaaggtttcttctccttcaattgcagaagattccctatcactggta

SEQ ID NO: 6358 - DNA, 348 bp, Glycine max
ccttgattgtcttcctagtaatactcctatggatcctaatgtgaagcttctctcaggtcagggggaggcattggaagacccgggaagataatgttgtttggtgggcagacttaattacctcactgtcactagactagacataacttttgcagttggtgtgcttagtcaatttctgaaagacccgactgatagtcaatggaatgcaacaatccgcatacttcgatatatcaagaatgcaccgggtcctggattgctatatgaagacaaaggcaatggcaaagttgtttgttactttgatgctgattggccaggatcaccatcagacaagagctccacctctggatatat

SEQ ID NO: 6359 - DNA, 316 bp, Glycine max
tggaggagttgaggaagagggctgaagctgacaagaatgataagtctgtgaaggaccttgtgttgcttctctttgagactgcccttttgacttcaggtttcagccttgatgatcccaacacatttgcttcgaggattcacaggatgttgaagttgggtcttagcattgatgaggatgacaatggtggagacgatgttgatatgcccccattggaagaggacggtgctgaggagagcaagatggaggaagtggactaaatgccaaaggtctcgtgttaaatgaattgtggttcgtgtctgttaaatggtggtggatg

SEQ ID NO: 6360 - DNA, 401 bp, Glycine max
accactactataaacaccacaaactcctctcctctcttttcttgtatccacatctccaacggaagaaagaacatccaagaaatcataggaaaaaaaatgccaccttttgccggatccgaacctgttggattccctaagccagattccaacatagtttccattgacgttggtggccaactgttccaaaccacgaaacagacactaacctcggcgggtccgaaaaccttcttctccagaattgcggcggaatcttctggactccacacgcccttcctagacagagacccagatctgttctcgctccttctctctcttctcagaaccggtaaccttccctcaaaggccaaaactttcgatctccaagacctaactattgagtctaaattctacggcatcgaact

SEQ ID NO: 6361 - DNA, 323 bp, Glycine max
actcctgtttctctctcgatacggctgcatcgcaccgtagttgctgggagtacacatttaatacaggaagcacatgcttatctattgcaccagagctatgttctccagcatgtacgtgatggaaatggaatgaagttcgacttcgacaaattgttggatatgaaatcagccgttacggttggtctgtctacgattgtatcttgtgtaaactacgtagatttatttcttgaattacatttttgtgacatcatgatatttaaaaagttagcttaatacgcatcaagtgtctaatctcttttattagtccctccatgttgaacaca

SEQ ID NO: 6362 - DNA, 1387 bp, Glycine max
gcctcctcctgcttctgctgctataagctgggcggtgatgcatgcaatgttcacgcaaaggctttccaagatgtatgtagttctcaagttctgtgtttttggtagatactactaaggtcttgtttgtttactgttttcaaaaacagttttcaattttctaaaatttgtttgcacatttaaaagtggttgtctcttgactacatttttcttttctaaaagtttctccctcgagtacttgaacaaaacactagaggataccagaagaagaggatgagaaatatttcccagttgtttctggttttaaagtgttttagaaacaattttcaaaacttttaatagtttttggatgagaaattgattgttgagtattgtgaaatagatttaaaaaacagttttaaaaacaaaacaaaaaagtgaaagagaatcagacatgtcctaaatctgctaataactcagtattttagtatcagaagctgaactgaaacatacaaagatatctccccatatatgatgtaatatcattcactaaccctgtaagctatagcagcttgaacaggtgtgggagggacaacttatctttccatattggaataacagagtaacagattctcaagaaatgtagatatgatagttttcttgagaaaggagaatgtaggtatattgaactttgagaaaaccctttatttggtcttccaaggttacatgcatcaccccattagtctttacaaaactttagtcaccatagtcccccaaatattttaatcttttacccattagttcctctaagaagtaagaactaaaatatcgccattatttttctgggatgagtattaagctaataagctatatatatcattgtatggaatcatgctttgagtttctagctgaatttgttgatgttggctgactagaagcaattttttagcctccaaagtagtaattttctttatgatagccgccagtttcagtggtacaatgccctgctgttcataggctattgttagggggagcctctatatagaagtataatattgtccctcgacgctcctatataaaccaatctcgtcaaaattttattttctatgtacatattatgttatgttacgtgttttctaagataatattacttaatatgacgttcaattgcttgcagtgcctgaacagctatgagagtgacattagcaagtgccagttttacataaacatgctagcagagtgcagaagaaattctggagccacattgagtgcatgaacatgcttgcttcatttgctttgccttgcaatggtatagctttggagtttgcattggagtccagatgtgtctcatggttagaactacgttttttatgttactaagtattccacattgctaattaataaatcggtt

SEQ ID NO: 6363 - DNA, 547 bp, Glycine max
  misc_feature (184)..(185): n is a, c, g, or t
  misc_feature (213)..(215): n is a, c, g, or t
  misc_feature (246)..(250): n is a, c, g, or t
  misc_feature (254)..(262): n is a, c, g, or t
  misc_feature (267)..(268): n is a, c, g, or t
  misc_feature (280)..(281): n is a, c, g, or t
  misc_feature (289)..(290): n is a, c, g, or t
  misc_feature (311)..(316): n is a, c, g, or t
  misc_feature (327)..(329): n is a, c, g, or t
  misc_feature (351)..(361): n is a, c, g, or t
  misc_feature (367)..(369): n is a, c, g, or t
  misc_feature (375)..(389): n is a, c, g, or t
  misc_feature (404)..(406): n is a, c, g, or t
  misc_feature (411)..(415): n is a, c, g, or t
  misc_feature (418)..(420): n is a, c, g, or t
  misc_feature (423)..(437): n is a, c, g, or t
  misc_feature (441)..(446): n is a, c, g, or t
  misc_feature (450)..(453): n is a, c, g, or t
  misc_feature (460)..(468): n is a, c, g, or t
  misc_feature (470)..(472): n is a, c, g, or t
  misc_feature (474)..(477): n is a, c, g, or t
  misc_feature (482)..(483): n is a, c, g, or t
  misc_feature (486)..(488): n is a, c, g, or t
  misc_feature (490)..(491): n is a, c, g, or t
  misc_feature (493)..(497): n is a, c, g, or t
  misc_feature (499)..(503): n is a, c, g, or t
  misc_feature (518)..(518): n is a, c, g, or t
  misc_feature (523)..(526): n is a, c, g, or t
attcgtgtattcttcttctgctttggaacatggctgatagtattgttacctccagcaattcttctacgtcctcgctgaaccctactcggataatctgtcacgtatgtcagaagcagttttcccagtacacgtgtcctcgatgcaattcgcgatactgctccctccaatgttacaaagtaagtanntgcacttgtaattgcctatttgtgttgnnntgctcaatttgatatgtttttaattattggnnnnngctnnnnnnnnnttttnngtttactgttgnnaattttgnncattttcgtgttgcaatcctnnnnnnctcatattctnnngttgcctgaaaacttcatgacnnnnnnnnnnnttcaannncccccnnnnnnnnnnnnnnnttaacaccccctaannnctatnnnnnacnnnttnnnnnnnnnnnnnnnactnnnnnntatnnnngaaaacnnnnnnnnncnnntnnnntcctnngcnnntnncnnnnntnnnnnttccccttccctttntccannnnccttgcagctcgtatattttt

SEQ ID NO: 6364 - DNA, 919 bp, Glycine max
ggggctcttgggtttctgagattcgtcacccattattgtactctcatcaaactcatctcaccatacattttcaattatttatttgttccacttctcaaaaaaaaattagattagtaccatttccttttcttttcttttaaatactaatactatgcttttgtacacttttccccatgaaacttaccctcttatattagttaagcaaggttttaaattgtgaccacggtcaccatcggagtgcaaacaaatgtagacttaattgcagttgcaatacagttgtgagactctcaaaaccttgatgtcacagtcgaaattgtagttgtgaatcttttcttaaagtcaaatgttaatccgttttcttagaatattaattaaggaattaaaataaaaaaaaatatttttattatgtaaaattgagttattcataatattttttatgtttttctatgatttctataacaaatatatttgttaatttcttaaccatgtaggacattagttaaccagacactattaaaaccttgcaaggatctttgtagcatctgaattaatgtgcactgaatgtgagagtcttagtttgcaatttgtgatgtgttgaataggaaaaggagggtgtggcttgggacattcgagacagctgaggaagcagcaagagcatatgatgaggcagccattttgatgagtggaagaaatgcaaaaacaaacttcccagttggtgaaaaccaaatagtgggaaatcacagttcaaacacttcctcttcctccactacaacattgtctgcagttctgagtgcgaagctgagaaagtgttgcaagtccccttcaccttccctcacttgcctgaggcttgacactgagaattcccacattggtgtgtggcagaagcgagcggggcctcgttccgactcaaactgatcag

SEQ ID NO: 6365 - DNA, 664 bp, Glycine max
aaccagttttctagtttacatgaagaggtttcaataccacattgatcatacgagctcctaaatttcatgtttttaatgagcagggaagattttgctttttatgcggacctatgttttaaaacctttggtgacagagttaagtactgggtcacattcaatgagccgaatttcctagtgtcacttggttaccgttctggtttatatcctccatgccgttgctctggccaattagcaatggctaaatgcagtgaaggagactcagaaaaggagccctttgtagcagctcataatgttatcctgtcacatgcagctgcagttgatatctatagaaccaaataccaggtaatgtggatgaaaacttttttgaaaatccaattatttgatcaatttcaattttttaataaaatttgtacgttgtggatgaaacaatagactgagcaaaaaggaagtattggtatagtccttcaacatgaatggtttgaaccaatgagcaattcaacagctgacaaattggctagcgaaagagcaagagcattcaacttcaattggtatagttaatactagttctcccttaataatagcattttctattgttcactcaactccccctgagtaacactttattataatgcaggttcttggacccaatcatattcggaaagta

SEQ ID NO: 6366 - DNA, 449 bp, Glycine max
tttgttcgagaagcagactaaggggactcttggtgtggactgctctccttggatggactggtttcatggagggttgcagtttcaggtggagcaccatctgtttccaaggctgccacggtgccatttgaggaagattgcgcctttggttaaggatctttgcaagaaacataatcttccttataattgtgtgtcgttctggaaggccaatgtgctgacgattcagaccttgaggaatgctgctttgcaggccagagacggttccaatccggttccaaagaatttggtttgggaggctgttaacactcatggatgaatgggggacctgagtggagtttcgtgtgattttgctgtcattgatagtttgatggaggtgtggtggtacttggtaggtagggacgaaattttatgtagttacataggtgcttttggtggtgttctcctatcagaaa

SEQ ID NO: 6367 - DNA, 379 bp, Glycine max
ggggtttccaccgtttttccctttcaccattggcatctgcagcatcactcaattgcacaaacagaatggtcaacactttatggtctttttgtgtggtttgaactgtaaagtctctctctttctctcactcacttttttctctctctatgttgcattcttttgtgtggcttagtctctggctgtgtctttcagtgttagattcttggtgggtttagtttaattttgactgaacgaatgagatcttgatgagggttggaaccagtttccttgcactgctctcattgttgccattgcttctttctccgcaattttcaagtgctcagcttccacctgacactggcatctcatcacgcacccttgatgccattctccaagattg

SEQ ID NO: 6368 - DNA, 435 bp, Glycine max
gtttccatccttctgaaatgagcaactttgagctatttggctcttttccaacctgaaaagaatacgactagagtggatttttgttccttcctttgttgcaatgaagaatcttaaaaagttatccctctacacgtgtaatatgaagcaggcatttgaaaacaatcacatgctaattccaaacgcttttccgaatcttgaagagttaaacattgaccattgcaaagatatggtggcattgcctaaggggctctgtgatatcacctccttgaagaagctcagcattactaattgccacaaactctctgcactgccgcaagaaattggaaatttgatgaatttggaactcctaagcctcagttgctgtactgatttggaaggtataccagcttctattggaaggctttcaaatctacgacttatggacatctcaaattg

SEQ ID NO: 6369 - DNA, 399 bp, Glycine max
cccctttcttctctctcctttcttcacccacatgagatgtgccttccttttccaacttgtgtactcttcttcttctccttcttcttgttgttgtccacctctctggaagagatgccccatcacttctaccacttctcttacttcttgatgcctagtatcatcattgtctagtttttactgtgttttttttttttgggttgttgttgtctctctctttttttatggatcttggggtggtgggtttggagggggtggtgggttcagaaagtggttgtgtgtttggttcttctcttgcttcagatcctgagacaaagcacaagtggtacggatctggtttgctcaagcaagagagatctgccatagctactgaagatgatgagtggaaaatttccaaagttg

SEQ ID NO: 6370 - DNA, 1170 bp, Glycine max
aaagccccaaggtgatgaataattacttaagagtgtttgatagagtgaaatgatataaataaaatttttaaattataataaagtgtaaaattgtgaattttacttcattttattgcttatttcacttatttttcgtcttttttcaatgcaaacatatgggagcttaaagtcttattatggtttttcaccactttgggtcttctaattttgatctgttttcaattactttttaacaatatgtagtatctggtgttttcttgttctgactctcgagtgagtgccactactatcctcaacttccaacctggagaagctttcatggtacgcaacattgctaacatggtccctccatttaatcaggttagttctctccttcacataaatgcttcatccacaccatggattattatttggatatgatgaattaacatcacgcaaacactttttcttatcacgtttttttatttccaaattcatatataagttcaatacttctattaatttatgaatggacccacatatttagtaagattcaagatttatttaataaaagaaaacgtgttaaaaaatattcaaatatgtattattaacgtttctcttaccattttactttatatgcgtttcctcaagtttttgttgaaattcttttcttcatcaattctacagctaaggtacagtggagttggtgcagccattgagtatgctatcacggctcttaaggtgatgatttttctcttgtttttttgtctaacttttaaggtgatggttagtttgtattcataaagttaccgtagtttttccaaggaccaattactttattttcttttctttcattttgatttttaatacataaaggaatattctgtgagaggtaaatatataagacaaaccaaataataatttaacaggtgccaaacatcctggtcattggacatagtcgctgtggtggaatccaaaggcttatgagtcatccagaggatggttcttctcccttgtaaggattaatttttatataacaataataatatatatagctagctttactatatattatagctccttgtttggcaaacaagagtaaaaaaaaatatatataataaatgtaggattaaacccttttatatggttcaattgaactgtgcagtgacttcatagatgattggggaaaat

SEQ ID NO: 6371 - DNA, 409 bp, Glycine max
gatcgtagcactgggggatttgatttaaataaatttgatgagactcctgaaattggtactttcttgataagcaaactggatattccttctttaccaagtaagccttcgttgtccagtgggttatctaatggcggaagtgtctcaagagactttgacttaaataatggaccaggccttgatgaagttgggagtgaagtcccaacacgtagtcagccaatgaaaagtactgtaccatttccaactgctgttcatggcacgagagcaaacaatgctgaatttgggaattattctgcatggtttcctcctggcaatacttattctgcaattactgtcccaccacttctgtccggcagaggggagcagagttatgttgctggtgctggggcgcaacgtataatgggtcctacag

SEQ ID NO: 6372 - DNA, 329 bp, Glycine max
cgtgggggagccgggatctgtctatgatctggtgctcagcgtgccatccacggtccacgtcaccgtcaaccctagaaggcttcagtttcgacaactaggggaaagccaaacctacacggtcacgtttctctctaataggactcttaatgattccgttacttctgattttggtactattatgtggaccaatcaactacaccaagttaggaccccgcttgcttttacatggacatatttttgactttgttattcgttggagtacactatattatttaaagcctaacggtaatagtctatagactagagtgcagaaaaaaaaaaaaaaaaaa

SEQ ID NO: 6373 - DNA, 803 bp, Glycine max
  misc_feature (718)..(729): n is a, c, g, or t
  misc_feature (734)..(737): n is a, c, g, or t
  misc_feature (739)..(739): n is a, c, g, or t
  misc_feature (741)..(743): n is a, c, g, or t
  misc_feature (745)..(747): n is a, c, g, or t
  misc_feature (761)..(765): n is a, c, g, or t
  misc_feature (777)..(783): n is a, c, g, or t
  misc_feature (785)..(791): n is a, c, g, or t
ggttttgaagctgtaaatgtgtgttcatcaatccaccccttgtaaacataaccaaatcccccttcaccaagaagactgtccgggcgaaagttcctggtggcattctttagctcattgaaggtaaaggccttaagatttggggaagacaagatttcgccctcagaccttggtgttggaagatttgagaaatcacttgcttcactatatgacagaatagataagttggaaggaacagatgaaggactagtttttgaaattcctgatgcagcgagaagaggaaaacagttagttcatatatgctagcattttcacaaacaaaagcaggaacttgccaatataaccttaaaactcaaccaactacactcataacccatttaggaaaattctgaacaaatactttatatgttataacaaaacttttcattatcacttattaggactgctatgcttttcagtttttcctcctcttttcacatgtaaaaggactaaaacaaaagggccaaagtgttacttagtttagttatagtccaaactcgagcattgtataagttttaactagattcggttaactacaagatcccatggattgaatcctagcaagcttgcagcatccaaaaacaacgagacaagaaaccttaaaaaacccacaaagaattcccaatctacaacaccatcaaacccacagctttgaaatctatattgaaaaaaaaaaggaatnnnnnnnnnnnncaaannnnancnnncnnntaggaaaatcaaannnnncccttcaaaaannnnnnnannnnnnnttttaaaaaatt

SEQ ID NO: 6374 - DNA, 368 bp, Glycine max
tgactctctatgcacctgatgctggcacccaagagcatgtagttactgctctcctgaacttgtctatcaatgtggataataaagagcgcatcatggcttcagaggctgtgccaggcatccttcatgtgctagaaaatggtagtatggaagctcaggaaaatgcagcagccacctttttcagcctctctggggtggatgagaacagagtggcaattggtgcgtctggagcaatcccagcattagttactctattttgtgagggaagtcaaagagggaaggtggatgccgcaaaagcactattcaatctgtgtttatcccaagggaacaaaggacgagcaattagggctggtattgtccctaagttgata

SEQ ID NO: 6375 - DNA, 244 bp, Glycine max
ttccttgttcttgaagtgataagtcaacaatgtgatagaattggacttcgttatgaaagcaacatcgaacacaatcaatcaatcatgtagggaaacaaactttcaaaatcactcttcatgaatgactaaatcttcaaagtaaataattagaaaataataaatttaattttcagatattaaagtaataaccttatcatgggagtacgcatgtatgatgcaaattattgttgtaaatatagctcaa

SEQ ID NO: 6376 - DNA, 376 bp, Glycine max
atttgattgaaaaatgagagctacaagtttactgggaaaattaaccacatggtatttgttttaggttcacaagaagggcattgcacttggtagatcagtggaccttacaaagtacagtggctatgatgaattagttgctgaattggatcagctgtttgaatttgggggtgaattattgtcaactaaaaaagattggcttatcgtctatactgataatgagggtgatatgatgcttgtaggcgatgatccatggcagtaaggatctgtattttaattatacatccttggttaactttctatttaaatatcttacttttccttgagaatgggacataatttatataattctatattttcaattcagggaattctgtgc

SEQ ID NO: 6377 - DNA, 456 bp, Glycine max
  misc_feature (398)..(400): n is a, c, g, or t
  misc_feature (410)..(410): n is a, c, g, or t
acagtttgctgcacaaggttctcatggtcaaaatggtcattcatatatagagggaaccgattttaacactcatcataaccaaagctcatctaacctgccagttctgaagaatggagctacgctacatgttaaaaaatctcaggcgtctaaggagagagggttacaagggagcacaataagcagtcctagtgaaatggcacagggaatcagagcagggaaaatagctgaaggaaatgatgcacattctctttctcttcaagctgttgaaactagacagcaaacacaagtcatcaaagttgtaccacataaccggaaatcagcgacggaatcagcagctagaatttttcaatccattcaagaagagagaaaacaacatgatttagtctagtgctgtttannnaggtggaatnctctttctttttccttcttaaatccatccaatgagcctattgatat

SEQ ID NO: 6378 - DNA, 409 bp, Glycine max
ggttttatgatattttcaggggagacttttaccaagaaaatgagtttcctggtgaaggatatgggttggccatcagaagctattgctgaatatcctcaagttgtagcgtacagcttggagaagagaattatccctagattctcagtaatcaaaatcttgaaatcaaaaggtgtgcttgagaaaaacatgtacattagttccattatttgcataaccgaggaaaagtttttggagaaatttgtcgtcaattttcagaatgttttgcctttcttaccagatgtttacagaggtgtgatcaatccttcaaatgtattgtagtctttgaatgtttttatggatatggttctaagttccaacttttttttatttcaatactaaattgaagcttgagtttagccttctttccggt

SEQ ID NO: 6379 - DNA, 645 bp, Glycine max
  misc_feature (363)..(363): n is a, c, g, or t
  misc_feature (439)..(439): n is a, c, g, or t
  misc_feature (441)..(444): n is a, c, g, or t
  misc_feature (447)..(452): n is a, c, g, or t
  misc_feature (454)..(454): n is a, c, g, or t
  misc_feature (456)..(458): n is a, c, g, or t
  misc_feature (461)..(463): n is a, c, g, or t
  misc_feature (496)..(496): n is a, c, g, or t
  misc_feature (579)..(581): n is a, c, g, or t
  misc_feature (584)..(585): n is a, c, g, or t
  misc_feature (594)..(601): n is a, c, g, or t
  misc_feature (611)..(616): n is a, c, g, or t
  misc_feature (618)..(620): n is a, c, g, or t
  misc_feature (623)..(629): n is a, c, g, or t
  misc_feature (631)..(632): n is a, c, g, or t
gttgatgttgtcggtgatgtccttcaacggaggggtgtttgtggccatcgtcgtgggtctcgctgttggttacttcttcttcaggaacgagggcgaagattcccttgttgttgatacttcttgtgcctgtgcttaaatcctaattacttttaaatctcccaatttcctgtaataataatataataggagtagcagtgcttgttaattattttcctttttttaatttagcaaacttgtttcaaggaatttgggatgtgtaatttcgtgtacgaaattgtatttaattgtaattgtaataatcaagtcaagatagtagtacaattggaatccttcttgattctaaagctggaatcaagaaggatngattttgtttgtactactatcttgacttgattattacaattacaattaaatacaatttcgtacacgaaattaccancnnnnttnnnnnnancnnnttnnnaaatttaaaaaaaggaaaataattaacaagcangctactctattatattattattacaggaaattgggagatttaaaagtaattaggatttaagcacaggcacaagaagtatcaannncannggaatcttnnnnnnnnaaaaaaaaannnnnngnnnccnnnnnnntnncccaaaacccccc

SEQ ID NO: 6380 - DNA, 458 bp, Glycine max
attcttactgttgatgatttagttaaattagatcaaaaaccaaaaggaatatggttgaatattcaggtaaatagaatgaatgcataatccattctcatgattcagtctccttgtttgttttaaaactaactcttgttttctcttatattttaaagcatgatgcattctacgcacaacacaatttgagtatgagaagctttgtgctttcagtttctagaagcgtagttttcagttatatctcatcacctgaggttggttttctgagaagtatagcatcacgtttcaacccaaaaacaacaaaattggtcttcaggtttatgagacagagtgacgtagatccatcaaccaatcagacttatggttcgcttttaaaaaatctaacatttatcaagacatttgcttctggaattcttgttccaaagggatacatatggcccgtagatgcaactctttatcta

SEQ ID NO: 6381 - DNA, 401 bp, Glycine max
ccttcaataaattaaattttctacattgatccactcataaaaggatgatgccaaaaaaatttggttggagctagctctgaggagttaaattaatcttatatggacgattattaatttattataattcgaagttgttacaagtgatcatatatctaccctttacccaattatccatcacgtgtgacataatatggtttgaatttcttataagaaacatgaaccatactcacaaatactaattgaatgacatcagatatcataatcgattaattagtccaaatattcatctttactttctagtatatgctcaagatcagtttcttgttttgaaagaaatgatcattaagcactatgaattgttgccgatgaattaatattttaccttggcatgttctagatgg

SEQ ID NO: 6382 - DNA, 418 bp, Glycine max
atttttgatgccactaatgacagaggatcagattcagatagctcctatgagaatgcagatttgagtcgttctaaaagaaaaaaggccaagaaacgggggaagtcccgttccaaaggagatgacagctcagagtgggcttcaacagagcttttggagtttgttatgcacatgagaaatggagacaaatctgttttatctcagtttgatgtgcatactcttttgctagagtatattaaaagaaataagcttcgagatcctcgccgaaaaagtcagattatttgtgatgcaagacttcaaaatctgtttggaaaaccaaaagtgggacattttgaaacgttaaagcttcttgaatcccatttccttctaaaagatgattctcaggctgaagatctgcagggaagtgttgttgacactgaaa

SEQ ID NO: 6383 - DNA, 304 bp, Glycine max
gatcctttcttagatttaagtcttgaaatattcaaggcagactcattgcaaaaagcactttcaaattttacggctgcagaatggttggatggaggggagaaggagtaccattgtcaacggtgcaaacagaaagttaaggctctcaaacagctaacaattcataaggcaccttatgtgctaacgatccacttaaagcggtttcacgcccatgatcctggacaaaagattaaaaagaaggttcaatttggctgtgcactggacttgaaaccttttgtcagtggctcgtatgtaagtaaataagtaa

SEQ ID NO: 6384 - DNA, 361 bp, Glycine max
ttgcttgtctagtttgtcctatattcttacttgaacatttgctgttggtggtttgttgctttggattcttatgcttccaggtgtttgatctggtgaatcgagaagcatttaacacagttgcaggtgtcagtgtgactggaatacgggaaaattatttacaattaagcttaggtcaagaaacctctgtgtacttaacacttgtgtccaatagtcaagatcattctacagttgaaggtgaactcaccgataacgcagaaaatgcaattttacctctggaatcatctgatggaatgaagcgtgaagccaaacagaacacctctaacaaagggcagttttctaattccatctgctatgagattta

SEQ ID NO: 6385 - DNA, 721 bp, Glycine max
gatagcattgtgggagcaaaaaagtggtcaaaattttcgcaaggattttgttgctgaggaagagattgtcaacctatcacagagtaagacattttattgagtatatattttagcttctatttacttgatacaaaacatggaaacttcgagttttcattattagattatttccttcatattattttagtttaattgatattgtcatgaattgacaatattaaaaagctttatattatcatctaacaataattcattattgatataatttttaagatgattattataaaaatcaacaaatatatcatacatacatgataattaatgatggaatgcatgatggtgtaaaacatatcttgcactgttaatatatatatttttttctcattttcttatgttaacattgacaaatcaaatcagccttgattaatcgtaactttttcaatgtttttgtagccttaccccctccacacaatattcccgtttctatccttcatagtgtatttgttagaggggacctcgtgaggttcgagataggagaagatgaccttgaagcttcacagctatatcctgattataactacacatccattgatgaacttcttgatatatttcttgttgatcctccagcccctgcctctgctgcttttgagtgaagacattttaccctgcacttgttggttataaattgtaataaagtaggtgatcctcccgattaccgtga

SEQ ID NO: 6386 - DNA, 206 bp, Glycine max
catgagaaaatgagacttacgtagttttttttatagaaaaagagcttgtgtgtcgagttaattattttattattattattattattattattattattttggaaagattttgattttgtggtaaactttgtgaattcaagcaagtcgaagaccaagcatgacattcacaaaatttactcacactttattgaaacactgccaagcaa

SEQ ID NO: 6387 - DNA, 936 bp, Glycine max
ttgttgatttcccattaatgatctggacttatcaacatatgtagcccacgggaatagccagtcttccaaccgctatgtgttatatgcaattagttgtcattatggagggttaggaggaggtcactatacagcatttgtccgtgtaagtacctcacaatttgtaatgtctcttgctctgttaaaacattagaatgcattcttctcaattttttttataatattaggggttaattatttatccatagaaaaactaagcttgattggtttgagaagacatttgtttgtttttatgttctgtttttactaataattacctaaatttcctttttctactatttttaattcaaatatttaaactcagggcgtaaagtgtttgtgattatcactaaaaagtaaaaaatgaaatatgttagatattaaggggtcagtggcaaacaatgttatgatatgcgaggccagtgggaagtaagagagctttgacagactaacggagagggtgaaatatgtttttgtagtttagtttttagtagtttgttcccgaggatgctatggcacataagttttccatataatattagttttaatttgacatccttattgatttatgtatttttttagttgatacaatcttagtgtttttcgggttatttgctttaactaaatctcttgatacaatattatattcgttataattacgcttattcaacttttttttccccttgcagtatggctatgataaatggtatgattttgatgacagcagggtcgaatctgttagtgaggacatgataaagactcctgctgcctatgttcttttctacaggaaaatttagatgaaaattttagatgcaattgtgtaattagtgatagcagcatgggatgcttgaggcttttcagaccttttgcctatacatacaattgtctgatttcctcaaa

SEQ ID NO: 6388 - DNA, 383 bp, Glycine max
ataagcaacttaacacagaattgcatatatgggaaacacttgtgcaccaactcaatacgcaagcaaaggcggaaaccatagttggcaatccacggtgaacatagttcacttagatggaaagttgcaacaattgaaggagtcaattaaggcatggaaagtgttgtctgagaacccaaactgctacatatgctgctcagaatccatgtatgttgggtcaccgatgcctcctttggctccaagtgaagagcttcaattgggtctcatatacttccttgttccaattcccaaatcaagaatcccactctctcttcaggacttgggggcactagccatcaaggctaatgcagctcttgctgctgctgcaacacctaataacaactacc

SEQ ID NO: 6389 - DNA, 264 bp, Glycine max
gatgactgcagaagacacccgagtcaaccggcaaaagaaagatttctcaacaagttacaaaagcaggctccaccttggggttgaaagatcttttcttgctcagaagggtccctcacatttcaaaggcttcctcaaatcgcaccaagtgctcttctgtttttgtactttctgcctttgtaatggtctcattagtggtctttactgacatttggggatatcttaaattttaaactgctaggagatcattcctttgttttttttttt

SEQ ID NO: 6390 - DNA, 360 bp, Glycine max
ctgattcagaaagccattagccagacatttcagagcaccgcacatttgggcaaccttttaccaactggcacagtccttgctttccaacttctgtccccaatcttcacaaatgttggcaactgtgactctgtcagcaaggccatgactgctgcacttgtatctctctgtggtgcctcatgcttcatgtcatgtttaactgatagcttccgagacagcaaggggagcatctgttatgggtttgccaccctcaggggcttgtgggtcattgatggatcaaccacccttccacctcaacttgccgcaaaatatcgcctaaagttaatagatttcatgcatgcagtgatgtcaggtttggtataa

SEQ ID NO: 6391 - DNA, 402 bp, Glycine max
accaaaggctaatacaagaatcagatcttcccaaccttccatacctacaagccatagtcaaagaaacactaaggattcaccctacagcgccactgctagggagagaatcatcagaaagctgcaatgtatgtggctatgacattccagcaaagtccttagtgtttgttaatctgtggtctatgggaagggaccccaaaatttgggaggaccctcttgagttcaagccagagaggtttatgaacaataatgaagacaaacaaattgatgtgaggggacagaatttccagctattgccatttgggactgggagaaggttgtgccctggtgcatcacttgcacttcagactgtgcctactaacgttgctgctatgattcaatgctttgaatttagggttgatggga

SEQ ID NO: 6392 - DNA, 693 bp, Glycine max
  misc_feature (638)..(638): n is a, c, g, or t
tttgggaatgctacagctgatgatggggaatatgctcgtatgctggctataatggatgaacttgaaaaagaagagcttgctgcagaaagtggcaatcacagtgatcaaaatgatgaaagtactggggatttccatgatatatcatatcaggaacatattgataacaaactccaaaattcaaaagtaatatctttgattattttgttgaaatctggtttagaggctatgagcacaatggactgtgatcgtctcataactcattttctatgactgctcaaacaggatgttcatcaaagtgaactactggaccagattaataataaaattataacagctgatcttccaaaaaaacagaatcgtaaagaagatataactgatcagttgaatgtaagatatcttcctttatcatagttcagcattaaagttgtttagtatgctatgtaactaagtagctaaacattcatgcttttgcattctaattttcaaaatgcagtttgctagcctggcagtagaatctagggtcaaaggttagtcctcaacaacttacatttcatttctttgtgtctgctcgttttgtagttatgactgttttgtatccattctaaaattaatttttccattgggtatgaactatcagngagggaaaattttgtagaatacattgatcctagtgaaaagattcctgctcgttct

SEQ ID NO: 6393 - DNA, 759 bp, Glycine max
  misc_feature (713)..(713): n is a, c, g, or t
tgccctcaaattgcttcgctgcttcaggttcgaatttggttggaaaccctcttaaaattgtattgtgatcacgaatttcattttaccttacatagaaaagcgttgattttttattgacccttttgtgttgttctcaatttggtgcaaaaaggtgcgggatttgtgtgccttaggttgttgttcgaggttctggagggaactctgcttctcagattgcatttgggagtctcttgtcagaaacagatggcccttactctcttccttccatttcccttcttcttccactcattctcccaatttcaaggtatcctccactgattctcctctattggaggaacaccctatttgtttttcaaccttgtttatacaaagttttgtacttttctttattggtttctgaattgggactctgggtaatcatcgtctaagccctaaattcttttttctttaatattcaattttttttaacctttgtaggaaagaacttggtcccctgttattaaattgagtaaatactaaatagtacatacacaagcaaggtaaaaaaaaaaaatattcttgcaaccaattaaaaattgccccggagggaaatttgattaaaatttgcattaattacctttaaaatcctcccttggataatttttaattggttaaaaaaggaaaacccctttaactggcccttaatggaaattaaactggtttaaattttggtnaattgggggccctggtttggtgggtggatggaaaaaaaaaaaattt

SEQ ID NO: 6394 - DNA, 554 bp, Glycine max
  misc_feature (8)..(8): n is a, c, g, or t
cttgtganacagtcaaatgcccttggtgtaatgtgcttacgcccatattgtatagcctatatctatgagtcaaccatttcatcttgcaactcgctcggggcaacaagtcctggaatagaaagcattctttgtctttccctctctctctgagctgcagcctcttcagcataaagatctttgttatcctgcagtagagggggacaattaacaaaccataggtgctgaaatacactaaaaatataaattccaacacatcatgctacgtttgtaatgtcaaataatctacagaacaaagcaaaccaaagtagtcagcagtcatgaatacataggactacattcaggaattagaataccaggcatgttgtggaatcaacaaagctactttttgaacactgatttttcaggtcattgaccaaagtatgagtgctttgagcgagaagtaaaggattttttcagataatataagctgtttttttaataggaaatacttttcaacaaagaaagtttaagagaagccaaactggcacaaggttctaaaaggcaaaaaaaaaaaa

SEQ ID NO: 6395 - DNA, 354 bp, Glycine max
atcctcagtcgtcactggtgacattctgtgatccgacgggtggcatcacagccgcgtggcgaaggaggaatattccttcatcgttccaatccaattcttagtggtggagattcctttgtttgatctcatttcattccttttttatggattattatcattcgcaatctctccatggctgatgtttttttattttaaatttcatccttagatttaggatttgatttagctccactcttatctctttggttgaatcatgtttggatctgaggtattcgtttacctttatttgttttgtttggtttccgagaaaattgaagcgaactgcaaacagatttacctcatctggatttggat

SEQ ID NO: 6396 - DNA, 901 bp, Glycine max
ttaatttttcactcaatggttcttccctcaggttttgtttccatgttgatactttttggcatggttttggtagttggggtgaatattgtcccaggggttgaggcaaaggcaagggctttctttgtatttggagactcactggttgacagtggtaacaacaattacttagcgaccactgcacgggctgattcccctccttatggcattgactatccaactcgtagaccaaccggtcgtttctccaacggtctcaacattcccgatcttatcagttaagtatcatcattttcttttcttttctcgcattcgttgcttcacattaatcattacttcattatgttaactttgctttagtttatgtcaaactttgcagtattaaataatagaatatgtgtattttaaaatagaataatcactacctaagacaaaaatgtctcatagtaacattatttatatgctattttttaattttaaggaataattaataattttaaggttctatttttatcacgacctaacttatgtttgggctggcctgcattttcgcgttttcatgtcctgtgctaacaattagctggtgtgtttagtttagtttggtttagagaaataaaatcgtacgtagtttttcgatcttactgaagcttttttgaaaaaaagaatcgtactaaagcttttgaagagaatagtctgtttccctaaaagtaagtgttactaaacatgcacatgcacttacgtggtaatttttttaacgtaagtagctagagcgtacgtagatagctgtaaatgtgtatatctaattagttaattaacctgtttttattgattatcaggtgaacgaatgggtggtgagtccgtgttgccttatttgagtccacaactaaaaagtgaaaatcttctgaat

SEQ ID NO: 6397 - DNA, 454 bp, Glycine max
  misc_feature (449)..(449): n is a, c, g, or t
tgctcatgggataaaatggaatgcccttcaagttggatatccacaaacacatagatcttgtattctttgtagtatatttaataggacattgagttatccactcacccaccacaacacattgtttctatcaattttatagcttcaaatttttggtgcaaactgacatgagttgctgctgtgagttcaacggctgtaatcaaggagccaaggttttggctgtcatttttgacttggatggcacccttttggacacaggtattctcccttgttcctgttgttctcttcaactatggtgttggttaaattttgtttcttttgggttctttctgaaccatgtgtgtgttggtgattggtgtgcagaaagggcaacaaggggtgtgttgaatgagtttttggcaaggtatgggaaagaacttgatagggagaaggaagagaagaagaggagaaanaagag

SEQ ID NO: 6398 - DNA, 647 bp, Glycine max
tccttgccttctacaaattctaatgcaattcaagaaccagttgctagagacattcatgggacctcagctaagttggaagagccgaaggaatccgagtgcaaagttcagactgatctggagctagattctgcaaagggttccgaaattgaacttgctaagtcggggaaacctatagatttagtggaagaggaagatgcatgcccaatctgtttagaaggtgatgttttcttagctttttatataatttctttagctgatggtattaattaagccatttattatgtaacggttattttgtttttggttaaagttgagaactgatgatggatgtatatctttttatcctggcagaatatgatgcagagaatccaaaactcgcaacaaattgtgaccatcattttcaccttgcatgcattctggaatggatggaaagaagtgaaacttgccctgtgtgcgatcaggtttcccccaatcattaccaatttctcatctacctttagatctgtgtgaagatacccttttgaatatgacacttaaagcaattctttgtttaacgcaggatttggttttcgaccctcccattgaataatacatcaacgtaggagttcaaatatactgtgtagtgtttgagaagcgaggttacaaag

SEQ ID NO: 6399 - DNA, 318 bp, Glycine max
gatcatcatcaggaggaaaaggagaatgaagaaaacaagggaagccacatggtgtttgaggttgatcggggtttggatagaaaagatgaggaggtagagaagagttgtgattgttctgtgtgtgatgctagcgtggagattctgtgtgatgaaatttgcaatttggatttgggtgtggagaaagggaaagaaacaattgaagaggaaagtttgaatgtccctaagcctaaggataatgatggtgatgatgttgttgctgctgctgatgatgaagatcaagcttgtgagaaatccactgctcaagttgattgcactaga

SEQ ID NO: 6400 - DNA, 724 bp, Glycine max
  misc_feature (10)..(10): n is a, c, g, or t
gttagttaanttggaatacattctttttaaagcagccctcataatcacccaaggcatcagtaacaatttcagccaaagataagatttattggaaatgtggagcaaacactgctaagacttccttgtagacaggtttcttgaaatccactgcctgcacaaagaagacaaaccaagtcatatattgtacagtaccccatcttaattggctttggacaagtatgaaaaaagttgtcatcatcacgtatacttacaagctcaattacttgttcaggtgatatccatgaccattccccaaactcagctttctcagtaccatcacccaaaagattaatttcttgatcttgcccagtgaacttaaaaagaaacctgtgtgtgtatatcaaaagtgtcaaaaacactacttaaagccaaaacaaaatatcccttcttccatgccttccaattctgatgccttgtcccctgcacttatccatagttgaacacacaactatacaagtatgcatataggcataactctagagcctcatcattgaataggagggtaaaaaaaatgtcaaaaatatttattgccccacaaattgttatatgattggttctaggttgttaaactttatataatatggttgtgtacagttcttatgagttgtattctatccagacagagcatattcaagtggttaccatttctgcgcctgacccttccaatcagatccccactgaatat

SEQ ID NO: 6401 - DNA, 407 bp, Glycine max
tgtgggcatcttgtgtgttgccaagggtgtgccatatcagttgaacgtgaagttgcacccaaatgtcctgtttgtcgtcaggagattcgagattcagtgcggacttatgaatcttgaacagacacagactgatttttctgttcactctgcggcaggaaacttttatgactgctattgagaagagtgtttgttttttactatttctataagatctggaatatggagttttagggaaaacttgcctctgctcttgtttcctgtgaacttattactttatctggtgtagatatttgaacttggtttagataggttggtcgaggttaattcgtagtctcctcacttctcactctgcaaggtcttttggggaaccttgtaggattttccaattatcccagttgctgtgtaca

SEQ ID NO: 6402 - DNA, 416 bp, Glycine max
ttttccatctctaacaatatgctaccagaaggagcataatgtgaatcttgtctttgagcgttttcatgtcaatagatgcacatggagacacatttacttatttgataatacataaatgttgtactattttatatttgataatgtgtagatgttatgctattttatctatccattcagttataaatagcttaagctgtgttattctcaaattaacgcattattcattatcaaaaaggttcctctctctttggcaataaggatagcatccctcaaagggacattgcggttgcagataaagccacctccgtctgatcaattgtggtttggtttcacatttatgcctgatatagacttcagcttggaatcatttgttggagaacacaagataactaattcacacatagctttgttcctgg

SEQ ID NO: 6403 - DNA, 1233 bp, Glycine max
  misc_feature (447)..(447): n is a, c, g, or t
  misc_feature (462)..(462): n is a, c, g, or t
  misc_feature (529)..(531): n is a, c, g, or t
  misc_feature (546)..(548): n is a, c, g, or t
  misc_feature (551)..(551): n is a, c, g, or t
  misc_feature (555)..(555): n is a, c, g, or t
  misc_feature (567)..(569): n is a, c, g, or t
  misc_feature (576)..(577): n is a, c, g, or t
  misc_feature (581)..(585): n is a, c, g, or t
  misc_feature (588)..(590): n is a, c, g, or t
  misc_feature (596)..(600): n is a, c, g, or t
  misc_feature (618)..(634): n is a, c, g, or t
  misc_feature (636)..(636): n is a, c, g, or t
  misc_feature (639)..(641): n is a, c, g, or t
  misc_feature (643)..(655): n is a, c, g, or t
  misc_feature (657)..(657): n is a, c, g, or t
  misc_feature (660)..(674): n is a, c, g, or t
  misc_feature (679)..(691): n is a, c, g, or t
  misc_feature (694)..(699): n is a, c, g, or t
  misc_feature (702)..(704): n is a, c, g, or t
  misc_feature (708)..(712): n is a, c, g, or t
  misc_feature (714)..(714): n is a, c, g, or t
  misc_feature (716)..(720): n is a, c, g, or t
  misc_feature (722)..(728): n is a, c, g, or t
  misc_feature (731)..(731): n is a, c, g, or t
  misc_feature (734)..(752): n is a, c, g, or t
  misc_feature (754)..(759): n is a, c, g, or t
  misc_feature (762)..(771): n is a, c, g, or t
  misc_feature (776)..(780): n is a, c, g, or t
  misc_feature (782)..(798): n is a, c, g, or t
  misc_feature (802)..(802): n is a, c, g, or t
  misc_feature (804)..(817): n is a, c, g, or t
  misc_feature (819)..(829): n is a, c, g, or t
  misc_feature (834)..(834): n is a, c, g, or t
  misc_feature (836)..(843): n is a, c, g, or t
  misc_feature (857)..(860): n is a, c, g, or t
  misc_feature (862)..(870): n is a, c, g, or t
  misc_feature (877)..(881): n is a, c, g, or t
  misc_feature (883)..(887): n is a, c, g, or t
  misc_feature (892)..(896): n is a, c, g, or t
  misc_feature (899)..(902): n is a, c, g, or t
  misc_feature (905)..(916): n is a, c, g, or t
  misc_feature (920)..(937): n is a, c, g, or t
  misc_feature (944)..(946): n is a, c, g, or t
  misc_feature (957)..(959): n is a, c, g, or t
  misc_feature (962)..(964): n is a, c, g, or t
  misc_feature (970)..(982): n is a, c, g, or t
  misc_feature (988)..(997): n is a, c, g, or t
  misc_feature (1001)..(1010): n is a, c, g, or t
  misc_feature (1014)..(1017): n is a, c, g, or t
  misc_feature (1024)..(1028): n is a, c, g, or t
  misc_feature (1034)..(1037): n is a, c, g, or t
  misc_feature (1039)..(1042): n is a, c, g, or t
  misc_feature (1045)..(1045): n is a, c, g, or t
  misc_feature (1047)..(1061): n is a, c, g, or t
  misc_feature (1066)..(1068): n is a, c, g, or t
  misc_feature (1071)..(1073): n is a, c, g, or t
  misc_feature (1077)..(1078): n is a, c, g, or t
  misc_feature (1087)..(1104): n is a, c, g, or t
  misc_feature (1107)..(1149): n is a, c, g, or t
  misc_feature (1153)..(1153): n is a, c, g, or t
  misc_feature (1158)..(1173): n is a, c, g, or t
  misc_feature (1176)..(1180): n is a, c, g, or t
  misc_feature (1184)..(1196): n is a, c, g, or t
  misc_feature (1198)..(1198): n is a, c, g, or t
  misc_feature (1200)..(1228): n is a, c, g, or t
tatgaacacatcagtaaaaccatcgataattaggattgatgcaatgaaagaactttgtgctaactgatgacaactaagttaatttaaaaaaaaatgcaaaactttcatgaaattcgggttctggaaaacatttagaaatttcacctttttgttcactcatgatcaaattgatttcatttcaactctgaagtcaaactacttctttagaaagtacattccatcccgaagttctaacttctcctcagaaactagaccagataaaaagctttgtagttgctggagtgacttgtcatatgggggatcggcaatgcaaaacatctgtgacaatacaatcatgtaactaatcttgatcgtgctatctgtgtccaaacatttatataggtgaaggtgtaaaactgttcttttttttttcagggggaacaaaactaaaaccattctaaccttganagaatggggaattcnatcaaaggccaggctaccaaagttggggagcttccccagaaaaaatttctgccaggaacctaccccnnnaaaatatctttttannnccnaggntaaaattttaannnacttacnntgcnnnnnttnnnaggccnnnnnagttttttttttattttnnnnnnnnnnnnnnnnngnaannnannnnnnnnnnnnnanctnnnnnnnnnnnnnnnccaannnnnnnnnnnnnggnnnnnnctnnncaannnnnantnnnnncnnnnnnnaanaannnnnnnnnnnnnnnnnnncnnnnnnaannnnnnnnnnaaaannnnngnnnnnnnnnnnnnnnnntttntnnnnnnnnnnnnnnannnnnnnnnnnaaacncnnnnnnnnaaaaatttccaaannnntnnnnnnnnnttttttnnnnnannnnnaaaannnnnaannnnaannnnnnnnnnnnaaannnnnnnnnnnnnnnnnntctcccnnnacccttttaannnggnnnttttcnnnnnnnnnnnnnttcccnnnnnnnnnnccannnnnnnnnncccnnnncttaccnnnnnaaaaannnnannnnaanannnnnnnnnnnnnnnttttnnnttnnntttnnaaaaaaaannnnnnnnnnnnnnnnnntannnnnnnnnnnnnnnnnnnnnnnnnnnnnnnnnnnnnnnnnnncaanaaaannnnnnnnnnnnnnnntcnnnnngagnnnnnnnnnnnnncnannnnnnnnnnnnnnnnnnnnnnnnnnnnntaaaa

SEQ ID NO: 6404 - DNA, 871 bp, Glycine max
  misc_feature (858)..(858): n is a, c, g, or t
  misc_feature (860)..(860): n is a, c, g, or t
cttttgggtgaaaggttgaaagtgatagagactttatggacgtgatgatttcagcacttaatggttcacaaatcgatgggtttgatgctgataccatatgcaaagcgacaaccttggtaagtagtttatgaaattagtattaattctattttaatttctaatgagtcagtaaaattacacttttatgacgtttcaaacttctctgcatgattaacaccaggagtattggttgaactgattttggaattatagtgtatttttataaagaaacaacattataagcaagttaaaaaaaaaactttttgtaacgaagaaaatgtcaagaaaaatagtctctgattttttttactattttttcttctctattttaaattccaagatttaagctttacagtaatttatagcataaacatattatataactaactttaattattttttaacagtagctttacagtaatttttaaattctaaaaagcttaagataagcattaccttcgaatctcaagcggtggtctacagtggcttttctgaactataatgtatatataaaatattaaacaattaaatactaatgattgaatataaattttcattgtatttctttttcttagataattttggacgactcttatgataagtttaaacttatttacaggagttgatcttgggaggaactgatacaactgctgttactcttacatgggcacttagtcttctattgcgaaatcctcttgcattgggaaaggccaaagaagaaattgatatgcaaattggcaaagatgaatatatacgtgagtcagatataagcaaacttgtgtatcttcaagctatagttaaagagacactaagatgtancnaccagctcctt

SEQ ID NO: 6405 - DNA, 403 bp, Glycine max
gtcatggtcggaaattggaattaacttcccagaaattaaacgaaagtatgtaccctaaaaaataacagtataaaatttgcaaagttacatttttaatttaactttagccgcggaaaaggtttttgcgttgcgttgcactagcccctgcacagtagtgtggtacgatgatttgattttgataagataggtctgtgctgtggggaaaattggaagcatcgatcggaaaatgcaatcgttatcgttgagtatgagtctgaggagtagtagcttagtgaattttcttttgctgggttcagagacgagagtgagaagcagaaggagtgtcatcgtagcgtgtgcttcagagggagacagtggcagcagtagcacaagctcgtttctctctcggacccaaacctacgct

SEQ ID NO: 6406 - DNA, 683 bp, Glycine max
  misc_feature (651)..(651): n is a, c, g, or t
  misc_feature (656)..(658): n is a, c, g, or t
gccacataaatttgagattctggagcatttgaggcagttgggttgtggtgctgtgcttgtgagtgggaatgagcttagattggctcttcgggctgggtttgatccgacaaggttgaattacacttaacccttggatgtgtctacatgtatcaatgtatttgtggttttttaagatcctttatgcgcagctattataggaacatatcctgtgagaacatgatggtaaagattgttttacctatgtctgattttgaccgtacatttagattgtatgatcaagagttgctcctttcatactcttgtctctcacttgatatgcttccctactctgtatatatatgggagggagcatgtctggtgagagatgagagaagtcaatcttggtcatccattaacttctttcatgggagcatgctctgatttctctcacctaatatgtttctgatatatacagatctgtcatctggaccttggttagctttgattaaaaattatattgtttggcatatctcttaaccagttcttagtaattcttttattttcttgaaaaaagtgtaatatttagggtatttgtggatcaacacattggtgaataggtgtatctttaatggcaatgggaaagtcttggatgatttggtcttggctgccaangaaannntttttgtcaacattgatagtgaatt

SEQ ID NO: 6407 - DNA, 692 bp, Glycine max
  misc_feature (675)..(675): n is a, c, g, or t
  misc_feature (681)..(685): n is a, c, g, or t
gatatattagtgcacatggggagacactcttgctgctacaagcagaagcttcgtaaaggcctctggtctccggaggaagacgagaagcttttgaattacatcaccaaacatggccatggatgttggagctccgttccaaaactagctggtaggatgatgagtactatacaacactttatcaatattaatattgcatcatgtttgtccacaacacaacacaaaagtcattttacttaattaaccttccttctctcaaactttgtgtctcaggtcttcagaggtgtggcaagagctgcagattaaggtggataaattatctcaggcctgatttgaagagaggagcattctcacagcaagaagagaattccattgttgaacttcatgcagtccttggcaacaggtactactatattttgttttcaaagttgttgctagtttagttcgccttttcgtcgtttagattaattgttatcactacaagtattttcgctattacggtgtctcttgaggctgtcggtaaaacatgttctttgtttcatggttttgtatatgtgtttttgatggttgtatcaggtggtcacagattgcagctcagttaccaggaagaactgataatgagataaagaatctatggaattcctgtctgaagaagaagcttaggcaaagaggcattangttacnnnnnagaactg

SEQ ID NO: 6408 - DNA, 500 bp, Glycine max
  misc_feature (319)..(319): n is a, c, g, or t
  misc_feature (384)..(385): n is a, c, g, or t
  misc_feature (387)..(393): n is a, c, g, or t
  misc_feature (402)..(402): n is a, c, g, or t
  misc_feature (404)..(415): n is a, c, g, or t
  misc_feature (434)..(441): n is a, c, g, or t
  misc_feature (454)..(455): n is a, c, g, or t
  misc_feature (467)..(467): n is a, c, g, or t
  misc_feature (470)..(472): n is a, c, g, or t
  misc_feature (478)..(478): n is a, c, g, or t
aatagttcattgtgttgtgccttcagaattcagagtttgcttgcttgtaactttactcaattttttaagcactgctttggatctagcaatggataggcaatccagagagataactcaccctttggctttaacgccatatttgagaattatggtccacgtgttatctaattaatgtgataatttgtctgttgtagcagtgtaaaatatcaacgtcaagctgtaataggttgttcgaggcttccccttttgtttgtttagttagcatatgaaagaattcttatgctaaacctttgggagcggtagtaacaaggattagacnaagtattaattctttcatatgctaactaaacaaacaaaaggggaagcctcgaactacctattacnntnnnnnnntatattttncnnnnnnnnnnnnattatcacattaattagannnnnnnnggacataattctnnatatggcgttanagnnnaggganagttatctctctggattgctat

SEQ ID NO: 6409 - DNA, 383 bp, Glycine max
cactcccgtatttggtcaacaacctgccccacttcaatcaaattttgcatttggagcattagctccaacaggagtgagtcctttccatttcgcaactcaacagaacattgctccacagaatccatctccatttcaggcttctggcagtcttgagtttaatgctggagggagtttctcattgggcactggtggggctgacaaggcgggtcgaaaatatgtgaaagttaggcataatagaccgcggaagaagtaagactatttgtttatgaaaattgttatttctgtcgctgctgcaggctgcacttcattaatgctactaattaataagctctaaaggggagtggttcctgagtttgtgtcctgttaggtttgcgtcctgttag

SEQ ID NO: 6410 - DNA, 415 bp, Glycine max
  misc_feature (352)..(353): n is a, c, g, or t
ctctgcacttacatcaacaatcctcacaccaattttgtaagaagatatgccaggaggctttttctgcatctctgtggcagcaagtctcattattacagtgttcgagactcttggcagttctctactgaagccaaaagactttataaacacacaaacaaatctggtggttttcaaaataatcctatcccatatgaaagaagtgtaaagattgtgaaatgcctttccactatggccgaagttgcagctgcacgtcctcgtaactggcaaaagtactgtttaaggcatggagatattttgtctttcctgatgaatggaatattttatttcggtgaagagtctgttattcagaaannacagggcgttcacaagttgaagcttttgggcttacattttaagcacatgctctgctggaatg

SEQ ID NO: 6411 - DNA, 851 bp, Glycine max
  misc_feature (207)..(208): n is a, c, g, or t
  misc_feature (263)..(264): n is a, c, g, or t
  misc_feature (420)..(420): n is a, c, g, or t
  misc_feature (422)..(424): n is a, c, g, or t
  misc_feature (489)..(490): n is a, c, g, or t
  misc_feature (835)..(838): n is a, c, g, or t
  misc_feature (843)..(844): n is a, c, g, or t
  misc_feature (846)..(847): n is a, c, g, or t
attcttttagttatttcaatgctcgtttctttggcaattctctggatataaggtgctcgcttttcttctaacttctcccagcagttactttttgctttcctttgagtagaatgttgtaacttaatcttcatgatgcttttaggtaccagtttgtgccccagatgattttccttaactgtctatttgggtatctttcccttctcatcnntgtcaagtggtgtactggctctcaggcagacctttatcatgtaatgatttacatnnttttaagcccttttgacaatcttggtgagaatcaattattctggggccaaagaccacttcaaggatgattcacttctttgcttctttattgcttaataattgttgttccatttcctattttacatcattccaaattactggttatgatatgcaggntnnnttattgcttttggctgtaattgcagttccatggatgctctttcccaaaccttttatactaaaganncttcataaagaggtgccgcttttgcctccctcatgtgtgattttattgcttgaatattgagaactttgttcactaaaattcttgtttacattttaatatgcctacattacatataaatccttgttggttcaattttcccctttcggcagaattttgcttaaggttgtcaaatttaaattctcttttgaggtccattataagatcatttttcttcagactaaaatatgctagtttcaaaacacttacaacttctattggctatacagacattgttttagctatatagttgcccttgtcctatacttttgatggcatctagttattaaagaagcaatgcggggagtnnnnaagannannaatc

SEQ ID NO: 6412 - DNA, 349 bp, Glycine max
caccgtagcttcgaagcttggttttggcgacacagcaacaacaacaccacaagagaagagaactgaccatgctgctgctcctacagaatatggaaaaagtgttgctcagtctctgacagagaaactagctccagtttctggaaaagttgctggtgtaggaagtggtgtgaagtccaaagtttctggaactcaaactagtagtatgggtgtggaacaggacaagggggtttctgtgaaggactatttggtggacaaactgaggcctggtgatgaagacagggctctctctgaagtgatatcagagactctgcacaagaaggaactgcccccagtggaagttactgaagaa

SEQ ID NO: 6413 - DNA, 400 bp, Glycine max
ccaacattttcatttttgaaaaggagttatcctttttgatcgattttccagaaagcgttccgattgtgctgctattccgtgtccgactcggctgagtttggccgatccaaacaagcgagtcagttgttggaggaaagcccctcatccaagaggaaccagttccacccgtatgctccagattggaaaaatggttacactctagaaggttaaaccccttctgtggtccctctagcacactatcgaagatactagatactccatccgcacgtttcgaagctattcatgatattgatttcagtgcttctgacttgaaaacattggaacgaactgaccgaagcaatttgcttcttcataccatcaaaactgaagagaagaaaacctctatcgagaatggcagtca

SEQ ID NO: 6414 - DNA, 342 bp, Glycine max
gggagacaagctgcggagttgttgaaggttttgctcggtgagaacaatggcgatgttgttgcgttgaacagtgatacttgttcttcgtttggttcctcgaggaatcatgattcggaatgagtttgattctttttgttaggaaatggattctttgcattcgcggattcattcaggcattcatgaattggaatggttgaatgaagataagatggttcacattttggatacatgtgttaagtttgttacatttaggataaaaacatagatgcagtttcttatgtgcttttggccatgttttccgatcagaattagagttttacctcggaaatctgtgttggtatt

SEQ ID NO: 6415 - DNA, 616 bp, Glycine max
ttccaattgcttctttacaggccttactgtgcatagcttctgtgtgtctttggggctgtggctaagtagtaatttttactttcatgggtgaatttcttgtggatgcaacagtgtttgaagataagaaggtaaaccccatttttcattaaggttctttcatattagaaattgatttcttttttcattacaattattatttgttccttgcaaatctgtcttactctatggttgttggacttggattggatcacaccccaatttgtgactgttaaaatcctgtgctctttttggtgttgtttgtgagttgtccttgtgttggttgtcttcaattatgaatacaagttttttgttttttttcccatgatgttgaagcagatgggagagggtggtgctgcttccaatcctgctttgcaagtgtcggtttcttttggtagatttgagaacgattccttgtcttgggagagatggtcctctttctctccaaacaagtacttggaagaggttgagaagtgtgccacacctggatcagtggcacagaagaaagcctactttgaagcacattacaagaaggttgccgcccggaaagccgaattgctggctcagagaagcaaagagc

SEQ ID NO: 6416 - DNA, 518 bp, Glycine max
tacggcggagcataataatctctgagtttttcttgctgcaactatgtaaacctctgttctctcttatccagatttagtttagtttcttattggatgagcattttcgagccctttcatttcattggccagtatctatttataattctattaatttcaagtttttttgtggttaatgtagttgatacttgctgtgcttcactattttctgtcatgtcaaatgtctcaaaaagttcctttgcatctgataaatatgaaagagtaggacctgattactttgggtattactcttctgaagtagtaaatttattgtcacaagatgaggatgtttttcctgtttctacccaaacacctgagctacctgaaaccaaatatgaagagggaggaaagaagaatttagtcaatcagactgataactgttctggtccgttgtatagtaatgctgttggagctggcctttcagagtttaaaaaggacagatttaaatcactgctcagacagagtgtcattgctctttcgtc

SEQ ID NO: 6417 - DNA, 361 bp, Glycine max
gattccgtaagtttgttagcagagcagacacatttctttgatgctgctagatggcaccgttgcttgaaatgcaatttcacccgaaaaagcagattatttggctgcataatatgtgggacgcaaactactggtagagcagcttcatagttgttgcctatcagctgtattctgttagctattgcttttgccttggtgcagtttattctggtagccattggtgatgttggcttgctgctgctgtcatgtttcgccttgtattttgatgatgattatgattatgattgcaaactgtaaaatttttgtaaaacctcgctctatttttagatattatgttgatgtccaacattagaacactgctctt

SEQ ID NO: 6418 - DNA, 777 bp, Glycine max
ttcgtccaaactgatgggaagttgattgagctgaacactcagtgtgcgcatgcagacaatggatgtggaagttgcagctgtgaagataatgccatgaatgaggctatacttaatagtaaagttgaagctgtaatgttgcaagattaatttagtaatttgctcgattcttagatttatgtatctttacggggacttttaatttctcacacattatatgaatatactttcttttacagattgtcaatgagtacaatgaattgcttgctactcaacttgaaaaccaaaaattagtaagtgtacttcatttgtcccttgctgtgaatctgcaaaacattgcctcctgtatattataaacacattaatttttttttataacttgtattgattaatctgtttctgtattaaattaattgtagtattttgaatccttattacaagaagtaaaagaagaatctgagagaaaaatttccaaagctgttcagaaggctatcagtcttaaacagcagaagattcagtccaagattgacagatgtaagaaagagaagaaatttctggatgatgtaagttgtaatccactcttgagaattctcttttgtagaaatcttagtaatatgccataagttataaccaagctaaggcttctctattgtctcattactatatcataaagagtgaaattctttttacgaatgtttatattttgtccgtgtctgcagcttaatgagaatcttgtgaaaaatgaggacatttggaaaactaagatacttgcgattgaaa

SEQ ID NO: 6419 - DNA, 386 bp, Glycine max
ctaaagactaaagactaaagactctatggaaaatatgagttagtaaccttcaaccccaaccccaatcctctctaggaaaaaaactccttttaattcatttattggaattttcatattatattacacccgatgtctctgtcacattttatttgagtcctttgaatttgcctcttcttggttccataactggggaaatttaaacgaaatttgttaacattatacttatctaacttcatgtttgttatcgatgtctatgaatctcatagctacagacttttacccaaatggaaggacaaataagtgattcattaagtaaacaacaatgtttgaagacaaaattaaccaacgagcttcaaaatgtccaacctccagaaatgtatgcattc

SEQ ID NO: 6420 - DNA, 418 bp, Glycine max
tccccctcccccatctcctcctcctccattgccagtgcttgaaacatcacctgaaaagggtgcaaactcacccattagaagaggccctggaaggcgtggaaaagatcgacgagctggttcacggcgccaccgcaaagttgttgctggaggtagagagatggaaccaagttaacaattttgtttgggtgattatattattagtagttttgtttaaaattccacctacagaaatcattcgttgcagagctggagggaaaaaatgtgcaagatgagtgttgtattgtttccacatagacgctctcattcttttaactatccgcaattgtccatttttgttaattttttgctgtatatatagtaaagttttcaataattatagtggtaacccattttgctattccgctatcactaaattcca

SEQ ID NO: 6421 - DNA, 468 bp, Glycine max
tctcctagttttgacatgacatggccaattgtttagaagtgtccatacttcttggatcttcattatttataaatgagaacagtgtttacaattacaagggactacattatatgattttgtttttctacccaatgtaaaaccggaaaataaccaacctgatcatgtctactggtttttcttaatcccggatgttgaaaaggatgatctcgccttctgactggattttcttgttttgttggcatctgcattggaacttctaataatgaaaaggaaagtttccacaaacatggcaccaaccaaccccagaattcctccagcagcattctggaaatagagacaaggaaggaaacgaagagatgagagctcataactaaacaactatttgaggataaatgaataagaaaaatatattttaggcagtaccatggcaggactgtgattgaacaatgctctaaatgctgcatatcc

SEQ ID NO: 6422 - DNA, 1507 bp, Glycine max
ttgttatctcctctttgtgaagtttatgattattgaacttggaaaatgttaactattgccctactagcactggttaaggaatcaaaagtagaaagtttttatagtgaagttgcatttaatgttatcgatgcacctccatcatgatttccaataaaaaacttctatttattgatttcataaactatgcactcagcactcttgttagactacatctttctctgtatagaattgtaaaatttgtggtagtaagctcttgatttaaagcttatattctcatttgaacatgctgtgttttccctctccagatattcagatagagtcaaagcagaaactgaacggttgaatcaagttgagcttgatgacttggaggtagttgacttattctgcttctacatttcatattgaaataactttttttttatcacattctaatatttctgtattttgtagatggatgaagatgaaaaatacaaccgtaaactagaatctggactatatactcttcaggcaagattttttttacatacactaactgatgctgagaaatgacataggtgtagttttttgctgttatatgaactcatccataattactttaacaaatggatgtcttctatgatttcttaggaaacttttgttctttgtacataatcaactgtattaccaaatggattttataaaggtttagtttcttcccatttcaaaaattgcatttaggaagaattttagaaaacaccagtggttcttgtactagcatcatcttaggaaacatttgttccttgtacataatcaactgtattaccaaatgaatcttataaaggtttagtttctttcattttcaaatggaatttaggaagaattttagtaaaaaaaaggtggttattgtactagcatcatgtttgtagaagcagataccagttttacagcacctgttgtgcactgacaattttatatatgttcctgcagttgattgctgtcattttgggtcatctttggtgctcagagtaagtatttgcttctatatattggtaatgtcaagacctttgatgtatatgtttttcaccagactagtgttgataaatattgtgttcaggcatccacaaatgagagggagaattgaactacttctcaagcagaacaaacttagtaagaagcatatcaaggatatacttcaggtatatgccctcaaagacttattagtattcagttaagaatgaaattgattatcccttagcgcagtttacctgtccttaaaaggttgcaaccttgtacttaaattttggtaatttaattatattccctttttctacacctgaccatgcttagcttccccacttatgatgtgtttgaatgattcagtgcattactcctagaagcccactattttaaaaaagaaataccagaggctcaaatctattggaatttcttctatttttcaggagtatcatgacaatattggtgaccttgatggaccggaagagaaggagagagcacagacaaaaatcag

SEQ ID NO: 6423 - DNA, 625 bp, Glycine max
gtggcttagagacggtcttggcatcatttctagtgctgcagagatagaggagatggcattacaggttgaatccactggtggggtttactttgttcctgcttttaatggattgtttgccccatggtggcgtgaggatgctcgcggggtttgtattggaataacaaggtttacaagcaagggtcacattgcccgagctgtgcttgagagcatgtgtttccaagtgaaagatgtcttggattcaatgcataaagattcaggagaaagtgaatcccaaaaaacagagtttttgcttagagtggatggtggggcaactgtaaacaacctgctgatgcagattcaggtttggactaattgcatattattttctatggatctctttgtttcatctaattgcatataattcttttaaaaaaaaataaaatttgttaatgatcatgttattttttccttaacaataacattatatgatttctggtttgttatgcttctttagtgttaatagtcactgaagtgttcatgtttgttgagaatcagaataggatcagtttcagattgatgcaaaagctttttacttttcacataactgataattttttgttactaatgttctacaggcagatttggt

SEQ ID NO: 6424 - DNA, 212 bp, Glycine max
atcataggtcaaagcatatatcaattaattatccttgggattctaaattttgatgggaagaggctgctcggacttggtggttcagatgcaacaaaaatactcaacactttgatattcaactcctttgtattttgccaggtacactctccatgcaccatgtcctaattgttgtttatacttaatagactccaaacatgtgaaactctgaggat

SEQ ID NO: 6425 - DNA, 341 bp, Glycine max
atttttaagtgcagcattagggaagcatatgtgaagtttctgcagtttactaatagcgcaagcaaattaggcttcaaaattagggttcttcaactccgttacaactttcagttttttctttccctacctttctataagtttattcggtttataaacaaactagcttcaagattttcatggtttaatttaatagattttgttattggacaatgcataacttatatttaaatttgactgccagagatgactttgttcatatatactttggcattttgtgcataaatgtgtttggacatcttcagagcgggatggccccgttatgtcacaactcacatgctttg

SEQ ID NO: 6426 - DNA, 472 bp, Glycine max
cagcgctgtttcgatgtggggattgctgaacaacatgctgtaacatttgcagctggtttagctgctgaaggcctcaaaccattttgtgccatttattcatcattcttgcaacggggatatgatcaagtgagccaatatcattaaatgaaaatagtccaatctaactaattattgatttcttatttatgtcagtttacttattatttcttgcctacgataaaaaaatttcaccactatgtatgtaggtagtccatgatgttgatcttcaaaagcttcctgttcgatttgctatggatagagctggtttggttggagcagatggaccaacacattgtggagcatttgatatcgcttacatggcttgcctacccaacatggtggtcatggctccttctgatgaagctgaactcatgcacatggttgcgactgcagcagctatagatgatagaccaagctgctttagatttccaag

SEQ ID NO: 6427 - DNA, 513 bp, Glycine max
  misc_feature (381)..(384): n is a, c, g, or t
  misc_feature (433)..(434): n is a, c, g, or t
  misc_feature (448)..(449): n is a, c, g, or t
tatgtaataattgaaacccagagcaatgcctgtgttttatctaagccagatatccccaattacttgaatcaaattttaaaagttaaagctggtttcaaggtgctgcctcctcatcattatcagagtctccatcacttgaggaatcttctttcttttgctgctcttctccagcatttaatttggtctttttctcctttttcctttgcttcttcttttgacgtcttgctcgcttctttgctgtccgttcctcagccgcttttagtctttcctctcttctcaaattaaattctgccacctctttccttttctggtagtcgacttccatcctggcaagacgatcttgctccttgcgtctcatttgtcgatactggtggaagtatnnnncttcgattataggttgaggattacccttttgcagttgatgggctaaaannttctgttgctatcnncacatgcgttaaggactagtgctccttttactacaaggagaatgacactatcaagaaagatact

SEQ ID NO: 6428 - DNA, 374 bp, Glycine max
cagtggctggtttggcagggttttacattatgaggcatcccagatttcgccacaggctgccatgtaccccagtcaacttcttccggcgcctccctgcaagaacagattgtatgctataatgtagtagtagtgtatgtgatgtttcaaaccagttttttcccctatttattgttttatctggtattgactgtgtttttattatgtaacgctttagttgtgatattcccaagcaagctcaagctggccagacttctaatttgtatgtggattgtttagctgcaaatcagtaagacttgaatagagttctctttaatggtttttggtaatcatgttattgatacggagtattcaccggttttgttgataattaatcg

SEQ ID NO: 6429 - DNA, 359 bp, Glycine max
gggaaaagagtgaatccgaatccgaattcggctcacccttcactcccattacagaagactacttctaacttctacaatacgagtgtggaaacgagaataaagttatgaaagaaagaaacaaatatatagaagatcgatggtgatctatatttggaagataaagaaagaatgtaaggctttctatagtccaactaagtcttgtataatagtgcttcatttggttatctttcttttctgcacaaggctgttacctttcagaaacacccaattgagttatcaaatttattaaacggttgataaataatcattttaatggtgtgcataggaagttttgtatggctgtgaactgtgactgtaaa

SEQ ID NO: 6430 - DNA, 363 bp, Glycine max
tcatatttaaaagatttgaagaacttgatgtttgtggtaagttaatgctgaagagtaaacttcgggaaattgcataccctgatcaaaattctatgtgtcatcctccagcaaaggttaacacaaaaggtgcaccgaagaaatcgatgaacagaaatccaaggtcaacaaagcgtgatccatcttactggaagtatgtagatgcttttcattctgtgcaaaatagcaattcgtcagtgaggcatagtgtatcatcttcttatcagcccaatccaagaaggatcatgcctatgttggaccaatttcagtcatttatccaggatttcattgataacattgtggatgtcaaacctgacagaaactgtg

SEQ ID NO: 6431 - DNA, 371 bp, Glycine max
aaagtttggatttggagtgaagaaatttactgcttggtaattaatcttattgacatggctgaccgttggcacaactatacattggaaatggttttgcaatgtagacattgatgacaagaataaagtctacaaatacaattgattattgtgacaattgtctaaattcattcttatttaaatagcattaaattcttcaaaattcttgaggacaaaattggtttgtcccgcatggtgtttcattaaactgatatgaagcttcataccaattagctgaagttttgtatgatagagaagcacactatactcggttaggatccgattttgtagttgtactttgtcatatttagtggctcagattgatggtcttactc

SEQ ID NO: 6432 - DNA, 351 bp, Glycine max
ggctttgtgagtcaccttcttactcatacatgaaacttcccggcgactcaggtcggtttcaaacctctgcttcttctccgtttgggtcagactatggtttttctgcttcttcaccatcttccaaactttgtacttcttcttcaacccaaatcatagtttcttccagtgttcaatcgccacaccgtggcatgaattcacctagagttccaacatgaacttctagaccaacatgttctggtacaagaatgtgattactgcttgtgttgttaagtgttcaagtttgtcttttgaaatggttaaagtttgggaccatgtttgaacttgcaagcatgtggataaccaaaggagtca

SEQ ID NO: 6433 - DNA, 730 bp, Glycine max
atgtctgagctcaaccctgagaaagttgtgataaaacaaattgtttggcctggaacccatgattctgcaaccaacaagattggcatcccatgcatcactcggccttttgctcaatgccaatccttgtccatctaccagcagcttgtgttggggacaagggtgattgacattcgggtgcaggaggatcgtaaagtgtgccacggagtcctcgttacatacagcatcgacgttgtcatcaaagatctcaagaagttcttatcagaaactcagtccgagatcatcatcctcgaggttagaacctatcaagcactacactcatatcttaaatttgcttcacgtatcttatatgtatcaaataatgatattattggacactttaataatacgacgaagtatccaagtctttaaaaacttaacaaaagtccaatacattataagagacatagaagcattctcctttgatgaacaaaaaatggaaattgtcctcattatagatgatttcagtgagaacgataatattattccaataatgttcaagaaatatgttcataatttggatcacagaaatgtaattatgcatacgtagatatgtgtcttatatttatcatatcctatataactttagaataattgtatcgctgtattggagacatattatatatttgcatcatataggttagaaccgagtttgggcacgaggaccctcaggaattcgacaagtaccttgaga

SEQ ID NO: 6434 - DNA, 1080 bp, Glycine max
  misc_feature (895)..(896): n is a, c, g, or t
  misc_feature (1001)..(1003): n is a, c, g, or t
  misc_feature (1016)..(1018): n is a, c, g, or t
  misc_feature (1022)..(1026): n is a, c, g, or t
  misc_feature (1035)..(1035): n is a, c, g, or t
  misc_feature (1053)..(1053): n is a, c, g, or t
  misc_feature (1055)..(1056): n is a, c, g, or t
  misc_feature (1058)..(1059): n is a, c, g, or t
atgagcctttgttctcgagaaggatcaatgctgggtagtggctgaaaatgaaaaattgaaagccaaggtaaaagctgcctaacttttctatccctaggtggatcattatgcacctctgccacaagttgaacactattattgtattaatgtcatagtaaaagttttagattaaaacatcatttatcaagcaatgagttatcattgatatgcaagtattcaagttgatcacatactcttagtcatttaaattttctgaaattagtgtgtaagattaatttgatttatgacttttatttttctggtaataccaaaattgctcattcctaaacaataaccgtggttgtaacctgaaggaaaaacaaaaaaacacctctaaaagaagaaaaagaaatcaccctctaatgatttttagtgtgagactttcaatatttgattactttctatgtagcactgtatggttaagtgagaactgaggatataattaattagaacctcatatatttgctccgtattctttgacaccttcttacagctttggaatcttgtaagtaaccaattatctttaaacttcaaagtgaatgtttccacaaaggctagtaaatcttctgtaatatttttgctatgcttttccctcctcaattgcttgtagaacactaggaacaattcattgtttaatgctcccaacccaaatggcaggaagcgaaggatagccgaacatttggtccagttcagatgacagacattgtaggcagagtcatatattgcctgcgaagtgctgtagaccatggccgggtacaaaacaggtgaactaaatttcttgggctaattaaattatcatgcacaaaaaatggggatgctcttttgaattgattgttgatatattttaccccttcanncagttatttcggcatgcgaaaggatacaccagtgctggaagtggaactcgatgttgatgagatggcaaagagtcacaaaccctgaaacatttgtcccgagaaacnnnaactagtttgctnnncgcnnnnnctagtttcnttcttgtggattttcctngnngnncagattgtataataaaaaata

SEQ ID NO: 6435 - DNA, 412 bp, Glycine max
tttttaccgttacagcggttgggctattagccgcccatccgccacaatttggggcttcattgatccagaaagccattgaagcccacaatgctaaggcaattgatgaacgtaacaaggagtgggagagtacacccaaaatttttcaattcaaagatgctggggtgaattgtgtggctgttggaagctccccaaggtttaaggtttatgacattgattttgggtgggggaagccagagaatgtgaggagtggaactaataacaagtttgatgggatgatttatttgtacccggggaagagtggagggaggagcattgatgtggaactaacattggagcctgaggctatggagaggttggagcaagacaaggattttcttttggaagcatgaaattgctagggtaaaaatagctt

SEQ ID NO: 6436 - DNA, 564 bp, Glycine max
  misc_feature (400)..(407): n is a, c, g, or t
  misc_feature (424)..(424): n is a, c, g, or t
  misc_feature (426)..(428): n is a, c, g, or t
  misc_feature (495)..(497): n is a, c, g, or t
  misc_feature (504)..(517): n is a, c, g, or t
  misc_feature (519)..(519): n is a, c, g, or t
  misc_feature (523)..(524): n is a, c, g, or t
  misc_feature (526)..(530): n is a, c, g, or t
  misc_feature (557)..(557): n is a, c, g, or t
ttgaagctctaggcgacacgccagcctttgtgtcgcacattggagacattagttatgcaagaggttattcctggttgtgggaccattttttcgcccagattgaacctgttgcctcccaagtggcataccatgtttgcattggcaatcatgagtatgactggcctttgcagccatggaaacctgattgggccagttatggaaaagatgggggtggtgagtgtggtgtgccttacagtttaaggtttaacatgcccggaaactcttcagaactcactggaaatgctgcagccccaccaactaggaatctttattactcatttgatatgggagcagtacactttgtgtatatttccacggagaccaattttgttcctgggagcaaacagtacgacttcttgannnnnnnntttcaatgaaatcgcantnnntgaagtgagaacgaacaatgtgttttacttgatgtttgatgtagtggtgatgctgaagaagggcatnnngtggtgnnnnnnnnnnnnnntnatcnntnnnnncttgcgtcaaggaaaatgttgccattnttggtta

SEQ ID NO: 6437 - DNA, 389 bp, Glycine max
gcagaagatattaatatgccagaaaaagctatggtactcatccaaccagggttcaagatgacaaactatggaacttaagccgtgtaactggtaagatggtggtggttagagtagtagtatagtgaagtagaagcaaagggaagcgaattcagagatgctctgggcatatattgacccaaattctataatataatgcgccaagaatcagccaagttcaaatttgtcaaaagaacaaggggtaacccactaatctgattttgttaatttatagagaaaaaaaatcatatatacataatatatatatcgcattcccatgagtgctgccatttgaaggacagtgatatttttgtacagaattgttttacggagaatagcactgcacttgtata

SEQ ID NO: 6438 - DNA, 372 bp, Glycine max
tatccacctgaactatatcttacattcccaacactcccttcctgtctgaccctccctcgaaaggttaacccaaaaatcaataactataaacattaataatactataaacatagtactcataaacatcccaacactgagataaaaaaaaacaaaaaaaaaaaaaaaaaaaaccccaaaggggaaaatttaaaaagggtggtgggaagggccggaatggttccccggtccgttttgggaactaaaaaaggttggggttttttttttggactaagattttttatataaatattaattaattaacggcctgggaaaaaaaggttggtcccccccttggaaccccccccttttgggaaaaaacccgggggaaaaaaa

SEQ ID NO: 6439 - DNA, 751 bp, Glycine max
acatccttggggtgtgacacctttcaaaaaggtatgttttcattttcttcaacaatgaaaaaaatgcgtctttctttgaaatttttcaacacaactgctattgtttaaactttcaacttgcagatatgtattgtttacatgttataacaatccgtggtctgtgttaatttcctgcaattttagtcttggtaccaaaaaacaccgctgaatttaaaatgaaactatcaccccgtgtctgtatcaaaatattaccctgcttcactagagtcacaattttatttttttgatattccgggttgtaagtaattgatacagtacttacttactaatgcattccatatttaaactctttggtttgtacatgattcatctggaatactatgttgttattcgtcccttcaacacaattttatgaattcaggttgtcagcttgccctcaagaattgatcctcatcagacgtctgcggtggtgacactgcatgggcagttgtttgttcgtgtcccatttgaacatgcagaatagtggtcgcttatgctttcaatgcctctctctttgatcatgatatatatgtaggatagttgacccggaaatcatgtagaaaaattatttctgcctgcaaaacatgccaatttctagcttagcgtagcatttattttaatgttttagttcacttataaattctcgtacatgattttctcaaagaatattttaaccttgttaatatgagctaggtaggattctgtaattgct

SEQ ID NO: 6440 - DNA, 202 bp, Glycine max
  misc_feature (56)..(56): n is a, c, g, or t
attttaataagctataatatacaaatataaactacacgaaataaattacaccattnggataaaatataacatatattcaccaatctttaaaagctgcaaaaggtagctttcatataaattacagtggataaaatacacaccattggtagcttccattctattgtagccgcaaataacaattcatattctcgttggttttttt

SEQ ID NO: 6441 - DNA, 389 bp, Glycine max
acgtgggcacttggagtgacaagccatctgtgcctgattgtagccattggtgcttagccggtgttcctgatatgtggaacgaaattctcctctcatatttgctacctaaagaaggagcatattagcatgagaggtaccaacatgttagtccttgtatcatctaagccacatatatagcttggtactcaattgtactcagcatcaaccatgttagcctttaacgacacggtagggccaaatgtacatttggaaatgaataatgtttataaagagtgatgtcaaataattggcatttgcaaagaattgataccaggactaaagtgtttatgtgtcacttaccccctgcgatgtggaatggcttttgcttaacgtggatgtgtctttggtta

SEQ ID NO: 6442 - DNA, 356 bp, Glycine max
acataagcatatatatagaaagatgtcaggggcacaaggagcacaaccaaaggagtcaaaaacagcaacaacatatgagtcagtagaaggaggagagaaccgaacaaggactgacttgctttcaagggaggatcaaggctgcattcaagtggaaaaacttcaggagaaggtccatgatcctgctggcaaaggtggtcctgtctttggtgctggcaaagatgaagacaaacaagaccttggagttactggcacaggctaattaacctactatatatattactactatatactatatagtgtatgagtatagtatatacccaaaaagtactagtctctcttgtgatcatggtgctacc

SEQ ID NO: 6443 - DNA, 393 bp, Glycine max
gacccaccattgcaagaaacaacatgccctcggaggacccttcggacgccgaatgggagctgttcttggagaagccggaggtgattatgctgaagtgcttcccgtcgcagattcaggccaccaccgtgatgacggtgctggacattctgtcaaaccactcgccggacgaggagtatctcggggagacagtggagccggcgtgggaggaggagccgcttgtgaaggccgcgtttgagaagtttagagggaagttgattgagcttgaagggattatcgacgccaggaatgcggataggaccaggaggaaccggaacggtgccgggattgtgccctatgaacttctcaagccttcttcggagcctggtgtcacaggaaagggagttccttatagca

SEQ ID NO: 6444 - DNA, 420 bp, Glycine max
  misc_feature (392)..(392): n is a, c, g, or t
  misc_feature (395)..(395): n is a, c, g, or t
  misc_feature (401)..(403): n is a, c, g, or t
aggccaagaaaaagagaaccaccaagatgaaaactggaacaaagagaagcaacaagggtggtggcggcagaggaggtaacaccaaaggtagcaacaaaatggacaaagtgagaagagccaaaatcaacaccgagtaacttaccatgcatgcacaatttctagctttcttagaagctgccacgtttggctccaccaaattcttgtgtgtctctccacctacttgatcacgaggatgcaccatcatcatcttcacctaataataacccttgttgaaaaaaccacattgagaggcaaagagagtgaagaatatgataagtgattgatgagtgagtagctagtgaggtgagtgaatatttgaggcaatggatttggacttgtctcttgaaattttntgngcagcnnnttgataatggttaccat

SEQ ID NO: 6445 - DNA, 409 bp, Glycine max
agctaacgaagctagtactgtgcaaatggatgacaatcaggctaatcaagaagagcaactccagaagttagttcaggaaagggtgaaagaaattcagttgattgcggaaaaggtaaccctgcatcttgggagctcagggttggtggttaattagatttgtccttcccaagatggcatgggatgaaaaggtcatgcatctatgatattgtgtgattttttttcctgtggaccaattagagtttgtttttctggacaatcactcagtagtgtatttgggttcttccttctaggatgttttaagattctcttatagtagtctgtgaaggaaccagtgatctgttaagctgtaattactgagattaaccacaacaaagttgattgagtgacattcagtggttattgtccattc

SEQ ID NO: 6446 - DNA, 355 bp, Glycine max
tattggacgaagaatatcgctaactagtaattttcacaacaggggaggtcattccaaaagtttccgagattttggggacttcagaaaatttgaccctttgggagttctcatataattgtaacgcctccctattaaaaaaatgtccaagatgatgtaattttcaagaacctcaaagaggaaggaataacattgtacgggagacataaccgaggaaagctagggtaagcaaagtcaatgatatctagaaatggttccctatttattgagcatttgtaaattttatttataagaaaatccgatttgggtcatcaagttaagaagaaagtttagaattaagtggaggaaaaaaatgaat

SEQ ID NO: 6447 - DNA, 559 bp, Glycine max
  misc_feature (117)..(117): n is a, c, g, or t
  misc_feature (330)..(331): n is a, c, g, or t
  misc_feature (377)..(377): n is a, c, g, or t
ctccaacgacttttcaaatcaaagccgcatgtaattttccttgacgtaggcatgactgctgaactctctggcagtgatcgggtaaatttattggaatttttcaaagctgttgctcancgagatggtcggacagctgcagagtgcacactcaagttatcaaagcaacagaactgtccaaatccaaaggcctttgttgaggtaatttatttagtttgcaattgttttgtaggaacctgactttattgatttctcatttccgttgagcattacatgaagattcataattttaaaaaattaatttgtcatgtagaagtttgtggttgattgacnnctgcatatggaacatttcattttatgacaattgtattttgtttttngtatttcatttactttgaaatccttggttatgattctgtgccattttatacattgggtttgctcgttgtttctaacaggaaatggaagagtcgtttactttttggggcactccagaaggtgatctggtccatcctgccgagtgcatggagcaattgcttgagaaagttaggcgtcataaagt

SEQ ID NO: 6448 - DNA, 351 bp, Glycine max
tactgatcatatacttttggtggaagacagatagaatttcaaataatgtggatgaggtactttcggaaaatgaatggaagcatgtagtggtctctattgatatttgatttcaaatggaacccaatagaaccatttgttgtgcaaattggactccatgtaatcaagccaaaaagtagcatggatgatattcgattcactgatccttataaaccaaccattttttaaagaaaaacatattgttggacatgggagtttcgcagagaccattgtgcagatgcagaaagatttggtgtcacttgattcattgcaaccacttttaaaagggtggagagtggtattcattgcttcaaa

SEQ ID NO: 6449 - DNA, 552 bp, Glycine max
ataaattgcaaggagaaaaggtctaaacataatgctcgccaggcagagaaagagataatttcttctgtagtttttactgtgtgctatgatgttttctctgggtttgcacacttcaatcgcacaactcaacaatcattggacacagcttcacgctcatacttgcttcgttggtaatatttaatttatacatcagtgttactggtttaagtttctttgtctgcctacaattactattaaccttgtgtgttatttattctctttttaacatcctagtcagggtttgctaagtatttgtctgcaatatcactgggctgcttatgacaattcagggtaggctggttctggtttgatggattcttttactcattaaatattgtggatcattaaatagtgcctgtttgcagtgaatcactaaatactgtggatcatgcttcatttgacaaccatacatcatatatgggaagtataaatggacccaagttacctctggtgtttgaagtgcaacagatgtcacatgacttaactacagaaggatgtccaaagagtgatttc

SEQ ID NO: 6450 - DNA, 360 bp, Glycine max
  misc_feature (12)..(12): n is a, c, g, or t
atcgcgggaacnctaggtttcatggtaaaatgatggattctaggcccaaagatgatggaactgttgaggtgctttatacgccagttggtggtgcaacgccggcgcctatgtctcttagagaaggggataagttaaagaagtatgatttggaggatttgaggaagactccgaatccgttttatttagaatcagggaagaaagctgagaatggttatagctttgttaagacaccgtcccctgctccgggtgttgatgaatccccgttcattacttggggagaaattgaggggactccgctgaggttggatctggaagatacgccacttgatattggtggtagtgctgatggacctcattaaa

SEQ ID NO: 6451 - DNA, 551 bp, Glycine max
agccttcaactgtcgtcgattccagacatacttatactaccttcagacatcaagtactttgtcaaggtaaatgtattcacctattgtacgcttcattttctttcaaaaactatcagataagcctgtgatcagggctgccagcaaagagagttggatactatcttttcatagtagaatgtttagaaattaattcaccattgcgcaggtgcttagtagcgaaaatgaagggattaaccacacgaaatgcatagccgtcaatccgggaagactagccaagggagaaggagggggaacttttgttgagcttgattattgtgggggttccgaccaaattaacgcttcagttgttggcatatgaatattgaagatgtgttttttttaaggtaaccatttagtttagctatagtcgctgaggcacagaaactgcgtatgactcgtgcaccgttatattatatagtttgtaacctgcataatttaagtttgttaaacgaaaattgtaaagttaattccttcaaaaaccacaccggccggaccagcggtttaattgacga

SEQ ID NO: 6452 - DNA, 423 bp, Glycine max
ttagtgcagtgtttcaggtacatagtctcaagtctttccaaactttttgaagataatttgaatgggacacaaattgcacataaagctggcaaattatctgtatttttgggtgtactacttttttactgatatgagaattggacttgattagcttcaacatctattgttcaacgcaattttaaaaaaagaatagctttattcctcactcatccctaaggctcttttttcataccccctccccttttaactattagtattaggtttatttttgaaactgcactcacaaaaattataactttgttcttgcagttaaacattatacaggataatacggcttcatagggttgaggttattcaatttttctgctgatgggattggcgactcagaatcctgaacgttagtatgtacattcatcgtccagg

SEQ ID NO: 6453 - DNA, 350 bp, Glycine max
tgtgattccttgtgaatgattcccaacctcaacttgtgtagaatcttctattcttcaagttctcaattttgtgttgtttgggctctatgttgttgcatatgaagctcatagatttcaagttgatactcaagtctaggagtgggtaacagaagacttagagatacacatgagggtagtataaagttcccacacaatagggtccagatgcagaaaccacgtctattgcagaagtcttaaatgaattaatgctggatcggaagcacatgttgcaaatctcttggtgcaaaacaaagataacagtccaaagaagatacttgtgtttatgatcaactagacaatgttgcaaatca

SEQ ID NO: 6454 - DNA, 380 bp, Glycine max
agggggcagatgacaaggcgtttaggtgcgtgtaccaggaacaagacgaggtcggaaaaaccggtgtttctttgtccaaggatctcatggctattgctggtggggctcttatgactaacataaccacgttgggtccccttgtcttgcctataagtgagcaatttctgttctttctcacacttgtggtgaagaagcttttcaatgccaagatgaagccttatatccctgatttcaagctcgcctttgaccatttctgcattcacgctggtgggagggctgtgatcgatgagctggagaagaatctgcagcttcggccggagcacgtggaggcttcgaggatgacgctgcataggttcgggaacacttcttcgagttcgatt

SEQ ID NO: 6455 - DNA, 802 bp, Glycine max
aactcccctggtccttcaaagcttagggttgccacaaaacaaactcttgcaatgtttcaggacaattatccagaaatggtggcaaaaaatgtaagttctttgcctttcttttcctttttgaattgtttatataatgtgatattattttgatgttctaattttgatatttgtgtttcattgtagattttcatcaatgttcctttctggtattatgctctcaatgcacttttatcccccttcttaacccaaagaacaaagagcaaatttgtggttgctcgtcctaacaaggtcactgaaacattgaccaagtatgctctcccatcctatccattaaattaaaaattttgttcattggaaattttcaatagcattcaattaattatcttaatttctttgcattaaaaaggtacattccaattgaggagatcccagttcactatggtggtttcaagagggaaaatgattctgagttctcttcccaagatgttgctgtttcagaactcattctcaaggctggatcaactgcaaccattgagattcctgcattggaggtaccaactaattccttagatgtcttttggtgttgttctctgaccaaaattggagttttacattgaaagtagtttatactaacatttaatgcaaacctttattatgtggattatcaaaattaaaactttaattttgatttgaaagcaataacaaaaataggagtgttggactaaaaaggttgtacttgtttgcatcatcattataggttggatactctttgtgctgggatttgactgttctgggttgggag

SEQ ID NO: 6456 - DNA, 600 bp, Glycine max
aaaattcttctgatcgtgagcagcaggtacacatcgaatccacgtttgtttgctgcagttgcatttttgcttgtgtaacttggatattggccttttcatttattttttctctttgaagtaatcatgttgttacatatttctcacccgattatgttgtgcctttatattcaactcccacaactctccatttgaaccaatttgtgtgttgtgctaactgggtcagaccatgatttgatgcagcaagaggttgaactgagcaaacagaggcacgagggagatctcaaggagaaggagaggcttgttcgcatgatgggcaataaggttattttcaacaacttttttgcttcttgtctgtttcttggccattatcgtaggcaaaatgtgttttctatccttttatttattgcaaacttttttttggaggacattacaggctatgatgtgtgaagaccttttcttgactatgaaaaattgtcattggacatcaaattagtggaactatcaattattatttaatttaattcacccaataaaaatgggttcttgccttgcactttggctgatatcttttcttgtgattgactatgcaggagatatatc

SEQ ID NO: 6457 - DNA, 367 bp, Glycine max
agcgctgtacaggtccagatccaagctatcaacaaatttccccatgcctcccgttcatataagcacatgtatatttgtgttgtgtcataattttttgatatatagttatgattatccaattttggaattctgtgatgtagtgtttcgagttagtttccccatttataatgcagttcatctgtgtccagtatagtaacatgtatacgtgagtaaaatcatttcagtgtacagttttcaccatcaactttgcccatcgatttactctttctttatgataattgttcttgttatggtgagcaagcaaattgaaaacttagtgtcgtaattaaagtgatacaaaagacgtcaacagacctgcatctagctt

SEQ ID NO: 6458 - DNA, 886 bp, Glycine max
tgttgaaacaagtggttcagatagtagttctgcaaaaggaaagaatgttgttgataatatggataatggagagctttcaaaatcgaatgagcgtcttaaaagaactgcagttgaggaaaatccagaggatgaaaagattgaactttcacaaaggagaaaacgaaaacgaacaataatgaatgataagcaggtgatgctgattgagagggcactcaaagatgagcctgatatgcagcgaaatgcagcttcacttcaatcatgggctgataaattaagtgggcatgtatgttaaatgcaaataaactttttgagtaatatttaattgacatattttcctgatactcttgcgtaatgctttccagggttccgaggttacatcttcacagcttaaaaattggtatgcctctatatgtagcttatcatatagtttgttaagttgttgcttgcttctcttgttatacatatcagatgatatagtcaaacatctaggatgaagtcatatatcatggtttctttaccaaattatattgaatctcatttgttatcttatccaaagctgtaaactaatattaggtacggatctgatttcgttattttattttaacattgttttgtgtcaagaaatgaagcgttttggaagaggagcattgaatttactggtctcttaaatattattgtgcaatttgcggatattgacacattacttggttgtgaaatcttaaatatattaagcaattggctgcatatacacatgatttgttgtattaggttgaacaatcgaaaagctaggctagcttatatggtttgatttgtaactgaatttcatgtttgttgtattaggttgaacaatcgaaaagctaggctagctcgcacagctagggatgtt

SEQ ID NO: 6459 - DNA, 245 bp, Glycine max
gtgcttatactgtagaaattttgcttacatccttctgattgaaaggaaaaagaaaatcatttgagaacttgtgagaaaaaggaaaaataccttaaggctttgaaaagatagtcaagaagtagagtgcaatgtttgtttggaacgtgttctgtccaaacctaaaccagctgattgtaagtttggtctgcttcctgaatgtgaccatgctttctgtttatcctgtatccgcaattggcgtaatagtg

SEQ ID NO: 6460 - DNA, 533 bp, Glycine max
  misc_feature (370)..(371): n is a, c, g, or t
  misc_feature (373)..(375): n is a, c, g, or t
  misc_feature (496)..(497): n is a, c, g, or t
  misc_feature (499)..(504): n is a, c, g, or t
  misc_feature (520)..(521): n is a, c, g, or t
  misc_feature (523)..(524): n is a, c, g, or t
acctacagacacttgatttaaggtattgttgttttttgaagaaaatacctaacataatttggaagatggtgaacttgagacatctcctcctgtacactccatttgattctccagatagcagccatctacggatggatacattaaccaatctacaaaccctaccgcacattgaggctggaaactggataggagatggtggtttagcgaatatgatcaacctcaggcaattggggatttgtgaattatcaggacaaatggtgaattctgttctttctactgtacaaggattacacaacctccattcactgtcactatcacttcaatcagaagaggatgaatttccaatctttatgcagctgtctcagtgcannannncggattggaagttcatcctcttctgattgaagtgatagtgacagtgaatggaggttgtgtaatccttgtacagtagaaagaacagaattcaccatttgtcctgataattcacaaattcccnntnnnnnnggttttattttcttgnncnntctcctatc

SEQ ID NO: 6461 - DNA, 369 bp, Glycine max
ctataactccaaaaggcaatttgttttggtgtgtaacttggtaatttcttgtagtagttgtgcttttcacctgacatggatgaagccattagcacgtttccaattaagtgaattgcatgccacatttgttttctcagttgaggcagggaggcagcttaaatttggagtacgctttgtgtttattgttattgtgttcatttaggaaaggaaagcatgcctgtggtggagactagagttgcattttagtctgcagactttctgtctgagttcccccctcctaatattaggtttctttcctcagggccgtgtaactgatcatacagttggtatcacttatcactcggtagatgatgtgatgcaaggtgaaaa

SEQ ID NO: 6462 - DNA, 1263 bp, Glycine max
  misc_feature (1145)..(1147): n is a, c, g, or t
  misc_feature (1208)..(1211): n is a, c, g, or t
  misc_feature (1252)..(1253): n is a, c, g, or t
ttgcacagtacaacttctgattgcatccaaagttgagatgttttctcctttgaggagtcagcagttgcaagaattggttaagtgtctccggaaaacagcatcatcacgtgaggttgtggatctcagcgatatggtgggggatctcattgagaatatcaactttcaaatgatatttggctgcagtaaggacgatagatttgatgtaaagaaccttgctcatgaaatagtgaacttggcaggaactttcaatgttgcagattacatgccttggctacgcgtgtttgatcttcaggtatgaaattcagctagatacagtaaacacttagcatatcccgtatcatattacttttgattctgatcaagtggtcatgcttcataatttgttaacgatcattcaccctcatctgaatttttggtctcaatatggtctcctaagcttaaagtttcactttggtttgaaatgtctctattagattatttaactacattgatcattcaccctcatcatgacaccagtttacactaatttggtcaacttggtgatacatgacaaactatgaaagatgtcacgtcagatgtgttggagaaccagctgatggagtcttaagactatacaagcaaacaacagatgatacagagtaaaacaaagaagattggtagagaaagataacagaaagtattattgattgtaaactgttttttgcacacacatttacattgcggggtgtatatttatacgtacaaggaaaagtaaaacagaaaactaaagagcaagttgttataaccaactaacaaattagttagttagttgctaatcatccttattggattacaacggtcaatgaatgtttgtcatttcagccaaaattaacacagttagtgcaagaaacgaaataactattttggtcgaacatagacattataaggaaccaaaatgaaaccattaacacttagaagaccaaactgaaattaaaaatacagagaccaaacttatattttaaccataattttaacttatgattcattttatctcttcatgattgtttttatattcttctcatctaagtgtttcctaacatccaaactattagacaatcatgcagaatgagttccactaatgctttaattttaggatgtgactttcnnnttcattattcactctatttttcattaatgattgtacttaccctgaaataatgaaatattannnntgttattcaatcacttgcacattaggaactagtaaggcgannaaagaaagta

SEQ ID NO: 6463 - DNA, 884 bp, Glycine max
cagcgcactcagatgaaggtacataaatacacgtggtttttgcttctttttttgtttttgtttgttgaaaagtgaaaaaggctttgaaccctttacgcgtgtgttgttttttgttacagacccaacatgaacgtcatgagaacacacagctgagaactgaaaacgagaagcttcgagcagataacatgaggttcagggaagctctcggcaatgcctcgtgtcctaactgtggtggaccaaccgctataggggaaatgtcattcgatgaacatcacttgaggctcgaaaatgctcgcctgagagaagaggtaccacaatttggaagctgctccaactttgcactgagaaacctttttttttcataaataactaaaaaaaacatcatcttaatttcacttcattttcatatatacaattgcataagaatattaacaaggttttatcatttctactatttgttatacaaatttttaagaataacaaatagattaaattaaatagaatgacattttcataattattagtaaaattgagaaataaaaaaaatcctaaactcattggaccaacttggtgattggtttaagtggtaaatgtttaattatctttaaataaagtcttaaatttaaatcttttatataaatgtttgtcatttaaatatgattgtctctgataaaaaatacatatgatttagaaccaagaggatagttaattagttgagtgttttgttaattcttatatatgttggtgttaatgtcagattgataggatatctgccattgctgcaaagtatgttgggaagcctgtggtgagctatccacttgtttctccttcatctgttcctcctcgtccactagaacttggggttagtggtggttttggtggcc

SEQ ID NO: 6464 - DNA, 537 bp, Glycine max
tattggtaagtatgaataagatatataatgcttactgtgtatgcatcagctagccatcgtggctcttatttagtttctggacgaaggaattcttacacattttcagtttaggataaaactgctttcttggttagcattattatgtaagttcatgtgacaattaaatttacaatatgattcaggtggaccattcaatcattgagagctttgctcagggagggagaacagtgatctcatctagagtttatccaacagaagcaatatatggagctgcaagattgtttctgttcaacaacgcaacggacataaacatcaaggtctcgctcaagatttggcaattgaactcagctttcatacgcccctttccctttgaccagaagttgtgaaagtcaaagctatggatgcacatttgcattttattattttgcaaacggttatcattattgccccagcgaagtaaggaaaacaaaacaaatcaaaacaacaaagtcttgtggcatcaacatgtataaattacagctttgtaggcataccgat

SEQ ID NO: 6465 - DNA, 408 bp, Glycine max
attgcctgcgaaagggttcagtcctagtgttgtgagtttcaacattttgctgaggagtttgtgctatgaagggcggtgggaggaagcgaatgagcttctggcggagatggataaagaggatcagcctccctcggtggtcacttacaacatattgattacttcgctttcacttcatggaagaacagaacaagctttcaaggttttagatgaaatgacgaggagtgggttcaaagcgagtgctactagctacaatccaatcattgcccgcctctgcaatgaagggaaggtggatcttgttctccagtgtctagaccaaatgattcaccgacgctgtcatcctaatgaaggaacgtacagtgctatcgcaatgctgtgtgagcaaggtaaggtgcaggaggctttctttaa

SEQ ID NO: 6466 - DNA, 385 bp, Glycine max
gaagaatccagctacaagagaaaaaggtggggtcaaagaagaagcataacagaatatacatgaaggagcttgctttggcctttctacttctaacagcttcagcaaggagtctcctttctgctcagggaatccacttctacttcttgttattccagggcatatcattccttttagttggtctagacttgattggtgaacaggttgattgaatctgaaaggtaaaaaaaaaaaaaaaaaaaaaaaaaaaaactttatagttggaaaaaaaaaactttccccatttttttccccaaaaaaaaaggggggaaaagttggacccctagaaatcttggaaaaaggccccggggcctcggaaagggtttaaaggggaattttttttccccct

SEQ ID NO: 6467 - DNA, 384 bp, Glycine max
ctaacatgtctatgtcatgtgtcaaacatgcaatacatctcagaaatcacacaactaccacttcactcccacgaagaaaacaaggcacacgcaacacaactagacagaaatatccaaaccaaaaccaagaccaaggatataaaactattttcctaacaattcccactaaaacattcccattggctagccaactgagacagggtctgtgatgaagaaccatccttcagtgcactagcagcagaatcttttaaattccccattctttcacgcattcctataccttcttctccatccatcagacactttatcacctttgcaatttcctccttttccactatgccatcttcattaaattttggcctcaatgccactttaagtccatcg

SEQ ID NO: 6468 - DNA, 378 bp, Glycine max
  misc_feature (341)..(344): n is a, c, g, or t
acgatgctgggacaccaacgaaatggaaagcgaatataagcgttaaaaatagtttgggtggaaatatgggattaaacgtttattgtccccatattgatccaaagcagcactttctgggaactggggcttactatgaatgggtttattctggtggcattccatcgccaggagagacaccatttctttgttactttacatggcaaggtgcctctcactccactgatttgtgcgtcccagataaagataccggttgccaatttgccgattgggaaatcaaactaaatggattgtgtaggtactttggtgccggacctggggcctatgtttgctataaatggaannnnctatgttcctgaaaccaagggattgacatttgat

SEQ ID NO: 6469 - DNA, 396 bp, Glycine max
tcatctataatcactggaggtatctcttgtagggatgtcatgcctccaatatccttccattgaattgaacacctataataagacagaagatgacgtagctttttaagcttactaatctcctctggcatctcagacacatttgtgtctcttatatccaaggtctctaaattctggagcttaccaatggattttggtagactttctatccatgtataccggaagcttaaatacttcaagtggcataaattccccaaattttcaggaacataacctaaaccagaaccttcaaaatcaagtaccttcaatagcatgtaatttgtagggaatttgtttaccatgtcttgacataagttttcatactttcctgtcatgataataattgaccgaatgggtgag

SEQ ID NO: 6470 - DNA, 398 bp, Glycine max
gcgcaggaggcgccgggggtgacggcggcattcatgtcggcgccctccgcgaggtgcgcgtggtctccgggcttcccgccgtgtcgagcaccgagcgcctcgagatcctcgacgacgagcgccacgtcatgagcttcagcgtcgtcggcggcgaccaccgcctcaggaactaccggtccgtcaccacgctccacggcgacggaagcaacggagggacagttgtcatcgagtcgtacgtggttgacataccggccggtaacactaaagaagagacttgcgttttcgtggacacaatcgtacggtgcaatttgcagtccctggctcagatggctgaaaatatgggaagttaacactgaagattttgttttgtctctatctgttagtgttggaaattggtg

SEQ ID NO: 6471 - DNA, 538 bp, Glycine max
  misc_feature (7)..(7): n is a, c, g, or t
tctggtnagttctataacgagtcttatgttcgtgttgtttttcttttagggtttcccgaagatttaacacctatggctcctaaaggtattgttttaatatttcgaaatccggcttatgaaaattgcgaaccggtggttaagcatctatatttactctctgattaggtactcacatgtcaaagtcaaaccctgttttcgctgttggataatgaaaaatagggattccatgaatgttgtagggattgagattaagtatttctatttgtgctgttaggttaattcttccagtgttactggaatggaattaggtaattatctgcattgtgttgaagattatgctgtttaaaaagtagttagcttttgattattttgtatggagtgtgatgtgtgactagagcaagtgtttaatgcagctgatagtttaaagaaggctgatccaaaggcacaagccttgaaaactgctaaggctgttaagtcaggtgctactttaaagaaaaagaccaagaagatccgaacatctgttaccttccatcgacca

SEQ ID NO: 6472 - DNA, 652 bp, Glycine max
ggttcccttcttgttcttcttccaggtaactcaaatcaattaacaaataacctaaaaaaatttataccatgaaatttaattaaactttaatgttccttttgctttgccttgacattagaactcaactgaattttatcgaacgttttaactgaaaatagtgggttgaatttgtgcgtagaaatggaggtagcagtggccaaagcgttgaaaccgagtttaaggagagagttcatcgttcagcaaatgctctgcgaggatattttcagcctgaacgccaacaccgtcgccgccggcgaagatttctccgtcgacgacctatttgacttctctaacggctctcttcacaacgaacaacaacaagaatacgacgaagggaaacaaagtttatcggcttcagaggaccgcggagaagacgattgcaactccaattccaccggcgtttcctatgattcacttttctccaccgaattagccgttccggtaactctctctctctctctctctctctctctctctctctctcggtttgctcctgttttcaaaccctaattttgttttctaatgattgaaatttgtgtagggcggtgatttggaggacctagagtgtgtctcactctgtgtggaagactctctcccggatctgtcttttata

SEQ ID NO: 6473 - DNA, 381 bp, Glycine max
  misc_feature (283)..(283): n is a, c, g, or t
  misc_feature (286)..(286): n is a, c, g, or t
  misc_feature (298)..(298): n is a, c, g, or t
  misc_feature (309)..(309): n is a, c, g, or t
  misc_feature (316)..(316): n is a, c, g, or t
  misc_feature (322)..(322): n is a, c, g, or t
  misc_feature (325)..(325): n is a, c, g, or t
  misc_feature (327)..(327): n is a, c, g, or t
  misc_feature (332)..(332): n is a, c, g, or t
  misc_feature (334)..(334): n is a, c, g, or t
aaaaggggctaacttctattaacaaagtgacccccaaattatctgctaaaaggcaaagcggcatgtgcaaactcaacaagagaaattgtcaagataaaattgtattaatctagaatcagttgttatttaacagtcaaccgatagtccagccaactaacccaacaaagggataccaaatcagatactataacatactatgttacaataacaatattttagttctactatgggtatcatctgcaacataaaaactacaggttttctgccaaaaaaaaaaactacnggntttcttcttctngggtatcgtcngaacttnggaganggntnaagtnanctctagcctttttgggtggcgaggactcttctgtggcatcaatttcg

SEQ ID NO: 6474 - DNA, 791 bp, Glycine max
  misc_feature (736)..(736): n is a, c, g, or t
  misc_feature (751)..(752): n is a, c, g, or t
atactatacagtcagtgccgcttgaagagccaccaatacctacaacccattaaggaaccccaatcatttcaaatcttcagcataattcgcagtcaatcagttttattacaagacggaaagaccgtatgtctactattgtaatccaacatgacaatattctcaacagtgtcacactaacatagatgacagcatgtaatgtataagaatggatctcacagtgcaacttggtaatccaaatattatactttgctgtattctgacaagtatagatggcaatggtagtgttgtgtaaaaaaaagatggtaatggtagtggattagtggtaacttagtacacatgttcagtttaagggaaaatagcaaattttgggtaagtgttcagattgaagtaactagtaaattagtaatatctaattctacaatctacactatgacaggaaaggattctcctacttcgtctctaagtcttacttttttcaacaagctagtattctgttttaagttttaacaaactaaaagtagagaaaattgacattgcatgttaaccatagaagtccaccattaacactcacttcctactttcctgaaacttttctttaaatagtaatttttttcatgtttcaatttaaagcaggtttttattcaggttctaattttaaaaacaaaaaactaatgccatgctgttgtaataaatgaaatgaaattagatttcagtttatgaaacagaaacaggcagngctttgctgggctannaaaagggttggcaacctttacccccccaacccccacccc

SEQ ID NO: 6475 - DNA, 506 bp, Glycine max
agaggtgagggttgcccctcacttatatattctaatttggctttatttttagctgatgtgggacttgggtttttcccaacacaaacattaaattaacctgtagtattttttgatttaggtatttcgattaccttttctatattgattttgaggcgtctatgactgaaccccgagcacaaactgccttaggacatcttcaggtttgacttcttaatttttttattttatgatttgaattatgtattttgattcttctcttattttatctcctcctaaacttttacaataacccatggaaaaatagtagaaaattttgttcagttgttttaggagtccagcaagcctgtgcagagtagtcctctcatatttttagattctagcatgctaacttaataaaaatttgccaacaattaatatcaaggagagcaagctttggtttggacttctactgtgctcaagagttttcattcttgagttttatgtccttgatttggatgcttgagtat

SEQ ID NO: 6476 - DNA, 452 bp, Glycine max
gagaatggttagggacatttgacacggctgaagaagccgctagagcttatgatcgtgcagccattggtttgaggggtgctcttgcaatccttaattttcctgatgagtactattctcatcttccttttgtattatcaaattcttctactaagggaaatgaaagttcttttgatacggaagttattgagttagagtatttggatgacaaggtgttggaagaacttcttgagttagaagagaagagaagaaatgaagactaagcagtggactattcccttcttttgagatcctttttttttccctccacttgtattaattattatctgaacttgtgatttagggttcagattgatttccaaaaaatctttcccacccattgattgaattaaagtcttgccagactttgtcattctttttcattcttaaatccatcacatgagcctattgatatg

SEQ ID NO: 6477 - DNA, 662 bp, Glycine max
gcgcatatatgccaggcatcactaatggccaagtgagggaatcagcagcatttgtagatcagagtagaacggtaatttattctccatttatattaaattggtatatgtatcttcgtttggccaaggatgtgagatttgctatcaatgcagatgatacccattgggcaactgtcaatgaaaaaactagcaattgtaggacaagcttctggcaagctatggaggtggaaaagaagccaccatcagtggctagtacaatttaaatggaaatggcagaagccatggagactttctgaacggattcggcacagtgatgagacaatcatgagagcaaggccacgttcgcaggctttgccgcatataatgtgaatctgaatgttattgtgatcatccatttgctttggctcagtgttcattttttaacctacaagaatgatcctagaaatcaggcaataaagaaccaaaaactaggtgcaggtaataacccttgtcccatacaacctttcaaaaattatattctaacttatcctacttttgatacaaacatatatgacttcgttataactatccaaaaaatttctatttcctttattggtgaataaagatgcattgatctggcattctgacgctacttatttctaggtgcagggtgtaatattaatgga

SEQ ID NO: 6478 - DNA, 579 bp, Glycine max
atctatgccgaatcatagcactaagaagttcaggcctattaaagcgtgagtcatgttccttgcatatttcattattctgttttcatcttttacattttgattattgaaagtaaaaatcataagcttctacaggttgaagatgattgttatttcattaagtagaatattttgtttgacatataaactaaagtgattggatacattcaacagattaggaagctagaatgtcatgaaaagaggtaagggacccctcaactgctgcaatcaggatctgagtcaatgtagatcggggaagctcttgttcagaattagacgagctctatgtctaaatgctgacttaactgggattattctttaaatcttctgtttcctagactatcatcaaaggctaattaaatattaaatattagtaaatggtgactcaatttggaacaattcctaaaacatttatgtatcttttagtgattggatacatgcatgtttttttaaccagtgctatgaaagaattagagagatttcatggtaatccatcacaattactttcacctcactagattgaactaaaggtcccattctcct

SEQ ID NO: 6479 - DNA, 430 bp, Glycine max
cttactgtcccagagctgactcaacaaatgtgggatgccaaaaatatgatgtgtgctgctgatccccgacacggccgatacttgactgcatctgctatgttcaggggaaagatgagcaccaaagaggttgatgaacaaatgatcaatgtgcagaacaagaactcatcatactttgttgaatggattcccaacaatgtgaagtccagtgtgtgtgatattccacccaggaatttgaagatgtcatccacctttattgggaactcgacatcaattcaagagatgtttaggagggtcagtgagcagttcactgctatgtaccggcgcaaagccttcttgcattggtacactggggagggtatggacgagatggagttcactgaggcagagagtaatatgaatgatttggtagcagagtaccagcagtaccagg

SEQ ID NO: 6480 - DNA, 795 bp, Glycine max
  misc_feature (785)..(787): n is a, c, g, or t
tattatggtacccctgatggcttcgggactccaagtatgtgcttgtaaaaattacttctgaaagatatatgcatgccttttcatttagaatgctttttatttagaagtaaaatgtgtagtatcacataacaaattggaattggcattatttatatatttcagcgggagcttgtggctttggcgaatttggaaggttgatggatgggtatggtggaagagtcgctggggtgtcagggctatggaggaatggagctggctgtggtacatgttatcaggtactaattttttcccttattttcttttcaacaattagttttctttttcttcaatttatctcacgtgtatcacacttgccaatgaaacaaaatattcatgtaggtaccaacaagtatttgattatgagtaagtggtaggaattcaatcccctccaataaaaataacctattaagattattttggcacaacaaacgacactaatgtcatgatataaaaaaaacaaaatatttatgtatactaccaaggattttgcaccaattatgtattaatactcaattaactaattaatctataaagtatatatatgatgatgatgataatgattcaggtaaagtgcctaatgccaaaattatgcgatgtgaatggagtaacgctggtggcaacagactacggtcagggagacagaacagacttcatcatgagcccaagcgccttctcaagattgggagttaataaaattgcatccgaagagattaagaaaaaaggcacagtggatattgaattcaaannnggttccct

SEQ ID NO: 6481 - DNA, 379 bp, Glycine max
agggtattcaacaagagctgaaaaagcaagttgttgttgaggaccagccttcactatcatcacaagaagaagcatcaagtggtaacaaagaggaacaagaagatgaaagaagtgttgaggttcctgaagatggttttgagaaggaaatgatggggctaactggggggtttcctgggggtgagaaagggttgaagaagtttattgagaaaagcaaccctcctactacaaaagctactaataatgttgtcaccatctcgttttgaaagaggccattgtgaagaatattcaaaggaaaatagtgttcatttttattttatgttatatatgtgtctgccattctaatttttgacaatcaaacttggatgaggtttgctctctt

SEQ ID NO: 6482 - DNA, 362 bp, Glycine max
cagcagcagcagcagcatcaagtggaggcaaagagtccaaggcaaggcaccgagaggagtgaagcggttcggtcaaggtggactccaaagccagaacaaatcctcatactcgagtccatcttcaacagtggcatggttaaccctccaaaggacgaaaccgtcagaataaggaagcttctcgagaaattcggcgccgtcggcgacgccaacgtcttctactggttccagaaccgccgctccagatcccgccgccgccagcgccagatgatgcaacagcaggctactgccaccgccaccgccaccgtcaccacctttgatcaccctcagcctcagactcagactcttgttaatgttggtggtgc

SEQ ID NO: 6483 - DNA, 377 bp, Glycine max
ttgtggtccgattgtttgctagatcaagcaaattaacctgtatactggtttatatatcttcaccttgcacctttctctctctctctctctctatctctctctctatatatatatatatgggtttaatctcttactttctttatcttttcactttttttcagttttggtttgatttaattacgtgattaaaatttacatatatggatttgaatatatagtacgtggttttcgagcttggtgttttagatataataacatgatgatgaaaaacaaaactagtctctttttttcttttgttgttgtgttgttgagaagtgagcactgtcactttgtgccttcttttacttgtatatgtgagttggagattgagctttgag

SEQ ID NO: 6484 - DNA, 370 bp, Glycine max
attatccttacaaaagttttatctaaacattaatggattatattaaaccactccttacacaagttttgtctaagacttgaaaaattttaaacacaatccttcccattataacatggatatgctgatatgcaccctttgaaatagtggctatgtatgtggtaaaaagtaaaaagaatgatttgtgtgtcacaaaagttacatttaacattgtaaaatctttattaaatttggttagcctagtctgtcttttttgtacaaattccaactgtgataaaacttgatggcattgttatgcagcccaaatgaatggaattctggagtgacagcaggactgactacaaagaactgctatggtgaaactactccaatt

SEQ ID NO: 6485 - DNA, 381 bp, Glycine max
ttgttcttccctcttcagagaaaatatctccaggtctgacacaaagtagtgcatctagttccaaaaccacgaaattaaccagaagcagaagttgtaaagcaagtctcatgagatatccatcttcagattggtttgaccaggaagaaatgattcagaacgcacccccaataggaagcgaaaaagatttcacaagaagacccgagggccttcaaaggaagacttgtacacatcattctaatgccaatgctaagaggttatcatgggctggctacgcaaattctctgggaagagcttctgatgtacagaatatgaaatcctccatcgataatggaagttataaagacaattctttaccccagggaagaaacggaaagaatgatc

SEQ ID NO: 6486 - DNA, 860 bp, Glycine max
  misc_feature (836)..(836): n is a, c, g, or t
  misc_feature (838)..(838): n is a, c, g, or t
  misc_feature (850)..(854): n is a, c, g, or t
agtgactagataccatctgaagagactagggatacaagctaaagttgcaaatagcatcaataaggctgtttctttatgtgggaaaaatggttctttgacctcggggtaagattttaatttcccttattttggtgtcaaatatgaagatactgaatgtgataataaacgacaacagcatcaacattttagtaattattgttaaacatgcttatgaattatattataattcttaatctctttaaactgagtttgcaatcttcattaaaatgcattttctacagttaaatctgggagtataccaagctagtatctcagcagattatggtcttccatgtataggctggcatatgtagcatagtcttgtctataactaaaatgctaagttttcataatgaagtttttcccctattggagttttatgtggtgttttggggagagctatcttcaacttgataacaaactaggctacttttttcaatatgttatagaatgtgtcttcacaaagcttgacaaattttgaaattttaaactctttttttctgagttttgtttatgtacgtgtggctcagttcattcactgagttaaactggttggttgtggcagattatttcagcccgatattatttttgttgagaaagattcatgggtttgtggagaggacgagatcttcaatgtgtggcaactggactggaaacaaaatgggcatatgtttaagatacctcaaatgatccttcttgcgaccaacatcggtaatgctgaatttgataaagctaaagctgcaggtttcagtgatactgtgatcatgaagcctctaagagctagcatggtggctgcngncttcagcaagtnnnnnacagga

SEQ ID NO: 6487 - DNA, 458 bp, Glycine max
  misc_feature (264)..(264): n is a, c, g, or t
  misc_feature (267)..(267): n is a, c, g, or t
  misc_feature (271)..(271): n is a, c, g, or t
  misc_feature (310)..(310): n is a, c, g, or t
  misc_feature (317)..(321): n is a, c, g, or t
  misc_feature (370)..(373): n is a, c, g, or t
  misc_feature (434)..(437): n is a, c, g, or t
  misc_feature (445)..(447): n is a, c, g, or t
  misc_feature (450)..(451): n is a, c, g, or t
ggattttggaggttgacaggaatgcctcagatgaagagttgaagagagcctacagaaagcttgcaatgaaatggcaccctgataagaacccaaccaataagaaagaggctgagattcaattcaaacagatatctgaatcctacgaggtaacatcatggtccttgatttgttgtgttgtggcggtgttaaagccaaagactatgcttaattttggtcattattactttgccttggccggggtactcaagatgctgatccttcctntcncttnatggataagcctctggaccttggctttaacctctccctngggaagnnnnncctctgccatgggatgcctctctcttgaggaagctatggggaggattgnnnntctatagagccccagtttcagttcatttcattttatgataatcttgcccaatatgattatnnnntgattttnnntgnntgattga

SEQ ID NO: 6488 - DNA, 335 bp, Glycine max
catgctggagctcctgaccgggaaaccgcccggggagccaaccaatggcatggacttgccacaatgggtggcatccatagtgaaggaagagtggactaatgaagtgtttgatttggagctcatgagggatgcaccagccataggagatgaattgcttaacacattgaagttagcattgcattgtgtggatccttctcctgctgctaggcctgaagttcatcaagttctacagcaattggaggagattaaaccagacttagcttcaggggatgatgatggagctaaggcccaagaaactgagtaaagagaattgattctgagtgtgtgtgtgtgtg

SEQ ID NO: 6489 - DNA, 370 bp, Glycine max
atgaaggctcaaaccccatccatcccgccttatacaggcgcttcaactgggccttatggtcctgatggtgtcccaatgggtcctagtggcaaccgtggtcaaggtggttctcttccaatttcatcagaaccacttatgccgtctggttattatgatagtggctctgcttatggtggttatggtctgcaacattattaccaaacatcttatcctcagtagattgagatatcgttttcttttgaatactgaactcctgggttggtggcttggtattagtttctctatgactttgcacttctgacttatagttattaaaagcattgcttgctttgttgatctccatgattaaaggaaaggaactagattcagc

SEQ ID NO: 6490 - DNA, 688 bp, Glycine max
ttcatggcatacggcatcccttctcaccttctctttccctacaatttcatccctgaaaaccatgttcactggacagaaacccctgactctcacatattctcagctgacatccctggtaagcaccaccttaattagtcatgtgggaaaataatgatactaaataaagtccttcccttcaatcatacgtctttttttttctttgtttcggtttgagtaaacagtaaacagtctatgtacttataagtttattgatttttaccataactatcttaataatcatatcatccataatttgtgattgattgatattattttactctaatagtgtataaaaattaaactcttttggttttcctcataatttttattagggtcttttgaacttggtgtctttatttatttatctggtgcttgcttgttgtggtaggtgtgaagaaagaggagcttagagtggaggttgaggactcaaagtacctcataatcagaactcaagcagtggataaatccacagaacctgcgaggaagtttgagaggaagtttaggctgccagggagggttgatcttgatggcatctctgcagggtatgaagatggagttttaactattacagttccaagatcacttagtagaggtttctacattgacccttctgatgtgcctgagaatttggaagttcttgcaagagctg

SEQ ID NO: 6491 - DNA, 798 bp, Glycine max
catcggaatggcagcgaggctcgccgagacaacgttctgtgcgttcagggagtacaccgaggaggagctccggttggcgacggataacttctccgagcgcctcaggttgaagtccggcggggattggaccaatgtgtataggggacgctttaaccattccactgttgctatcaagatgctgccttctttgtcaccccaacatttccaatccaaggtacaaatataagtatttcacatcaatttcttttctttgattgtgttaatctttaatgtattttttttattagaggaattactaaatgaagctctaattctagttgaaaaacaatatcaaaaatagttatgaaatgtaatcttctgtggggtttaataatatgctactcatttgtggtattaatagaatattcaaatcaattgaattaatagacacattataaccataggtaaaaaaagtgaaaagtatttttgttgggtgtcctataaattcccccaattcaattcaaatattgaactaattgtgtctgacccatgatgacatatgttcaatgatcatgttaattttgtttccaaaatttcttgttatatagaattttcaaatagttttttcctcgaaataattataaaattctgtctcagcttgaatttactaatttacaccgcatatttcaggtgaggcttcttggtgatattaggcaacctcatctggttgccatggttggcttttgctccgagcccaaatgcatagttttggaatacatgcgcaatggaagcttacgagacatgctgttttctaggaga

SEQ ID NO: 6492 - DNA, 390 bp, Glycine max
gctcgcacacgacggcgcgaagctcggcgaggacttcaaggtcgtaaccgtcgacgatccgccggagaattgcctccacttctctgtcctctcggaggcgaacgagagcgacgtgccagaggtggagatccacccggacgacgcggtggcgatgccgttctcctccggcacgacgggtttacctaaaggagtgattctcacgcacaagagtttaaccacgagtgtggcgcagcaagttgacggagagaaccctaacctctacctcaccaccgaggacgtgctcctctgcgtgcttccgctctttcacatattctcgctcaacagtgtgctattgtgcgccctcagggcggggagtgcagttttgttgatgcagaagttcgagatcatcat

SEQ ID NO: 6493 - DNA, 409 bp, Glycine max
gagagagagagagaaagagattggttgtgttctgctactatggcgagcaacagagagagagaagaatcgctgacattcacaatcccttcttcctcttcccattcttcccccatcaccgtctccgaccaactcgacagttacctcgccgaccccagaagcgcctccggaagcttccagaacgacggccttctctcctccggagacgcctccgccgccgatcccgacttcggtttctcccgccccgatttccggcagagccccctcgtcggcaccgtcgagttctaccgacgccacgtcttcctttgctacaagaacccccgcgtctggccaccgcgcatagaagccgccgagtttgatcgcttgccgaggttgctccatgccgccgttgttgcaaggaagagtcacatga

SEQ ID NO: 6494 - DNA, 372 bp, Glycine max
gaattttagttatccaaattatgtaactatgcatttgcaataatacatgatctcaactgaacttcttgctcatgaaagaagggaaaagttgagatgaataaattagaagaaaaaaaatattttactattcactttcttttaccaataatccccacaagagcaagttccatttgcgaaatgatggaaccttctaacatctctaagaatgatttccctgtccataatcttagatatgattttagtggcaacatggcagtcattgcaaacccgaaggtttttggcaactctgatggtagttcctggaggggtatttaaaagaccaaaggctattgccagtctctcactgtgcccacagagcatagtttctttcta

SEQ ID NO: 6495 - DNA, 736 bp, Glycine max
  misc_feature (699)..(700): n is a, c, g, or t
  misc_feature (706)..(713): n is a, c, g, or t
  misc_feature (715)..(715): n is a, c, g, or t
gagaaaacattctctaacagtcaagtatttgatcaattgtcaataaatattgattttccaagttgaaactggtcacgatgtcacctgaatgcaataccgaatgttttggctcatgaatcctgactggtccatatcatcttcagtggatgattatagccggttttatttggattttgctgtcagttttgtataacttattatgactcaaatggcccacatcctttatttattggaagagaattcaatttttttgccttttgatgctgactatgtatgggataatcttattatcaatgggaactgagattagacatggtattataaaatcttatttcaagctagaatatgattgtgctgtcattttaatttagataatttcctcaaattctatctcaagacttattggcttgcgcttggcaaatttgcaggaggcggcatccaatttcttgaagatttagtagataagggagctcattggagatgggttctttagttgcttgcctgacttttattcatggcatgcgtcaacagaggatatcagcttttgcagacagacaagtatatctcatcgatattgcccttgtctgtcacaccacaaagcgagatagggacaaggaaaaaaaggagggaaaacctgttaatttaggaaaattgatagtgtttcttgaaccatttatttaatcgtctactgagttggcnntaacannnnnnnntnggggtgcggctatttattttg

SEQ ID NO: 6496 - DNA, 1436 bp, Glycine max
  misc_feature (376)..(379): n is a, c, g, or t
  misc_feature (381)..(381): n is a, c, g, or t
  misc_feature (383)..(383): n is a, c, g, or t
  misc_feature (388)..(390): n is a, c, g, or t
  misc_feature (534)..(534): n is a, c, g, or t
  misc_feature (654)..(656): n is a, c, g, or t
  misc_feature (658)..(665): n is a, c, g, or t
  misc_feature (669)..(671): n is a, c, g, or t
  misc_feature (675)..(675): n is a, c, g, or t
  misc_feature (678)..(678): n is a, c, g, or t
  misc_feature (680)..(691): n is a, c, g, or t
  misc_feature (697)..(702): n is a, c, g, or t
  misc_feature (707)..(711): n is a, c, g, or t
  misc_feature (715)..(725): n is a, c, g, or t
  misc_feature (727)..(727): n is a, c, g, or t
  misc_feature (737)..(737): n is a, c, g, or t
  misc_feature (742)..(749): n is a, c, g, or t
  misc_feature (751)..(762): n is a, c, g, or t
  misc_feature (784)..(794): n is a, c, g, or t
  misc_feature (796)..(804): n is a, c, g, or t
  misc_feature (808)..(818): n is a, c, g, or t
  misc_feature (820)..(824): n is a, c, g, or t
  misc_feature (837)..(837): n is a, c, g, or t
  misc_feature (841)..(853): n is a, c, g, or t
  misc_feature (855)..(855): n is a, c, g, or t
  misc_feature (857)..(863): n is a, c, g, or t
  misc_feature (872)..(884): n is a, c, g, or t
  misc_feature (887)..(891): n is a, c, g, or t
  misc_feature (895)..(895): n is a, c, g, or t
  misc_feature (899)..(901): n is a, c, g, or t
  misc_feature (911)..(919): n is a, c, g, or t
  misc_feature (933)..(938): n is a, c, g, or t
  misc_feature (941)..(941): n is a, c, g, or t
  misc_feature (944)..(963): n is a, c, g, or t
  misc_feature (969)..(977): n is a, c, g, or t
  misc_feature (979)..(983): n is a, c, g, or t
  misc_feature (985)..(996): n is a, c, g, or t
  misc_feature (1008)..(1012): n is a, c, g, or t
  misc_feature (1014)..(1019): n is a, c, g, or t
  misc_feature (1021)..(1031): n is a, c, g, or t
  misc_feature (1033)..(1039): n is a, c, g, or t
  misc_feature (1042)..(1046): n is a, c, g, or t
  misc_feature (1051)..(1054): n is a, c, g, or t
  misc_feature (1056)..(1056): n is a, c, g, or t
  misc_feature (1058)..(1061): n is a, c, g, or t
  misc_feature (1063)..(1063): n is a, c, g, or t
  misc_feature (1065)..(1066): n is a, c, g, or t
  misc_feature (1068)..(1070): n is a, c, g, or t
  misc_feature (1072)..(1075): n is a, c, g, or t
  misc_feature (1077)..(1077): n is a, c, g, or t
  misc_feature (1080)..(1085): n is a, c, g, or t
  misc_feature (1087)..(1100): n is a, c, g, or t
  misc_feature (1107)..(1114): n is a, c, g, or t
  misc_feature (1116)..(1126): n is a, c, g, or t
  misc_feature (1130)..(1132): n is a, c, g, or t
  misc_feature (1134)..(1149): n is a, c, g, or t
  misc_feature (1151)..(1159): n is a, c, g, or t
  misc_feature (1162)..(1164): n is a, c, g, or t
  misc_feature (1167)..(1169): n is a, c, g, or t
  misc_feature (1171)..(1172): n is a, c, g, or t
  misc_feature (1174)..(1174): n is a, c, g, or t
  misc_feature (1176)..(1180): n is a, c, g, or t
  misc_feature (1187)..(1190): n is a, c, g, or t
  misc_feature (1192)..(1192): n is a, c, g, or t
  misc_feature (1194)..(1201): n is a, c, g, or t
  misc_feature (1207)..(1209): n is a, c, g, or t
  misc_feature (1211)..(1214): n is a, c, g, or t
  misc_feature (1218)..(1234): n is a, c, g, or t
  misc_feature (1239)..(1253): n is a, c, g, or t
  misc_feature (1255)..(1261): n is a, c, g, or t
  misc_feature (1263)..(1272): n is a, c, g, or t
  misc_feature (1274)..(1283): n is a, c, g, or t
  misc_feature (1293)..(1300): n is a, c, g, or t
  misc_feature (1302)..(1312): n is a, c, g, or t
  misc_feature (1320)..(1322): n is a, c, g, or t
  misc_feature (1324)..(1343): n is a, c, g, or t
  misc_feature (1346)..(1361): n is a, c, g, or t
  misc_feature (1364)..(1373): n is a, c, g, or t
  misc_feature (1376)..(1378): n is a, c, g, or t
  misc_feature (1380)..(1384): n is a, c, g, or t
  misc_feature (1393)..(1419): n is a, c, g, or t
  misc_feature (1422)..(1433): n is a, c, g, or t
aaagtcctaatatacaatacaacaccagcagtgtacgctcacaaaacatctctaaacgcttgtaaagatctccatctcccattgatcctcctgaagtttttgtattcaaccatggctacctatagttggtcaactgagatattttcatttttggttctaacgttgttgtcgacaagcagtcacacaatggttgctggagcacgcaatcttctcgaatcaaccttgtcaaaaccagaagtgccaacacttcccaaacctcatgagttgccaccattgccggaaatccctgaattgcccaagtttgagtcgcctaagatccctgcactcccgaaacctgagctacctaaggtccctgaactgtctaagcctgacatgnnnngngnatagnnnttgcccataagggatgttagagctagtataggcgctggatttatttatcctttagttggaacaatgattacgatgccagggcttccaacaaggccatgcttctatgacattggtcttgatacaacaactgaaaaagtcattggnctctcttaaatcaaagtcgacttgctctatcacctttcaaaagctttatggatgtcatttacatatccctttgcgatgttcatgaatgtcacagtaacattcctccttgtttgtttgccnnntnnnnnnnntcannnatanagngnnnnnnnnnnnnaccccnnnnnnccccnnnnnactnnnnnnnnnnntntcacacatanttcannnnnnnntnnnnnnnnnnnncccttcaactatctctactctnnnnnnnnnnngnnnnnnnnncccnnnnnnnnnnntnnnnncagcttccaattngcannnnnnnnnnnnnanannnnnnnaataataannnnnnnnnnnnnaannnnntaantatnnntttgcccctnnnnnnnnnacctccctgccccnnnnnnctnccnnnnnnnnnnnnnnnnnnnntctccnnnnnnnnnannnnncnnnnnnnnnnnntgtcactctttnnnnncnnnnnncnnnnnnnnnnncnnnnnnngcnnnnncgtcnnnnancnnnnancnncnnncnnnncnccnnnnnntnnnnnnnnnnnnnntcactcnnnnnnnntnnnnnnnnnnntgannncnnnnnnnnnnnnnnnncnnnnnnnnngtnnnacnnntnnancnnnnntcttacnnnncntnnnnnnnncttccnnncnnnncccnnnnnnnnnnnnnnnnncctcnnnnnnnnnnnnnnnannnnnnntnnnnnnnnnntnnnnnnnnnnctttattatnnnnnnnnannnnnnnnnnncaatcacnnnannnnnnnnnnnnnnnnnnnncannnnnnnnnnnnnnnntcnnnnnnnnnntcnnncnnnnncttctacannnnnnnnnnnnnnnnnnnnnnnnnnnctnnnnnnnnnnnncac

SEQ ID NO: 6497 - DNA, 356 bp, Glycine max
agaaactcctgtagcaggtgtaagtactcagaagtctgctggagcaagtttaagtactcagaagtctactggagcaagtttgagtactcagaagtctaatgttgcacctgaaacaaccaaccaatctgcaccagcagaggcagagccaaaacaaattgaagcagctccatcttcagcaaaagaaaatgggaactctcctcctacttctacaaaagagaccttaatggaagaaagcattcgagttacacgtggtagactaagaaaaacccgatcagcaggaactcgctagcaaatgaatattgtcaatttttagtctgaaataggggtaggtggacaatgatgggcattgaattgat

SEQ ID NO: 6498 - DNA, 542 bp, Glycine max
ggggcatcattggttgcagtgaatgttactggaaatgccatttatgatcccataggttctattgtagttggcaacttacttggaatggtaaagaggattcagaagacagcaaaaattccccgggcatttgaagtggtatctattttattttaattccattctgaattaaccatgcaggtagccatatttcttatccagagaaaccggcatgctttgattggtagagccatggatgaccatgatatggagaaagtacttcagtttttgaaaaaagacccggtacaagctttttgctagtttctatggaaatcacataataatttttttgtcattcatttgactaaggtgaatttttgctttaggttgtagattccctctatgattgcaaaagtgaagttattgggcctggattcttcagatttaaggcagaaataggttcctttctcatctttgttacagaattcagataatgaattatgcatgatggtgttaagctgatcattcttaatgaaacagattttaatggagaaatggtggtgcaa

SEQ ID NO: 6499 - DNA, 946 bp, Glycine max
  misc_feature (327)..(329): n is a, c, g, or t
  misc_feature (334)..(340): n is a, c, g, or t
  misc_feature (344)..(346): n is a, c, g, or t
  misc_feature (350)..(355): n is a, c, g, or t
  misc_feature (361)..(367): n is a, c, g, or t
  misc_feature (372)..(378): n is a, c, g, or t
  misc_feature (380)..(385): n is a, c, g, or t
  misc_feature (389)..(399): n is a, c, g, or t
  misc_feature (404)..(404): n is a, c, g, or t
  misc_feature (406)..(413): n is a, c, g, or t
  misc_feature (421)..(435): n is a, c, g, or t
  misc_feature (438)..(450): n is a, c, g, or t
  misc_feature (453)..(455): n is a, c, g, or t
  misc_feature (464)..(476): n is a, c, g, or t
  misc_feature (480)..(482): n is a, c, g, or t
  misc_feature (484)..(486): n is a, c, g, or t
  misc_feature (490)..(496): n is a, c, g, or t
  misc_feature (499)..(516): n is a, c, g, or t
  misc_feature (518)..(518): n is a, c, g, or t
  misc_feature (525)..(527): n is a, c, g, or t
  misc_feature (538)..(542): n is a, c, g, or t
  misc_feature (546)..(548): n is a, c, g, or t
  misc_feature (555)..(559): n is a, c, g, or t
  misc_feature (563)..(570): n is a, c, g, or t
  misc_feature (573)..(579): n is a, c, g, or t
  misc_feature (585)..(588): n is a, c, g, or t
  misc_feature (590)..(595): n is a, c, g, or t
  misc_feature (597)..(600): n is a, c, g, or t
  misc_feature (602)..(602): n is a, c, g, or t
  misc_feature (604)..(605): n is a, c, g, or t
  misc_feature (609)..(612): n is a, c, g, or t
  misc_feature (619)..(626): n is a, c, g, or t
  misc_feature (628)..(631): n is a, c, g, or t
  misc_feature (633)..(639): n is a, c, g, or t
  misc_feature (642)..(647): n is a, c, g, or t
  misc_feature (651)..(651): n is a, c, g, or t
  misc_feature (661)..(667): n is a, c, g, or t
  misc_feature (669)..(679): n is a, c, g, or t
  misc_feature (687)..(688): n is a, c, g, or t
  misc_feature (692)..(696): n is a, c, g, or t
  misc_feature (699)..(700): n is a, c, g, or t
  misc_feature (705)..(715): n is a, c, g, or t
  misc_feature (717)..(718): n is a, c, g, or t
  misc_feature (721)..(721): n is a, c, g, or t
  misc_feature (728)..(729): n is a, c, g, or t
  misc_feature (736)..(738): n is a, c, g, or t
  misc_feature (742)..(754): n is a, c, g, or t
  misc_feature (758)..(758): n is a, c, g, or t
  misc_feature (760)..(760): n is a, c, g, or t
  misc_feature (764)..(775): n is a, c, g, or t
  misc_feature (782)..(784): n is a, c, g, or t
  misc_feature (788)..(801): n is a, c, g, or t
  misc_feature (804)..(806): n is a, c, g, or t
  misc_feature (808)..(809): n is a, c, g, or t
  misc_feature (811)..(815): n is a, c, g, or t
  misc_feature (818)..(829): n is a, c, g, or t
  misc_feature (834)..(834): n is a, c, g, or t
  misc_feature (840)..(854): n is a, c, g, or t
  misc_feature (856)..(863): n is a, c, g, or t
  misc_feature (865)..(869): n is a, c, g, or t
  misc_feature (875)..(881): n is a, c, g, or t
  misc_feature (883)..(883): n is a, c, g, or t
  misc_feature (886)..(898): n is a, c, g, or t
  misc_feature (906)..(916): n is a, c, g, or t
  misc_feature (918)..(931): n is a, c, g, or t
  misc_feature (938)..(938): n is a, c, g, or t
  misc_feature (940)..(940): n is a, c, g, or t
ataatgcagacatatattcaaaagataatgatgggagttcaccacgtgacatctgtgagtcaaactggccatgcatgcagcatgtgggggaagaagtaaattgattgattgattgtttgcttgttgcagcttctggccaatacaaccttttagccaaatcccaagaggatgttcgtgtctatataacttgattttttttgtccttactcatgatggtgtatacacccttttcagtctagtgtacgcctatgcaccgcttaggtaatggttagttaattaggttgtattctgttctattattgtttcctctgctcagctctttaacannngcagnnnnnnnggcnnntgannnnnnctcgcnnnnnnngtttnnnnnnncnnnnnnacannnnnnnnnnncactntnnnnnnnncccccacnnnnnnnnnnnnnnnctnnnnnnnnnnnnnccnnnccccctccnnnnnnnnnnnnncccnnncnnnctcnnnnnnnttnnnnnnnnnnnnnnnnnnancctcatnnncctccctcccnnnnntccnnntcctctnnnnntctnnnnnnnncannnnnnntttctnnnntnnnnnncnnnntntnntccnnnnccacccnnnnnnnncnnnncnnnnnnnctnnnnnnctcntttccccccnnnnnnncnnnnnnnnnnnttccctcnncccnnnnnccnnccatnnnnnnnnnnntnncancccttcnncttcatnnncccnnnnnnnnnnnnncctncnttcnnnnnnnnnnnntccttcnnncctnnnnnnnnnnnnnnctnnntnntnnnnnacnnnnnnnnnnnntaacnacatannnnnnnnnnnnnnntnnnnnnnncnnnnnccctcnnnnnnncncannnnnnnnnnnnnatctcccnnnnnnnnnnntnnnnnnnnnnnnnnttttcantncctttt

SEQ ID NO: 6500 - DNA, 341 bp, Glycine max
tccccaaatcagttattgggacctgctggtatcaaatgggcgactgtgaatagtggaagagtagatgttgctgctggtaaaagaagaagtgggccagtaaattcaaaagcttatgccattgctgacgttctcaagacttcaatctaccaaatagtctctgcattccatgatgagatgttggctggtgctaaagcaagtcttctagagaaggactgggtcacaaatgggaagccactttttggtactcgtgagatgcttatacaaaaattacgtcttttccttgattttcgagctacctaagtgctgcattgtactgtggtttgaatgctactttcctgaaa

SEQ ID NO: 6501 - DNA, 557 bp, Glycine max
tggggaaaggaagaagtcctgggaaatggttcaagaatttactcttggggaagaaatcgtcttcaaagtctacttcatcaaagaagaatgacatttttgtaagtatttttgtggttggcattcgtttgtgtttatgatttgttataaaagaaactatggaagggagaaagtctcattgttgttgcctataatctgtgtctgtgagtgcttagtcttttgaaatatgcatgttctaatttttatttcattttgtgtgtaaagaaaccttcaattgacaaggatttgctggtgtcgtctgaggtacccgtgcctgatccaaccatggattcgttgcagatatccacaccaatatctggagctaatgattataaaggagtgttttccgaaaaggaggtagttagtaggtcatcacatgatagggatgttctttcaactagagtcaaagaagctaaggtgcaagatgttgctaattttggatctcaagagaatcttgagaaactccagcttacggaagcaactataaaagttcaggctgcttgtagaagttatctggctcg

SEQ ID NO: 6502 - DNA, 1502 bp, Glycine max
  misc_feature (530)..(534): n is a, c, g, or t
  misc_feature (538)..(541): n is a, c, g, or t
  misc_feature (569)..(571): n is a, c, g, or t
  misc_feature (597)..(599): n is a, c, g, or t
  misc_feature (601)..(603): n is a, c, g, or t
  misc_feature (605)..(605): n is a, c, g, or t
  misc_feature (612)..(612): n is a, c, g, or t
  misc_feature (636)..(637): n is a, c, g, or t
  misc_feature (653)..(655): n is a, c, g, or t
  misc_feature (658)..(663): n is a, c, g, or t
  misc_feature (672)..(690): n is a, c, g, or t
  misc_feature (692)..(693): n is a, c, g, or t
  misc_feature (699)..(714): n is a, c, g, or t
  misc_feature (716)..(721): n is a, c, g, or t
  misc_feature (724)..(724): n is a, c, g, or t
  misc_feature (726)..(730): n is a, c, g, or t
  misc_feature (732)..(737): n is a, c, g, or t
  misc_feature (739)..(749): n is a, c, g, or t
  misc_feature (751)..(756): n is a, c, g, or t
  misc_feature (760)..(764): n is a, c, g, or t
  misc_feature (766)..(771): n is a, c, g, or t
  misc_feature (773)..(775): n is a, c, g, or t
  misc_feature (779)..(784): n is a, c, g, or t
  misc_feature (788)..(789): n is a, c, g, or t
  misc_feature (795)..(796): n is a, c, g, or t
  misc_feature (801)..(802): n is a, c, g, or t
  misc_feature (808)..(814): n is a, c, g, or t
  misc_feature (817)..(826): n is a, c, g, or t
  misc_feature (834)..(840): n is a, c, g, or t
  misc_feature (843)..(856): n is a, c, g, or t
  misc_feature (858)..(858): n is a, c, g, or t
  misc_feature (861)..(861): n is a, c, g, or t
  misc_feature (863)..(872): n is a, c, g, or t
  misc_feature (874)..(876): n is a, c, g, or t
  misc_feature (878)..(888): n is a, c, g, or t
  misc_feature (897)..(903): n is a, c, g, or t
  misc_feature (907)..(912): n is a, c, g, or t
  misc_feature (914)..(924): n is a, c, g, or t
  misc_feature (926)..(931): n is a, c, g, or t
  misc_feature (934)..(972): n is a, c, g, or t
  misc_feature (975)..(975): n is a, c, g, or t
  misc_feature (977)..(978): n is a, c, g, or t
  misc_feature (980)..(982): n is a, c, g, or t
  misc_feature (984)..(992): n is a, c, g, or t
  misc_feature (994)..(1026): n is a, c, g, or t
  misc_feature (1032)..(1033): n is a, c, g, or t
  misc_feature (1035)..(1039): n is a, c, g, or t
  misc_feature (1045)..(1055): n is a, c, g, or t
  misc_feature (1067)..(1078): n is a, c, g, or t
  misc_feature (1082)..(1085): n is a, c, g, or t
  misc_feature (1087)..(1092): n is a, c, g, or t
  misc_feature (1094)..(1107): n is a, c, g, or t
  misc_feature (1112)..(1112): n is a, c, g, or t
  misc_feature (1114)..(1131): n is a, c, g, or t
  misc_feature (1136)..(1150): n is a, c, g, or t
  misc_feature (1152)..(1160): n is a, c, g, or t
  misc_feature (1162)..(1170): n is a, c, g, or t
  misc_feature (1178)..(1179): n is a, c, g, or t
  misc_feature (1185)..(1198): n is a, c, g, or t
  misc_feature (1204)..(1217): n is a, c, g, or t
  misc_feature (1219)..(1220): n is a, c, g, or t
  misc_feature (1222)..(1224): n is a, c, g, or t
  misc_feature (1228)..(1241): n is a, c, g, or t
  misc_feature (1244)..(1254): n is a, c, g, or t
  misc_feature (1256)..(1265): n is a, c, g, or t
  misc_feature (1267)..(1275): n is a, c, g, or t
  misc_feature (1281)..(1298): n is a, c, g, or t
  misc_feature (1300)..(1304): n is a, c, g, or t
  misc_feature (1306)..(1322): n is a, c, g, or t
  misc_feature (1324)..(1328): n is a, c, g, or t
  misc_feature (1330)..(1334): n is a, c, g, or t
  misc_feature (1336)..(1336): n is a, c, g, or t
  misc_feature (1338)..(1338): n is a, c, g, or t
  misc_feature (1342)..(1342): n is a, c, g, or t
  misc_feature (1345)..(1349): n is a, c, g, or t
  misc_feature (1352)..(1364): n is a, c, g, or t
  misc_feature (1366)..(1369): n is a, c, g, or t
  misc_feature (1371)..(1377): n is a, c, g, or t
  misc_feature (1379)..(1395): n is a, c, g, or t
  misc_feature (1397)..(1406): n is a, c, g, or t
  misc_feature (1413)..(1420): n is a, c, g, or t
  misc_feature (1423)..(1426): n is a, c, g, or t
  misc_feature (1428)..(1431): n is a, c, g, or t
  misc_feature (1434)..(1436): n is a, c, g, or t
  misc_feature (1439)..(1440): n is a, c, g, or t
  misc_feature (1443)..(1445): n is a, c, g, or t
  misc_feature (1453)..(1462): n is a, c, g, or t
  misc_feature (1466)..(1473): n is a, c, g, or t
  misc_feature (1478)..(1484): n is a, c, g, or t
  misc_feature (1486)..(1487): n is a, c, g, or t
  misc_feature (1490)..(1498): n is a, c, g, or t
tggttctggagtggatgggcatgcatgcattaatgatttatatccttgcggcttgcaatgtttttccaattttccttcaaggattttattggggaagtcctcacaataacattgtaatttctttgtccctctccagtttggttttaatcctactttcataatcataattttctattgtgacttgtaaagattcagtaatctacttgcacgtttatattctgcacatgctgataatgtaatctgattgcaatttcctatcacagctcaagttaattggagttggtacttgaagagaggcacatacacatgctcgtggataaagattatatgcagtaagacagtgagacatgttttactgtaaaagaaattggctaccacgcggtgtttattgattattacccgagttttggagctaatcttttgatcaagaacaagaacgggtgtatcatattcctctaatctcttgatgacgtcacctgcatggatgatggatatagtttagagttcgctatatctcttgatggcaactnnnnntttnnnngtttatttatgaattttgttttctattnnngattgacattttttttcatcttttgnnnannngngttggtntaaaaattgtgaatctacaaaggnnaatcctcgttgctttnnnttnnnnnngatttgacnnnnnnnnnnnnnnnnnnnanncgcccnnnnnnnnnnnnnnnnannnnnntcntnnnnnannnnnntnnnnnnnnnnncnnnnnnaatnnnnnannnnnncnnnccannnnnntccnnccattnncttcnntctctnnnnnnnttnnnnnnnnnntccttccnnnnnnntcnnnnnnnnnnnnnntnacntnnnnnnnnnntnnntnnnnnnnnnnnctccctcgnnnnnnntctnnnnnntnnnnnnnnnnncnnnnnncgnnnnnnnnnnnnnnnnnnnnnnnnnnnnnnnnnnnnnnncantnnannncnnnnnnnnnannnnnnnnnnnnnnnnnnnnnnnnnnnnnnnnnctttanntnnnnntacccnnnnnnnnnnnattctccctccnnnnnnnnnnnntctnnnnannnnnnannnnnnnnnnnnnnatacntnnnnnnnnnnnnnnnnnntaacnnnnnnnnnnnnnnncnnnnnnnnntnnnnnnnnnatgtcttnnctttannnnnnnnnnnnnnttatcnnnnnnnnnnnnnntnntnnnactnnnnnnnnnnnnnnctnnnnnnnnnnngnnnnnnnnnntnnnnnnnnntctccnnnnnnnnnnnnnnnnnncnnnnntnnnnnnnnnnnnnnnnntnnnnntnnnnncncnccantcnnnnntcnnnnnnnnnnnnntnnnnannnnnnncnnnnnnnnnnnnnnnnntnnnnnnnnnncttccannnnnnnntcnnnntnnnnatnnnatnnatnnntattctcnnnnnnnnnnctcnnnnnnnntcctnnnnnnnannaannnnnnnnnttac

SEQ ID NO: 6503 - DNA, 414 bp, Glycine max
ctgaagcaggttcaccctgacatcgggatctccagcaaggccatggggatcatgaacagcttcatcaacgacatcttcgagaagctcgctcaagaatcttccagactcgcgcgctacaacaagaagcctaccatcacctctcgcgaaatccagactgcggttcgtcttgtgctccctggtgagctcgccaagcacgctgtctccgaaggcaccaaggctgtaaccaagttcactagctcttgaacgcgtttctgagaattttagggtttacgagatgtatattttgggagaattttaattttatatttatcctcttttattaccgtttttcttcttctttcaacaggtctatgttgatcctcttattcttttctcctcttaaccatgcgccggattctcaacgtcttaaatggt

SEQ ID NO: 6504 - DNA, 354 bp, Glycine max
tcaattaaagccagcactctatgccactcctgaggtgacaccgcttccggatgcaccctcttcgttccctccttctccgtacatcatcaatcacaaacgccgtggcccacgcctgctgaagagttattctgaggccaatgtgcaggccaagcaggagaaccttgaaaatgaaaatgctaatgttaagagcaatgatggtgtgattaccagtttagatggtgatctccaagtcactttcaccaacattgaacctgttaaggaggagcaggtgaatggcgtgcatgataccgaccttagtagcagtagcaacaataaaggtgaccttggggaggcacatagggaaagtgaaagtaa

SEQ ID NO: 6505 - DNA, 480 bp, Glycine max
  misc_feature (463)..(467): n is a, c, g, or t
acaatggaccaacacaagagactccaaatagcagtgccatgtactcagagtttcacaaaggaaaagatgctactcgtgtctccaaccaccatcatcgagcaaccatgggaaaaccaaccccttccaagtgggatgatgcacaaaaatggctcgtggggttgtcaaaaggtggagagaaaagccactccaaaagcaagccaagaaactcaaacgcagatgatttgagactcatagctcctgtgccacagaaggagcatgattactcaagtagtgagaaggaagaggaggaaaatgatgcttgccatgatttcatgactaatattattagtgctaatgctattgctgctcaatattagaggtatcatgctccttctgtggcacaggagctatgagtcgcaaatcatctgcgtttgagtttcttggcttgcttttggagtggtttttctctccaccttttgacaannnnncgagatatttttg

SEQ ID NO: 6506 - DNA, 606 bp, Glycine max
  misc_feature (580)..(585): n is a, c, g, or t
  misc_feature (587)..(588): n is a, c, g, or t
  misc_feature (594)..(598): n is a, c, g, or t
caccgggtgaaattttttataatctgtcacattgttttgtagagaacaccaccattgcaaggtatgtaccaacatggttttttactacctaagcattaattaacccatgatatcattctaatcagagtaatcatggtgcaatttggatttcttttgtaatccctgaagatgtaacatcatgatttgttaatggtagataatctaatagccactacttttgcttttttatttaatatatgtagttgatgggtgatctatttttcataaatggtgctttgattgtagaacaatctagttttggagtgtcataacgagtggaagaaataattagagaaaatgttcagaattctttctacaaagagttggatgtggatgccttgagacagtgaaacggcctagttagttgatttagagtgcatggattaaagtttcatccaactgaacttatgttcaactcaatccatcactcacattgttagcatttatgcattggcacgtacaagagtgcttgagtttgatcttcagaatgcattgagtctctgaccctttttttcaacccctttccacctctctcttggtnnnnnngnncctgannnnntaaaaaaa

SEQ ID NO: 6507 - DNA, 782 bp, Glycine max
ggtacttcaaattagtaatgtaacatgacattttttaatgttctttgttttgtatacttgtctttctctaaagttgcactgacccattgctttgatatctcgaaagatagatgttcattgttcagcccaaatttagtgttttttcttattttatttatttatcattctttccctattctccccatatccctattcttcatggggatagcctgtgaactaacatccgcatatgcaaattacaaatggcactgtagataacaaaatggatgctaagcaaaggtcaaggaaagacaatgggaagctatttcacattacttaatgctttagtggaggatgaccgtcttgacgaagctgaagagctttggacaaagttattaatgcagtacatggaaagcttgcctcgtagattttttgataaaatgatatctatctaccataagaggggcatgcatgacaagatgtttgaggtattaatgatatgcaactcgatatcaatgttactgagtagtagtagttgtcaacttaacatgtccctatattaatatgactagatgatactatatttgaaggtacttcagacttgacacatcatggatattcacttcttgatttctcctgtagatatttgcagacatggaggagctttgtcttcgacctaatattgttgttgtctcgatgattggagatgccttcaaagagcggggtatgctagacaaataccagaagctacatgcaaaatatccaccaccacaatgggaatacagatacatcagaggaaaagc

SEQ ID NO: 6508 - DNA, 710 bp, Glycine max
agtggactggcatggtaaagttggtctggaaaacaaatggttggacaatttgatgactttgaagccggacaattgtactctaccaaatgcaattccatctgctactcttcctcattcagagacaacagaagaatttgaagtgcagaatagcatcaaagtcaaggtaaatttttatatggatgacactgaaattatggaaacaacatccctgttgaagaaattgactttatatgagctatcaaatctaacacgagtgtggggaaagaatagtaaaggagttctcatctttcatgtgtctaacaggaagaaggcacagcagcaaatgtaacacaaaagtttgtgtttcctcgtttagagaattggaatatccatgacttgccacaggtcacttacttttaccctcgaatgtatatgctctaaaatgcccccaccttaaataattatcattgttggattgtgatgagcagcagttatttccaagtgcacatctcatgaataaggatgaaggtaccagtacttcaattaatagtcatcctcttatcttaagtctaaaggtaagcaccatagaatctggactcccaatctttttttattttgttggttgtgtctaattcacagtcctttgtattcgaattgtttaaccttcaatttttaggttatttctaacccgaaggaattgagactagattggaaacacaatccagcgttat

SEQ ID NO: 6509 - DNA, 337 bp, Glycine max
ctttgattcttgccagtctttttcattctttttcattcttaaatccatcaaatgaacctattgatatgactgaaacctttggattagccaagactaaagctactccacttgagattttaattaagccacgattatcttctagttgttatctataaaagcatgtgaatcttgtcttagcggtttgtggaaagtctgttgttaaactatgtgatcttcttttagataaatcaggtttgcctgataaattatattttcgtcaaaagggcatttttggaattcacaaaattgtcatcatgtggtgttgaaataaggtgtgttgtaataaggtttaaggctt

SEQ ID NO: 6510 - DNA, 864 bp, Glycine max
cttttcaggtcaaagtgaaagcttcaaagctcataagttgatacttgcagcccgatctcctgtgtttagagcccagttttttgggcttgttggggatcctaccttagaggaagtagtggtagaggatattgagccctttatcttcaaggtagctttcaactcttattaactcccatttgtaatatctgaactgtgaaataattgagcttgttcttacatcatgataaatagccatcttactctatttgtgacatatgaactgtgaaactttaattatttctttattcttagtttcagagtctgacctatttgtgtttgcttttgtttctgaagcagtcggttggaactaggtgtatcttgccgaaatagttttttgtggtggaacaaaataagttgtttaattaacaacttcgcttgttaaattgcaatcatttagtatggagaatgttgtatgtgaaataaatggctaagcatgagtattttgttgagtgatgactaatgagatctgtttatgtcaattgtaatctcattccattccaatactcagaaaattgtgtttggttttttaagacatagtcagttcctgcagctgtagtagtattcatcatgttatatgcttgctgacaatttctaactgaattaattattctttcatattatcttgttaatcagattgattaagtgaaaatcctttcatctgttttttccaggcaatgcttctctttgtttactctgacaaacttcctggcatatatgaggttatggactcaatgcccttgtgctcatacaccgtcatggtgcagcatctcttggctgctgctgatctctataatcttgatcggctcaaactgcttgcgaatcaaa

SEQ ID NO: 6511 - DNA, 650 bp, Glycine max
  misc_feature (546)..(549): n is a, c, g, or t
  misc_feature (587)..(589): n is a, c, g, or t
  misc_feature (603)..(603): n is a, c, g, or t
  misc_feature (614)..(614): n is a, c, g, or t
  misc_feature (616)..(616): n is a, c, g, or t
  misc_feature (622)..(627): n is a, c, g, or t
  misc_feature (629)..(641): n is a, c, g, or t
  misc_feature (643)..(645): n is a, c, g, or t
catgtaagttttctttccttgtttatgtgcatacttggatgggcacattactctactttggttacttacatttgtggctatgcttgtgcctcctccccttacttcccctgaatctataatagcacctgctcattttctggatattaagatgtcagcttttttgtcaataaataaaaacaatattataaaactggttaaggttgcattggttggccaaatatttaagctggttctttttgctagtggtagaaggcttgcattctggttactggagtttccataggggccacatgtgtccaaaattggatacattctagaaactttttcttaagaaaaaaaactcttatatgcaaggtttttcttccttttagttggtttcttgtttgttgcttatagctatccagtatctgatggattgcccttgattttttattttttttactttggggattatttgtctaacttgtggattctttgtattcgtatctaatgtttttgtcacttgaatttgacattgcttgttcgttcaacaggcatccaagggannnngagggattaccaacttgctgggctaaactggctcatannnttgtatgaaaatgncataaatggtntnctggcnnnnnnannnnnnnnnnnnnannnctggc

SEQ ID NO: 6512 - DNA, 530 bp, Glycine max
attctcttgttatgtgtctgctatttcatattgaaaagatcaaggaagaaatacaacactcttctaagggaaaattgtaagtaatctgatcaacaaagccaaatccattcctttctttaaaaggcttaaaggactaataatgttagcctctctactttgatgttgcttctagttggggaagaaagtgccactttagagtcgttacaatttggtttggtcacaattgaagctgccacaaacaagttttcctatgaaaagagaataggtgaaggtggatttggagtggtttataaggtgatcaagtgtaaataaaaaaatatatgtacatttgtttattgtaggcttgtagctaactaagttgattatgtttttagggtgttctccctgatggacgagaaatagctgttaagaaactctcaaaaagttcgggacaaggtgcaaatgaattcaagaatgagattctattgatagccaaacttcaacatagaaatctagtgacattattaggattttgtttggaagaacacgag

SEQ ID NO: 6513 - DNA, 493 bp, Glycine max
  misc_feature (6)..(6): n is a, c, g, or t
tgagtnggaagaagaacactgacttttatcaatcgaatcatgctgatgaccttttaagccatgtgagtataaacaagagtaatttcctttctttactgataccaagcttagccacaatgcctagctacatttcagtgggtgaggaaagagatattcccggtttaaatgctaatattatacaacttcaggcgtggaagaattggacactgcagacacctctggagttgctggatccaacactgagaggttcttattcaagaaatgaagtcaacagatgcatccatattggtttattgtgtgttcaagaaaatccatctgataggccttcgatggccactattgcacttatgctgaacagttattcagttaccatgtcaatgccacaacaaccagcatcttttctgcgtggaagaggtcctaacaggttaaaccaagggatggactctgatcagtctaccaccgatcagtctacgacttgttcaattccatggtc

SEQ ID NO: 6514 - DNA, 536 bp, Glycine max
gcatctggtctttcaggtaaatcaaaattttcaaccctactgtatacaactttgcttttgttttaagaagcaaaatacatatcacatgaagcatcaaggaatcaaggatttattaacaacactgtgtttgatattatcttgcaggggttgaatcagtttctattgacatgaaagacgagaaaatgaccttattagggaacattgatccagtgaatgcagtgtgcaagctacgaaagtgttgtcaaactgaaatagttacagttggtccagcaaaagaggataaggagaaagagaaggtggagccagtaaaagaacctgttcctctcaaactctatgatgcctatccctattattatcaaatgacacccccactgtatatgtatagttaaaatttaacataggctagaagttttgaagagaatcctataaagctgtgtcatctgctaaattttagaatattgaatattaggagtattattttcagcaaaaaaaataaaataatgcatgtatgcatgccttcgtaatgtctttggctt

SEQ ID NO: 6515 - DNA, 360 bp, Glycine max
  misc_feature (219)..(219): n is a, c, g, or t
  misc_feature (234)..(236): n is a, c, g, or t
  misc_feature (291)..(291): n is a, c, g, or t
  misc_feature (293)..(296): n is a, c, g, or t
  misc_feature (346)..(347): n is a, c, g, or t
aggctgataatgaagaagagaagaaaaaaatagagacagcaacaaatggggctaagaaggctctcaaccgtttccttcgtggcctttcaaagaggattcctaatgaataatattttcattattttgatgtgtcgtgtctcggcttgaagaattcaccaaaagaggtatggtaagccatacattgtcttggtgggatacatgctacggaaaaaaaaatanctgaaagatttagannntagccaagttgatcttaatggacaagattttcaattaattccgttcggtattggnannnngggatgccctgcaatgtcatttggacttgcttctactaacacttttcttnntaatcttttgaat

SEQ ID NO: 6516 - DNA, 850 bp, Glycine max
tcctcactcctgccaagtatccaccaagcaaagaaatggatgccaaaaattgggaagatgtgcgcaggtatatcatatgtggtcagtggtcttgtcttctattcttagaaaatagtcacgataaagctattttattcttgattttttctcatgctttgagtcttattcatgaatctagttatcattattctacggaatgaaaattaaaggttgcatcatcttcaaaggccaaggcctaatatttcgccacatccacatatattcattctatcaaaaccttatgcaggagaattaggcatctcaagtgaaaaagttggtaattataaaccaggggaataagttattcattgttttttatctttatattcataatctccttatggttttaaatattcatttaaaccattaacctggcatcttaagtaatcaaatgattcaaaatttaaccaaatgtttctattgaaattttgtttgatttatttcctatttctgtgaccgaagtcttaatcttatgctcaggaaaaagaatggaggtaaagtgagagaggccgtaacatcaaaaaggcaaagacaagtccacaaagtttcccatgaccatatcaatttcaacaaaccagctttgaaagaggtgctcttgctttaattgcacaatgccacactactagaaaaaaaaatagctacttttattcacttgccttttttctttgtgaaggaaatgcagaatgattctcaaaatgctgctccagatgatggtagggcacatgttacaaaaggaaaagtagcaggagctatgcataaagagcaaccaaagccttcatatgatgcgaagtcagaggctgcccaagtggtg

SEQ ID NO: 6517 - DNA, 369 bp, Glycine max
tctaaacgaggaataaatatataaaacatgttattttaatattttcttaacgcatactttatggttgaatttcgtctcatagtacttgttttacaattgagcaagtatagacgtagtccaataataaaagtatgttaaagaaaatattcaaaaaagatattatctagtttactactagtcttccaaaaagaaataaacatttatatgctaccctttgtggcacttaatctctctacttttattctcataacgaaaaaaaatatgtatgaattaagatatgctatatatgcaatcagcgtctgtgatttagatttcctattaggagaaacaatgtgtttgtgtcgaaataatgtgtgatatttgtatttg

SEQ ID NO: 6518 - DNA, 691 bp, Glycine max
cccctctcaactgaccctgaggtttgattacttgattcagaatcctgtctcttttgtctgtgacctttccaacatgtggccaatctgttgagtcgcatacccgactgaagattgaatagtcaagctgaatttaactattaactatttacagagaagttattcatttgttttatcattctgtgcaaaggattaggtatacacactatgattgaccatttgtcagtcattaattaaacttcagtgcctaagcacatgcaaatgatagttccttgatgtaccttgcttatcttccgcaggcagctaaggatgttgtgttagctgagaagcctgtgataactgatgactcaaaccaacttgatccttctctacttgacgagcttcttgtcaacattgctacattatcttgtgtctatcacaagcccccagatgcatttgtaacccgcacgcactcgtctgcccagaaaaccgaagacgatgactatcctgagggaagcgaaacagggtattctgagtcacctggaaatcctactaatggccctgcttcacctccaagtgccagctattcagcacctgcgtctgttgcaccggcatcgcctccacctactgcgcctgtgcctgatttacttggtgatttgatgggcacagataatagttctattgttcctcttgatgagccagctacttctactgg

SEQ ID NO: 6519 - DNA, 332 bp, Glycine max
cttcctccgtccccctcgcctccgcctgaagcttccctccctatccctcccctccccgaacgccgtcttcgccctcctccttcttacctacttcatggtcgtctcaggcatcgtctacgacatcatcgtcgagccccccggcattggctccacgcaggacccctacaccggcgccgttcgccccgtcgtcttcatgtccggccgtgtcaacggccagtacattatcgagggcctctcctccggcttcatgttcgtcctcggcggcgtcggcatcattctcctcgacctcgccctcgatcgcaaccgcgcgaaatccgtcaaggtgtcctacg

SEQ ID NO: 6520 - DNA, 399 bp, Glycine max
tttttgttaccaagtaacattattgccatgatgcctaaactgtcttcattgctcgctgaaagttgcaaggggttgcaatgggtgaaatcagaagagggtgaagaaaaagtgggctcaatagtatgttcaaatgtagatgactccagtttcgatggttgcaacctgtatgatgattttttttcaacaggtttcatgcagcttgatcatgtgaaaactttaagcctaagggacaataatttcacattccttcctgaatgcctcaaagaattgcaatttttaacaagacttgatgtgagtggctgcttgcgtcttcaggaaattagaggggttccaccaaacttaaaagaattcatggcaagagaatgtatatccttgtcttcctcgagtttaagcatgttg

SEQ ID NO: 6521 - DNA, 389 bp, Glycine max
  misc_feature (316)..(318): n is a, c, g, or t
tcatcatgcatcaagcaattccctatagatcatggcgccatctccataaccccaccacccacttcaccccactcccattaattactcattcccacaacgatgatgataagaagaccaagaatattattgttaacaacaataatactattaatattcattcttcttcagttcttgtttcaccaaaagagaaggaggggatgaaaatggtgctcaacatggtttctgagaacgccgttatagtgattgcgagaagagggtgttgcatgagccacgtggtgaagcgtttgcttcttggtcttggtgttaaacctaaaannnaaaaactcatagctactttgtccgtacatttcgtggtatgtttcttcttcttaatgttagtgtcgtgtttg

SEQ ID NO: 6522 - DNA, 381 bp, Glycine max
gacttaaattcctgtttgtgactgatggaacacttagaattcactactataccccttctttcgatgggtctgtgatgggaactgaagatgtgctcataacaccatatacttgtgatagaacaggctcgggtgatgctgttgtggctgccattttaagaaaactaaccacttgccctgaaatgtttgaaaatcaagatgttttggagagacagctacgctttgctgttgcagcaggaattatatctcaatggactattggtgcagttagaggtttccctactgaaagtgctactcagaatctcaaagaacaagtttatgtgccttcattgtggtgattaaaattgtatctgtaacttcaatagagcttagcagagccttgag

SEQ ID NO: 6523 - DNA, 1185 bp, Glycine max
  misc_feature (1172)..(1174): n is a, c, g, or t
ttattaagatgggtcaccattcttgctgcaccaacagaagggtaagagaggcctttggtcccccgaggaagatgagaagctcatcagatacattaccactcacggctatggttgctggagtgaagttccagagaaagctggtctcttctttcattttcttccttgctagcttgatgatatagagaattgcgccctcaacttatttttgtgatgaaccaaccttttgctttttctttatgaagtttaattcttaatttcgtgtatctttcagggcttcaaaggtgtggtaagagttgtcgcctgagatggattaattatttgaggcctgatattagaagaggcaggtttacacctgaagaggagaagttaattataagtcttcatggggtcgttggcaacaggtttgaatcacactgcagacacaattaagctagccatagcactaccaagcatttttaattatgatcagtccatttttttacttgtttgctcttcttgcattttctgtcctagttgtacatgtctttcttctttcaattgattagtatgaggatggttgaaagtatgataattaatacttgaaattaattttgagcataatcaaattaatttttaatcatacataatatagggaatggaaagaaagcagatagaaatggaatcgagacttataacacgttattctactcaataatcagtattgtaatcacaaatcataggaattagtcctaattagatcaactatagttattaattaagcaatctgaaggagcaatcagactcggagctacagtttggagaagttaagcaggcaattttgtcagttgaagtttacttgtccgttttcattgtgtgtgcactcccagcctctcatgtccacattcttcataatactttatttcttgaaatcctttagaaaagcaactatattgttatctattattcatttcttgccacgtttttctagacacatatgcttccaatttacgattttatgcgcgactatcttaattaagaagatactgtttttcattatttaaacattagaatatacatacgtactcaattaattaattatatatgttcctgtgtttgagaaatgcagatgggctcacattgcaagccacttaccaggtagaactgacaacgaaataaagaactactggaattcnnnatcaaaaagaa

SEQ ID NO: 6524 - DNA, 256 bp, Glycine max
gaatcagattctgtggcactcacaccaatttcctctagttcagtaacattaaggagcagcaaaagttcagaagaactgacaagacctttgttagagaatgacaaaccaccagaaactagagatttgcaagaacttagaactacttcattgcagaatgacaatactaatgaagctagtgaagctagtgaagagaagatgggagatatttctgtgagtgaatcacctccccgaaatgtggtgctggataaacaacatc

SEQ ID NO: 6525 - DNA, 357 bp, Glycine max
accttgaacctgaagcccattttctgtgcctcaggcatcaagggcaagcgagtgactgcgttgtcagcagaaaaaaatggcctcactgatttcattcaaagaatcattgctgacaaaccagacatcgacacaccattcagcgtcctcgatttgggggtcgtcatgggcctgatggaccaatgggcctgcaagctccccacggtccagcccttctacgccgtcaagtgcaacccaaacctctccctcatcggtgcgctcgctgcgctcggctccagcttcgactgcgccagcaaagccgagatcgaatccgttctctccctcggagtctcacccgacagaatcatctatgcaaaccca

SEQ ID NO: 6526 - DNA, 457 bp, Glycine max
tgatgttatttagatagaaaaaaaaagagtaaaatgtgttctagatctcctaactttcggtcaaaatttgtattagtggatatattttaaaatcgataattctgatcctcatattttttttttataatcggggatttcatcccttttttataaaatttaaaaaactaaggaaaaggacaaaattcccaaattataaaaatataaaaaccaaaatcttcgtttttataaggactaaaacaaattttgaccgaaaattgagagacttaaacactttttacccataaaacaaaatgaaaaaaattaatttttaaaacattgcaactaatctgagggaaggaagggagggaaacaaccaaggaatcctgggtcaaagggccctgaatacatcacccagggccccatcaaaccgggggggaaattcaggaaaaggttgattttttctatggaggaaggaacc

SEQ ID NO: 6527 - DNA, 506 bp, Glycine max
cataagttggaattcttctatagaagcttccattgacaatcaacaagcaatacaggagcatcctgttgagctgattgatggtggtgcaactcatcaagatgaaccagaatcctggcctagtttgattcataaagaaacacaggtaagcacatggctttgattgatgaaaattgaactgttgactgcaatcgtctcctggattatcatttggttatgtcaaggcttcatttgacttgtttttggcttcgtatttcgtttttcaatattgatttggtaaaattatcgtggatttcagtcggatgaagtgagtgattctgtgactgataccgagcttcacatctctaatagaaagggaatggaatcatcaaactcattgtcaaaaaatgatcgtgaaccattagctccagtgatatatatgagtttgccttctaggtctgtgcatctttcaaccaaagagagacttcttctgcggaagcaagccctaaagataaagcaacctgtccttg

SEQ ID NO: 6528 - DNA, 547 bp, Glycine max
ctgcaggtaattttctgcagaagctcttaactaactctctttgttgtattcttcattaaccaatatgggtttgtagttagatgaagaatccaggaagcatgtaatatatgttgaagctttaaaatttaagaacaaactaaccacttggttatttaacagttgcaacaacagctaactctctacagtcaggaacaaaatatggacaagagagaggaaattgcatgaaagctgattaattatgatctgatcattccttaatgaagtacatgcacatccacttgagtgatgaacctctgccgaaggagaacgggatttggatattgaaaaaaaaagagttgtatatcatccgcgatccaacttgccttgccattaataagtttctatgaatacctatagtttagcaaggccaatatacagagttgcagacataatatctcagttaatctcattgtttatttcatacaaaattccgatgtaaccaagcttccctgctgtatcttctgcaacctgataagtttgcagatccacacgggttgttgtaaatgta

SEQ ID NO: 6529 - DNA, 700 bp, Glycine max
attgttatgttgtgaagatttagttagttatgttctctatacatagctgacatactaatcccaaacttgatatccacagcatgtcccggcaactgtttggaatcgcttggtagctggactgaatgctcagttaaggactgtaaggcatggatcaattcgtactgcactaggtcctgttgttgattggataaatagccatgcaaacccccaacttgagtttcatggagttaaaattgagcttggatggttccaagcaacagcttctggttactatcagcttggtatcgtggtagcagttggggattattcccttcttgatttgcaccagtctgatactttggttggcacagatgaatatttgaggtaatttatgatcctgacaaatgctgtatacatgcagaccataaccttgttttcttctgattaatccaattaacaacatggcagggaagggtaacaatcattttattttgtcctattagagaattgatagtgccaattgaatctaaataacatcaaattgaatgttagtaaatgggtttcgtgtgggaaatattgttggaaagaacatggtgcatactcaaatattgggaaatcagtttaagaaatgttttgttttcattttctgtttccaataatgataactaatattctaccttgttttcgctgttattgtggttttcaccattttttgtacaaa

SEQ ID NO: 6530 - DNA, 910 bp, Glycine max
  misc_feature (650)..(651): n is a, c, g, or t
  misc_feature (668)..(672): n is a, c, g, or t
  misc_feature (677)..(677): n is a, c, g, or t
  misc_feature (684)..(685): n is a, c, g, or t
  misc_feature (687)..(687): n is a, c, g, or t
  misc_feature (712)..(712): n is a, c, g, or t
  misc_feature (716)..(716): n is a, c, g, or t
  misc_feature (718)..(721): n is a, c, g, or t
  misc_feature (723)..(723): n is a, c, g, or t
  misc_feature (727)..(727): n is a, c, g, or t
  misc_feature (731)..(732): n is a, c, g, or t
  misc_feature (734)..(735): n is a, c, g, or t
  misc_feature (738)..(740): n is a, c, g, or t
  misc_feature (747)..(760): n is a, c, g, or t
  misc_feature (762)..(763): n is a, c, g, or t
  misc_feature (773)..(782): n is a, c, g, or t
  misc_feature (786)..(794): n is a, c, g, or t
  misc_feature (796)..(811): n is a, c, g, or t
  misc_feature (813)..(813): n is a, c, g, or t
  misc_feature (815)..(823): n is a, c, g, or t
  misc_feature (833)..(843): n is a, c, g, or t
  misc_feature (846)..(860): n is a, c, g, or t
  misc_feature (864)..(889): n is a, c, g, or t
  misc_feature (891)..(896): n is a, c, g, or t
  misc_feature (898)..(899): n is a, c, g, or t
gtgagggttgaagttcgagcagaaacaaaatcagaaaatggtcctgcatcatcaaaacaaccagaatcttccaaaacaccttcaggacttcacattgaggtaaaacttatgaggcacactagcatgctgctggattggatgtaacttaacagtggttctttctcttacattcttactagaatccatatagcaagtttcatgtactgctaatagatgcataatacagtttatgtttatcctttgcttatactgatctccttatccttttgagtttgcagtacttggaatgcgaggcagataagaagccatcacagctagtacatatcctgataaagaatctctcgaaaaaaattattatgtgagatacacgttgataattaatgatgtgatttgtgcagtagaagagtattttatcatacccaaaacatcattttgactctaatgcagatatttcatgacttgtgcttgtgttgattattggggagctgtccttccttgtctttctgttttgaaaggcttctccttgattcccctgcatggaaagatgaagcaggtatagttttggcctttttggatgttagcatttttctatatcgaagcataatattctataaatcagcattgtttttcttatttcccattattttgtnngtgtcttaccgtttacnnnnntgatnatttatnnantttgccttatagtctgccagggagnaagnannnncntcanttanntnnctnnncaatggnnnnnnnnnnnnnncnnatgttgcagnnnnnnnnnntggnnnnnnnnngnnnnnnnnnnnnnnnnancnnnnnnnnnattctaaaannnnnnnnnnnatnnnnnnnnnnnnnnnaacnnnnnnnnnnnnnnnnnnnnnnnnnncnnnnnnannaataataaaaa

SEQ ID NO: 6531 - DNA, 499 bp, Glycine max
caaacagaagcaagcttcttagacttttgggtgacttaaaaaccgataaaggtaaggaggtgatgcaatttcttatgaatttgtacttgcttttttctggtattatgttcctatgatatcatatttactgggattgtgcagaggatgaacagttcgaagctgataaagctcaagttataaaagaaattgcggctcttgaacctagggacctcgcttgagcttcagtttgtgtcgagtaacaagttgcattgtggcattttaccttatttaattgtctattgttatagttcttttagtcttcatcaagatgagactaacattcaacacaaattccagtgttttctttctgaattttcatttcggttctgtaattcctagatgaataaattgctgaaagagctacatgcagtggcagtattcggctttcatggtgttagaaagctttgcttgcctagcagttagtttataaattatacgatgccaagttatattcttacgg

SEQ ID NO: 6532 - DNA, 213 bp, Glycine max
ctacgagaagaagaaacgcaagagaactattgtcaccactactgtcaccgccgcagccaccgttatgtctaccataacgggtagtagtcctaataatactattacaaacggtgctggtagtagcactggtaacactactaacggagctggtgttagtgaaccttctgctgctgctactgctacacctaatgttactactgctgctgccgtaaa

SEQ ID NO: 6533 - DNA, 1242 bp, Glycine max
  misc_feature (659)..(660): n is a, c, g, or t
  misc_feature (766)..(768): n is a, c, g, or t
  misc_feature (778)..(786): n is a, c, g, or t
  misc_feature (806)..(807): n is a, c, g, or t
  misc_feature (812)..(815): n is a, c, g, or t
  misc_feature (817)..(817): n is a, c, g, or t
  misc_feature (826)..(827): n is a, c, g, or t
  misc_feature (831)..(833): n is a, c, g, or t
  misc_feature (836)..(840): n is a, c, g, or t
  misc_feature (865)..(870): n is a, c, g, or t
  misc_feature (872)..(877): n is a, c, g, or t
  misc_feature (880)..(891): n is a, c, g, or t
  misc_feature (897)..(907): n is a, c, g, or t
  misc_feature (909)..(921): n is a, c, g, or t
  misc_feature (924)..(924): n is a, c, g, or t
  misc_feature (927)..(936): n is a, c, g, or t
  misc_feature (939)..(942): n is a, c, g, or t
  misc_feature (947)..(954): n is a, c, g, or t
  misc_feature (957)..(969): n is a, c, g, or t
  misc_feature (974)..(976): n is a, c, g, or t
  misc_feature (986)..(991): n is a, c, g, or t
  misc_feature (999)..(1020): n is a, c, g, or t
  misc_feature (1026)..(1037): n is a, c, g, or t
  misc_feature (1040)..(1049): n is a, c, g, or t
  misc_feature (1056)..(1063): n is a, c, g, or t
  misc_feature (1070)..(1079): n is a, c, g, or t
  misc_feature (1081)..(1082): n is a, c, g, or t
  misc_feature (1085)..(1088): n is a, c, g, or t
  misc_feature (1094)..(1096): n is a, c, g, or t
  misc_feature (1098)..(1102): n is a, c, g, or t
  misc_feature (1104)..(1105): n is a, c, g, or t
  misc_feature (1108)..(1114): n is a, c, g, or t
  misc_feature (1123)..(1128): n is a, c, g, or t
  misc_feature (1130)..(1138): n is a, c, g, or t
  misc_feature (1140)..(1145): n is a, c, g, or t
  misc_feature (1147)..(1150): n is a, c, g, or t
  misc_feature (1152)..(1152): n is a, c, g, or t
  misc_feature (1157)..(1157): n is a, c, g, or t
  misc_feature (1159)..(1164): n is a, c, g, or t
  misc_feature (1174)..(1186): n is a, c, g, or t
  misc_feature (1192)..(1196): n is a, c, g, or t
  misc_feature (1198)..(1216): n is a, c, g, or t
  misc_feature (1219)..(1233): n is a, c, g, or t
  misc_feature (1235)..(1239): n is a, c, g, or t
caccacaatttcttgtgatcttccttcatatccagcctcatgctgactgctatgtactgaactatacctatatgctggcagatctattatttttgttaatggaaccgaagaatcaagaatggctgctgtcagcaaagaacaggaacaaaccaggtcaagaagcagcattgtgactactcaaattctgcaacttggaacattttaccctgcagagccagagcaccaggtatgtttccaaaataatgtttgatagaataccaatttgaaatagatggaaataggattaagtcacagcagattatacagatatttcagcaatttcttgctttcccagagttcaaaaactcctttagagactacttctgtcagaaaagctaccgaagacatgacttaatagtccccccaagattaccacaccgatataaaccaaatacataattattcgccacagaaactgtcacacgacacttatgaaaactgcagtgattattaaaactaagtcctaacatcaagttattaaaactgcagtaattaaaactaaatcctagattttctagaatagacctccaatctgtgggtagtctgatgccttatcaatgtttctaagaaaagcatttcctgctatgttgcttggatgtgggtacaaataaaactaaggnncccggtgccatggaggcttccttgttgcacaaaggtatgagagagggtcattgtatctagcatttcccttgagtatgcaaagaggctatttctggattcaaacttnnngccgactggnnnnnnnnngaaacttttaccgctatgcnntattnnnncntcccccatnntggnnncannnnngcatcataaagattaatcctcttannnnnncnnnnnnttnnnnnnnnnnnnccggcnnnnnnnnnnntnnnnnnnnnnnnnctnccnnnnnnnnnnttnnnncttcnnnnnnnnttnnnnnnnnnnnnnccccnnnccctcccctnnnnnntccccccnnnnnnnnnnnnnnnnnnnnnntctccnnnnnnnnnnnntcnnnnnnnnnntcatttnnnnnnnnctcctcnnnnnnnnnncnncannnnaatcannntnnnnncnntannnnnnnctacccccnnnnnntnnnnnnnnncnnnnnncnnnncncttcncnnnnnnctcccacacnnnnnnnnnnnnnctcatnnnnncnnnnnnnnnnnnnnnnnnntannnnnnnnnnnnnnncnnnnnccc

SEQ ID NO: 6534 - DNA, 340 bp, Glycine max
atctgacagatctaaatagtttaattgttgcaactccattaacgacttggggatctctcctctgaggtataaactgtgaaggtcgagcattagaatatggtcagtgaggttgctgcagcgaatcccttcccaccggcagcaatcagcagtggtccaagaagagagcatgccatagtcatccacaagtgcagtcttgaataagaggagtgcttccctctccctctcaatgcacattatttcctcttcagcacaaacaacctgcaacatcatcatcatcatcatcaaacacaccattaatattattatggcttctatgaatttgaaactatctggattcatg

SEQ ID NO: 6535 - DNA, 396 bp, Glycine max
gtggcacaagggcaagaacaaacttcccttacaaccccaatgcgtctcaatcttcatcttccaagcttctctcagcaactttaactgcaaaactgcataggtgctacatggcttctttgcaaatgacaaggccatcatcacagccagagactcagagagtggtggcttcaccaaatgtcatcacctcctcggcaagcaacttctccatgaagagtaacgaaactgagacaatgttgttgccacagaagagacaagaggaggagcaagaaggagaggggaattgggttttcaagaaggttaaggtggaaaatgctcaacagttcaagcctcttgaagaggaccacatcgagcaaatgatagaggagttgctgcattacgggtccattgaactatgct

SEQ ID NO: 6536 - DNA, 1054 bp, Glycine max
  misc_feature (65)..(66): n is a, c, g, or t
  misc_feature (475)..(476): n is a, c, g, or t
  misc_feature (497)..(497): n is a, c, g, or t
  misc_feature (567)..(569): n is a, c, g, or t
  misc_feature (575)..(576): n is a, c, g, or t
  misc_feature (585)..(591): n is a, c, g, or t
  misc_feature (605)..(605): n is a, c, g, or t
  misc_feature (607)..(610): n is a, c, g, or t
  misc_feature (613)..(613): n is a, c, g, or t
  misc_feature (617)..(624): n is a, c, g, or t
  misc_feature (626)..(629): n is a, c, g, or t
  misc_feature (640)..(643): n is a, c, g, or t
  misc_feature (646)..(647): n is a, c, g, or t
  misc_feature (656)..(668): n is a, c, g, or t
  misc_feature (674)..(677): n is a, c, g, or t
  misc_feature (683)..(688): n is a, c, g, or t
  misc_feature (695)..(702): n is a, c, g, or t
  misc_feature (718)..(725): n is a, c, g, or t
  misc_feature (733)..(733): n is a, c, g, or t
  misc_feature (745)..(750): n is a, c, g, or t
  misc_feature (754)..(766): n is a, c, g, or t
  misc_feature (779)..(779): n is a, c, g, or t
  misc_feature (781)..(788): n is a, c, g, or t
  misc_feature (794)..(794): n is a, c, g, or t
  misc_feature (796)..(798): n is a, c, g, or t
  misc_feature (800)..(801): n is a, c, g, or t
  misc_feature (804)..(805): n is a, c, g, or t
  misc_feature (807)..(812): n is a, c, g, or t
  misc_feature (820)..(827): n is a, c, g, or t
  misc_feature (829)..(835): n is a, c, g, or t
  misc_feature (837)..(837): n is a, c, g, or t
  misc_feature (839)..(848): n is a, c, g, or t
  misc_feature (850)..(857): n is a, c, g, or t
  misc_feature (860)..(869): n is a, c, g, or t
  misc_feature (872)..(877): n is a, c, g, or t
  misc_feature (885)..(893): n is a, c, g, or t
  misc_feature (900)..(900): n is a, c, g, or t
  misc_feature (903)..(908): n is a, c, g, or t
  misc_feature (912)..(914): n is a, c, g, or t
  misc_feature (916)..(916): n is a, c, g, or t
  misc_feature (921)..(929): n is a, c, g, or t
  misc_feature (932)..(939): n is a, c, g, or t
  misc_feature (948)..(952): n is a, c, g, or t
  misc_feature (959)..(980): n is a, c, g, or t
  misc_feature (982)..(983): n is a, c, g, or t
  misc_feature (989)..(992): n is a, c, g, or t
  misc_feature (999)..(999): n is a, c, g, or t
  misc_feature (1001)..(1003): n is a, c, g, or t
  misc_feature (1005)..(1008): n is a, c, g, or t
  misc_feature (1017)..(1017): n is a, c, g, or t
  misc_feature (1020)..(1028): n is a, c, g, or t
  misc_feature (1030)..(1035): n is a, c, g, or t
  misc_feature (1041)..(1042): n is a, c, g, or t
  misc_feature (1045)..(1048): n is a, c, g, or t
tttttgtggctttagatgaacatggtaagtcaatgcattcaattttcccttggcatgcttgtacnnctatcttgctaaggtttttactcttaagattaacaccttgctgttaaaggctgtatggataagatttacggggtgtttggtttgaaagaaattatggggagctaatttgagcttatgaaaacaatttatgactcctatatgttcttagcttattttgataagcttctcggcacaatttatcaaaagaaactctttttaactatgaaatatgggtaaatttatggcataagcccttacatgataagaacttgttgaactagtgtttgattaagttctttacccaaatgcacccttcatgattgacagggaaagctgaaggtgttctatttgaggatgatggtgatggatatgaattcactaaaggcagttatttattaacacattatgtggctgaacttaaatcatcagnngttacagtgagtgtccacaanactgatggatcatgggaaagacctaaacgccgctttgctattcaattattgctgggtgggggtgcaatgnnntgtganntgaaactannnnnnntttgaaatttgacntnnnnaanctgnnnnnnnntnnnnccttccctttnnnncannctctgatcnnnnnnnnnnnnntttttnnnncttttnnnnnnccccccnnnnnnnnttccccccgctggctnnnnnnnntctttttntttttttccttnnnnnnattnnnnnnnnnnnnntttttttttcccntnnnnnnnncccccnannncnnccnntnnnnnncttctacnnnnnnnntnnnnnnncntnnnnnnnnnncnnnnnnnnttnnnnnnnnnnccnnnnnntttttttnnnnnnnnnttttttnatnnnnnntttnnncnccttnnnnnnnnnttnnnnnnnntattttttnnnnnacatatnnnnnnnnnnnnnnnnnnnnnntnntatttnnnnccccttntnnntnnnntttttaccntcnnnnnnnnntnnnnnnttttcnnctnnnncttccc

SEQ ID NO: 6537 - DNA, 312 bp, Glycine max
gtggatctaaattctgcagcagacacactttccgagaagacaaatgaaaattcagttaaaattcgaagagtattcaatgacgtgtacgcaatcataaaactgaaagcccttcattctacaacttgatattttatccacgtatgatgctaaaccatgtgcattttgtaggcgtctagctttgtatgttgtggcagctgtaatgcttcttctggctcttgctggacttggtatgggttgatcataaaatcttgaataagttgacctaattttatacttatgttcctgaactcttggtttcaactgactcttatt

SEQ ID NO: 6538 - DNA, 818 bp, Glycine max
ggtgctctcgcctctgtcgcaagcaacgtctcttatgccatgtggcttatcattcaggtcaggttattcattttatgttgcagccagccagctactgtggtctagagaatggaaggttgattggatgattaaaaaaatcaataatttgattttttttttattaattaaaaactaataaattaaccgttaatatttatcgataaaaaaaacatcaattatattatagtatttcattaattgtcgattgttactgtagtgcaggcaaagatgagtgaaagatacccgtgtccttattcgagcacagcgttgatgtccctaatgggggcactcttatccatttcatttgctttttgtgttgaaagggatttgagtcagtggaggttggattggaatgtcagactattgactgtggcttatgcggtatggtactccattctttgtattcactttttttattttttttctttggacattctagatgtatataatagcatattttcttagatgggaacatgggaacccatagatcaatcgtgtctggtgttctttgcattgactttaatgatctgtcattgaatatatatgaccataatttggccaattgagaccacatactaaggttacatcgatcttgattatataattgatggcttaagaaaaataatatgtgaattattgatgtagggtatagtagtttctggagtgatggtagccgtgatttcgtggtgtgtacgcacgagaggtccactgtttgtctccgtttttagccctctaatgcttgtcgttgtggcctttgctggatccactattttggacga

SEQ ID NO: 6539 - DNA, 401 bp, Glycine max
ttctggtggtgaccttaaccttaaagttagaactacaccacccaacaccaccatccagagaagccgctccaacggcggctaccgcaccggaaaagtctcgccggcgatcgagcctccctctcccaagctctctgcttgcggcttctgcagcgctttcgggaaaacaagggaaaagggccgtgctaagcatcgatcaaggtaggttttttcccgtcgccggagacggtggttcatacagctcttcaacacgttctgtttatgtccacttaagatttagggtttgagtttgagttcgtatatgggaatagagaagggtgaattgtagccctccgtttcgtctctgtttacgagttttggtttgttttcatgtttcaattgtctctgtggaagaagagatgatg

SEQ ID NO: 6540 - DNA, 676 bp, Glycine max
atctatacttttatttgcttcacaaccttaaaggcagcaagtaggagctcccatcaaggccttttgcataataatttgtcaagatttctttcatattcatgtccctatagactggggggttttcttctgataacaattcctttattggaccataactcttcgatgtacatttagatatggtaaaattcatgaagaaggttgctacagaaattctagggcccatattcctcaacaagacccggtgataaacactgatgaacttgtcattagtcataagctgcataatgatgataaaaaaattgataaatatagatataaatataatcataaaaaaatgggtaaaggcaatacataaaacaaaagctccttggttgttaaaccctgaatgccactgagttaaagtacaaatacataataggaaaaaccctatctttacatcttgataattttattcactttttgcattcaaattttctgtctggaactttgtgtgatgttttacatctttgaaacttatttaaagctaaatctaggccataaagcttctctgataatcatatctcaagaccatcatttttggtaaaaaaaaaaacacagtaaacaattcccgaagttacctgcagaatatctccaatgttgacaacaagagctcctcgcactggaggagcataaccca

SEQ ID NO: 6541 - DNA, 384 bp, Glycine max
caattcgagtgttgattcgggtaaagtcttgaagaggggcttgtctggcaatgccaatttgagtgaaagccagccttttctgcgcgatgttaaggagaagaatgaaggatcttcaaacatgtttgggaatgtagtgttctctgatggcaatgtgatccatggttcaagttcggattctagatatgcacttggatctggttttgttgttgggactgattctgagaatagcgaggatcagagtagcaagtcttctacagcggctagtgagcccaagttgaggcaagagaaaagccgtagcaagaatgtgaattcaaagcatttagctaactcggctcaacgagttcaaccgggaaagggacgaactgaaggcagtaagaaaccagg

SEQ ID NO: 6542 - DNA, 739 bp, Glycine max
  misc_feature (680)..(682): n is a, c, g, or t
  misc_feature (687)..(688): n is a, c, g, or t
  misc_feature (694)..(694): n is a, c, g, or t
  misc_feature (725)..(726): n is a, c, g, or t
aataaataacaaatgattaattctaaatcctcctattgtatatcctcttacttcctttgtatggtaactgataagtattgaatgcatttcatttaattctttctttataaggtaatgaaaggacttgtagatgatataattttaagatttaatgattatgcacgtaaaataattttatgattcaataataatgtaaaatttcttttgtgcataatctattttcttatatcctatgtaccaaactttgctaaccagatattagaaattttacctctgcaactaccactccaagctcgttagatattttgcaagctgagttgcaagtgttgcgttctattttatgagtatacggttgatttttgtccaatccaagttcaacttcataggttgaaccccctctagagatcttataagtttttgaaactcgaaagcatggtcctttgtggtcattccttgttcctggaactggaaatctataaccctcccaaaacctggacaacttatattgctacacacacaaaaaaaaaaccccaaattggtcctttaatgggaaaaaataaaaaccttaaacttatttaaactaagaaatttgcctggaattgggaaatttggttacctttttccacaaaaggaaaaaaaaaaccccctttttaaccctggaaagaacttccttcccaatnnnggcgnnggaatnatcaaccccggatggaatttggccctttganncaaaacacgggga

SEQ ID NO: 6543 - DNA, 372 bp, Glycine max
ttcgcgctgagggagatcggcgtgaaggatgccgtcggaatcgcgagaaaggcggcgaagcctctcgtgaagttcggccgaggcgagcggattccgttcggcgacggagccttcgacttcgtgttctccggcgaggactcgttcgtgaagtcggcgaagccggcggagttcgcggccgagatcggccggacgctgcggccgggaggtttcgcggtgttccatttcgcaaaccctaaagatacgtatagttttaattcgttccttgatttgttcaattgtttcagagtagtgaagttgcatggcttggaaggattcgattcttcgatgccgtatatacgagaaattgttttgaagaaagagtgtggtgatggt

SEQ ID NO: 6544 - DNA, 418 bp, Glycine max
ccccttctgcgccggcgattccgcctaccacgccgacgcgaagtcgttcaagaaacgcttcaacaagttccgcatattcgcgaagatcttcaggaccagatcggagaagttccagtcggatccgtcgtgcgagcaagcctcgtacgcatcgccgtcgtggttctcggcgttttttcccacgcgccggaggaacaaggatcggaccggaacgacggaggaatattcctcctccgccccgcggcggcggtaccgcccgtcggatcgcggaatgtcgccggtgacgaccgaggatttcggcgacgagtgcgatcagtcaccatcgggaagcggatacgtctcagaggcttcgccgtggtggcggagatcgccgacggtggcgccgtcggcgcggcggtcgaggctagggcacacgaagaga

SEQ ID NO: 6545 - DNA, 800 bp, Glycine max
cctgccctggtaagtataatcctatgatttccaatttgacttgaaatttgttatctctctctcctttatcctatatattgttcttcaagcaggggctaaaggagctgaaggaatccaccatccaactggcttcaagtcatggatacattgattcccctgttgacgaggctgttttcgatgtagataaggatgttgatgaccttttgccagttgaagttaaagaacagcgcctcagcaatctgctgcaggcattgatggttgcagcttgtgttgctgctatgcctctcttgaagaagataccaacctcagtgctttggggttactttgctttcatggcaattgaaagcttgcccggaaaccagttttgggagagaatactatatcttttcactgctccaagtcgaagatacaagtatacctatgctcatagtcaatgttatgaatttatcatttgcatggttcctaggattcatggatttgaatatggagccaaaaatttcttcctgcatcaaattcctacttttattgcataagaatcatgcattcgttgtcatttttagaattctactatctgtttatttatatattttttactaaaaaatattgatgggaagtagttgacctgttgggattatgcttattcctagactcctacgagacatatccatgttaagattaacatgtgtttgcttgctcatctttagcattatcattacattttataatgttgaagacgatgattcctttttcttttgtctctttactagagtgatggaggaacaccatgcagcctttatgag

SEQ ID NO: 6546 - DNA, 661 bp, Glycine max
cagtgtccggactgaaagatatgcctgatatctcaccgaagaaatcaatttcctgttcattctcatacccactttttacatcatacacatgtacaaaatctgcaggctctgcaacagccatataccggccatctgaagtatacttgattgaacggatggctccaatgttgctctgcagcacagccactgacttggataaattccgcaagtcccaaatctggcaggttttgtcctggtttccagtggcaaaggtcacaccatcaggatgccatgatgatgcaaatgaataatcaaagtgcccagataagggaacaattgtctgcaagacagacaaaaaatcgtataactataagctctcttgggatacaacgggcacaaatcctttccagttaaaaaaaactggagtgtgtgcagtttaaataaatctcactgttcatttttttgttatcttgtaaatattaaaataaattaaatataaaaaataaacgatggttgagatttcctcccgttctaaaaaaactggagaggatctttttccaggatacaactgaattaaagaattgattggttgttggacaaaaagggagtacagtgttacctttccattttgggagtccactaacatacattcaggattgtctccaacaattagtagtagctt

SEQ ID NO: 6547 - DNA, 381 bp, Glycine max
tcttgagcttacagttcaaggaacccccaagtctcagccaaaggcacgtacccttttgcagttactaagagagtctccatattcaagacctgaagctgaacctgacattcttgagaacatagtgtgtgacatcatatcacagattgatggggatgatcaatctggtaaagcaaagaagatgctagctgagatggtccaagtcagcatggagcagagtttgagacatttacagcaaagggctcttgtatgtacccctagtgaaatgcctattgcaagttgtgcttctgaagtttcttcaaaatattagttggggctcttcttaatttgtatcttttcaccctttttctctctactctttttctttccagttggaactagcaa

SEQ ID NO: 6548 - DNA, 325 bp, Glycine max
cccacaagacaaacaaacgctactccaaatcaagaaagagcttggcaacccaaccactctttcctcatggcacccaaagaccgactgttgcaacaacagctgggtaggtgtctcatgcgacaccgtcaccccaacataccgcgtcgacaacctcgacctctccgaacttaacctccgcaaaccctaccctattcccccctccgtaggtagccttccctgcctcaaatttctttacatcaccaacaaccccaacatcgttggcacaatacccaccaccatcaccaaactcaccaagcttcgtgagctcaacatcagatacaccaat

SEQ ID NO: 6549 - DNA, 356 bp, Glycine max
gggtgctccaacaatgatccaggattctcaggagaagaaagattaagatttcccttatctggtgttgaagattggtgtggcttatgaaaagccaaagtagctacctcaccctgaatgctgctctgcctgtaagcactttatttgatttctcaacacattctagatttttgtttcatttgtttatattggaatttgttgtgtgtgtgtgttttttttaatttattttctcttacggtcgaaaaagggctgtttcttttgtagcttcaaatgactcttatacaatgtgatagttttggcactaaatagatgcattgtcaaattgaaatctcagtcttagatagctttcgcctttggag

SEQ ID NO: 6550 - DNA, 391 bp, Glycine max
tggagccctcaaggatgacactaaataggtttggtaacacttctagcagttccttgtggtatgaattggcctacactgaagccaaagggaggatcaagaaaggtgacaggacttggcagattgcatttgggtcagggtttaagtgcaacagtgctgtgtggagggctttgaggaccatcaatcctgctaaggagaaaaatccttggatggatgagattcatgagtttcctgttcatgtgcctaaagtggcaccaattgcttcctaaattaatcaaacatctttttctctttttagtacgattctaaaattaaagaaacttgttcatgaaacagaagagaagattgttaattattactcctgtagcttttccagtttctttggtcttgtaac

SEQ ID NO: 6551 - DNA, 373 bp, Glycine max
aaattttcaaccccttctgcgtgacacggttccgacaatgaggaggacaacgacaaaatgggccacactcaaaaaccaaaggcttccctctcaagagaatcccactctgattataaggaaaatcccctccattcttcatggcacaaaagcacccctcaacacacccgtccgcacactcacaacctgtccccctcccgctctgatggaacacaaactgcggaaaatttgtcttcacaagatactcatactgcagagggtcatagttaggatcaatgtcattgaaaagccgaaccgccacattctccttcctatttgaaacatcaagcgacaaacaacacgtgggtttgaaactcaagggatccttcctaagaat

SEQ ID NO: 6552 - DNA, 404 bp, Glycine max
tcacctcctaaaagtagtatagttagtcctactgctacaacaccagcagggaattttgctactcctgtttctatgaatgttcctgtgcctaacttgtcgagtccaccagccattgcatcagtcatgcctggttcaaattctgttcagagttccttggagattagtagtcctgtggatgcttcatcttttgttaatcagtctagcactatgaaggaggaagagattaatagtttccctggtcaaagaccatctccatcgctttctgatgttacactcgtaaggaacatcagcagaaacagcgtatcaaatcaagcaacaaatagcatacctcttgcttctggcaatatggtttccagcaatgggccccttggttcagtgccttctgcacctgaaataaccaagag

SEQ ID NO: 6553 - DNA, 408 bp, Glycine max
  misc_feature (372)..(372): n is a, c, g, or t
  misc_feature (399)..(400): n is a, c, g, or t
ggttctgaatttctagaacgactacaatttggccgaggctttttttttaatcctcccctccccgatttatacaggcaatcttgttggtcagatgtataggtttacattttttctatataaaaaaatactaggtagctcgagttttttggtgcgtaatgccacttggtttctacaaggtcgcccatttttcttgcttcatgatgtctggtcttctcgttcgagaaatcaattttgtctttgtatcttacagaataataatgtcgtactgattgaaaataatttgtattatgagaggatagagttttaggccgtctataaagttaaactgactggcaatgtacaatttgctttgctttaaataccctaaaaatngagcaagtaaactgcctacctttccgnntgtttaaa

SEQ ID NO: 6554 - DNA, 364 bp, Glycine max
ttcctcgaagcggagcccttcaaatcgctcctcttctggctcgcactctctctcctcgttggccccttcgcccctccctccatcactggcggcgacgtccgcgtcggccgcggcgaggtcgtcaacttccccgatccggagcccgagcccgacgaggacgccagtaggaagtcctcacaacggcgatccagacagcggagggccgaggaagcctccgccgccgtaggcccggtggtttccgtcagcgcggcggagaagagaaaagaatcttctggaatcgagaagcgtgcgacggtggtggaggaggagaaggggtggagcgaggaggatgtggaggtgctgaagaagcagatggtgaagaatc

SEQ ID NO: 6555 - DNA, 453 bp, Glycine max
  misc_feature (205)..(207): n is a, c, g, or t
  misc_feature (210)..(212): n is a, c, g, or t
  misc_feature (374)..(374): n is a, c, g, or t
  misc_feature (376)..(379): n is a, c, g, or t
  misc_feature (383)..(396): n is a, c, g, or t
  misc_feature (403)..(412): n is a, c, g, or t
  misc_feature (416)..(416): n is a, c, g, or t
  misc_feature (425)..(425): n is a, c, g, or t
  misc_feature (428)..(442): n is a, c, g, or t
tgatgatagcatttggggcagcaaaaggactaaattatctgcaccatgaagcaaagccttctgttatatacagggatctgaaatcatccaacatactattggatgaaggtttccatccaaaactttctgattttgggcttgcaaaatttggtccaaccggagaacaatcatatgttgccactagggtcatgggaacacaaggttnnngtnnnacaacagaagcaaacaattccccaatcgctgcctccaatattaatgccaaacaataatttcgaggtcaagaaaataaataatggtcacagtgttactagtactactactggtactgttgctactgctgctactactactactacttcgccggtgaatacttntnnnncggnnnnnnnnnnnnnngtgcccnnnnnnnnnntccnccccctctnccnnnnnnnnnnnnnnncttcccccccc

SEQ ID NO: 6556 - DNA, 329 bp, Glycine max
gatgctcagaatggtgggtcggagaatgccgctgctgcggtgtcgtttgtcgctttgaagccgcagctcctcatcgaagctcccaaagcgaacgacgcctttctgttctacaaggccgcgtttgccgctgaggaggttggccgtacgctcaaccctaagcgtaaagcggagcacgagcttcctctcatactctccgcagagctcaaaatcgctggctctaccattctcgttgctgacctcgttgatgactctgcttcaacgttagttttccctttgatgttcatcttaatctagatctatgaatgttaactctgttttttctttttttt

SEQ ID NO: 6557 - DNA, 416 bp, Glycine max
gtttcggactttgggctttccagatttgggcccatggactcatcccatgcctatggcagcaccaccgctgtaagaggcagctttgggtatatagacccagagtattataagcggcatcatttgacggacaagtctgacgtgtacgctttcggggtagtgttgtttgaggtactgtgcgctcgtccgcctcttatacgcaatgaagatcccaaacaggagtcgcttgctaagtgggttaggtactgttaccaaagtgggaccatggaccagattgtggaccccacgttgaaggggaggatcgcgcctgaatgcttccggaggttttgccatattggggtgagttgtttgtcagaggttgggacgcagaggccgtcgatgaaagatgttgttttcatgttggagtctactctgcaggt

SEQ ID NO: 6558 - DNA, 467 bp, Glycine max
ttctgtcatttgcctatatattcagaaatcacgagcctggctgctctagaacacaaagatttggtttttattctacctaacaccacatggatacgttgccggaggattgtgtttccaaaattctgtcttacacatctccaccagacgcatgtagattctctatggtctcttcaaccctacgctcttccgctgactctgaccttctctggcgaactttctttccttctgattactctgacattgtctcaagggctctcaaccccctctcccttaattcctcttcttcatacaaacaccttttctatgctctttgtcatccactcctcctagatggaggcaacatggtacatatttgatgtcctttcatgctagcttcatttgttttgcatcatataattttatatattaatcaatcaattaattaattatgtgtacatattgtagagcttcaaattagacaagtcttc

SEQ ID NO: 6559 - DNA, 403 bp, Glycine max
gccgggtcgttcgtcgtcgtcgtcggcatcgttcaaagggtgctgttgctgcctcttccttctattctcgttcctggcgctgctggtgctagcggtggtgctggtaataatcctagcggtgaagccgaagaagccacagttcgatctggagcaagtgggggtgcagtacatgggcatcacacccaatcccccctccaccgcttccctctccctcactattcgcctcctcttcgccgccaccaaccccaacaaggtcgggatcaggtacggccagtccagcttcaccgtcatgtaccgcggcatcccattgggaaaagccaccgtccccggcttcttccaacagcctcacagcacccgacaggtcatcgccaccatcgccgtcgatcgcgtcaatttgcttcag

SEQ ID NO: 6560 - DNA, 529 bp, Glycine max
aaagaattggatttaacttttgttaagttaattaaaagtcttgagtgtgtcacatgagaaattttatggtgtagttattgaaatttgaaaattgattgtcatgactttctgtggtgattcatttgtaaatgcaaggccgagattggtttctttgtaatcttatctgtgaagggttggaaattttaaatctttaaatttgtatctctttcaatgctactgactctatactggcatttgaagattatgtttttggttctattttgctttgtgagctgaaatttaacttcatttatttgaatagctcttccacacatatcggagctttgcaagtgaacaagagaaggatggcatatctagaagccttcaagagactgaggaatggctttatgaggatggtgttgatgaaactgaacatgcttattcttcaaaactggaagatctgaaaaaggtttccctcccccccttttattactgaattccatgctgtatttcttgtttacaatctatgtacttttgtagctggtagatc

SEQ ID NO: 6561 - DNA, 366 bp, Glycine max
agatttgggttttacttcggtggtctgtgtactagagattttgattaaatgtcaatgcggattattggggtgaaactccgattcagaacagagaaaaatagttccaaaagcacaatggaactgcatctaactttatgtcctttgatgacttcagttactaccgtgttttctcatttactatcgtcagtttggatttttctgctcccatgttgcaaaaatagagtaagaagaataggctcataaatttagttatctaagaattttagtttaatagtttgggggtggttgatgctggatctagcaccctctaaaatgagcaattgctcaagatgaaaaagtaagggcgtatcctctgctgactttaac

SEQ ID NO: 6562 - DNA, 351 bp, Glycine max
tggaccgacccattaaacttttgttactttagcaagttatgtaagtgtcgatggtggtaatattaaagagtctaccatcgaccacagccagtttggcactaacagcttctacatggcgtggaagttctgtgtttgaaaagatcgttaacgtggttgtttttgatatagccgagataatggagtagagttacagggacaatactcaatgtaccgaacatctcttgtatgtttccggttgtgttatgattttattttgtcagtgctcccgatattgaaattgtcagataatgaatgctcgtgatggatgtatgttactctttacattatcttttgacggagttgctgtctgac

SEQ ID NO: 6563 - DNA, 356 bp, Glycine max
  misc_feature (55)..(55): n is a, c, g, or t
  misc_feature (57)..(58): n is a, c, g, or t
aaaacattacttgattttgctcagcgctctatacctatagttggatttaatagtnanntcggggggtcaaggtcaccatgtgaactcagagtcagtcctgagttaattagataattggacattcatctatggaactgtttttcaaatgacggcagtaaatttctcagggacaactgttgtgtgtctaatctctttggagcagcctgatgtggaaggaccgggagcatgcatctaccttggaagttttaaccccttcatatcttgttatattgtggtaatgccatgtagcattgtgataaatttgcaatcaggccctctgtgtattatgatagacttggcttgatttgttcctctta

SEQ ID NO: 6564 - DNA, 374 bp, Glycine max
attctgttggtgccaaaattgatacgaagacacttgggcataagtttacaatttcaaaggaagtaggagatccaaaagtatctaaagttccttcagttacaaacgcacgttacttgccttttctacaagacaatgtgttagctgatgtttcatctgatagttcgagcacatctatgtcgtcagattctgaagatgaagatgtgcaagtagctaatggctaaattttcatagcggaaagatgttaagagtcttttgtaggtttatgtgtaggataaccattttttcatgcaaagattggcactggaaatttggatgatacatccatcgtagtaggtagttatatagttacaaaaaggttggtctgtaacccaata

SEQ ID NO: 6565 - DNA, 844 bp, Glycine max
  misc_feature (781)..(782): n is a, c, g, or t
  misc_feature (785)..(787): n is a, c, g, or t
  misc_feature (800)..(806): n is a, c, g, or t
  misc_feature (810)..(810): n is a, c, g, or t
  misc_feature (826)..(840): n is a, c, g, or t
ctgtctatttggcactgcgtagagttttgtgtgtcttgtttttttgtgttgttattacagtacatatcatatttgttaataggacttttacagaagtcagtgtgtcaaataatcaatttctttggaatagtaagtctctttccaatcctgaatgagaattgagaacacatattcagtcactttgaagtttcttattatatatgaaaactgggaactgatagctgcgtgattaagaaaatcgtataattctgcttagcaaatttgcttctgaaatgttttatcatgaaacttctaataactaatgcagctactttataattgtaattgtaataaaaataattttcgtgttgagcagttaagatactcagctcagattaactagtctattaatttacctttatatattttttttctatgccttggccgatatcatatattttgcagtgacgctcctaatttcattttagtgtccactgtaattgaatacttgatgaggttatttgtattattaatggcttgggctgcttggctatatatatttatcgttccataatagttttgaagatatgctattttctatatcctctttatccttcttattagtttattctttttctccaggaaattaaagttcttagcaatctaaaacattcaaacatcgtacagtattatggcagtgaaatagtaagcaatctcctacttcataattagctgctcaagattaataatcattattctgtaacagccttaaaaccttaacatatgtgcttgcaggttgagnnacnnntttatatttatcnnnnnnntgtncatcctggttcaatannnnnnnnnnnnnnnatca

SEQ ID NO: 6566 - DNA, 365 bp, Glycine max
acttatggatatcttgctccggagtttgtgtacagaaacgagctcacaacaaagagtgacgtatatagtttcggtgtgctactacttgaaatagtaagtggacgtagacctgcacaggcagtggattctgtgggttggcagagtatatttgaatgggcgacacctcttgtgcaagctcatcgctatcatgaactcttggatcttcatataacttcctcctcttctagtatcatcccagaggctagtaccatccaaaaggtggttgacctcgtttattcttgcacgcagcatgtcccgtctatgcgccctagaatgtctcatgtctttcaccagctgcaacagattacccaccacatgcaaagtaa

SEQ ID NO: 6567 - DNA, 398 bp, Glycine max
atggatctgaatatgctccaacttatgaagacaaggatggggattggatgctggttggagatgttccatggaagtaagtttcttctcctaaatctgttctttgaattaactagtagtaattatttgttgttattatatatatatatatatatattaaaaggttgtgtttttgctaagcttatgttaattattattgtagcatgtttgtgtcatcctgcaagagactgagaattatgaaagcatcagaagcaaaggggttgggttgtttttgaccaaaataaaaaaacaaagcaggaccatcatgcatgcccatatccaaaacatggagcaaagcaattttcagtgacgtcatccaagagaatttcttctgtttggaatatgcaagagctaggcactta

SEQ ID NO: 6568 - DNA, 369 bp, Glycine max
aaacgggttaatctttcccgggtagttcaacaacatggccggccagaaggtggttaattgaattgatcacttcaacaccatattcctttgaatagcttattgctgaaggtgcctcttctccagtggcctagtggagttgagcttgtatagtataacatacacatatggtaaaaaggatcagggaatgcatttgactttggagtaaaggcctgagggtatctgcctaagagtgagcctgtgacttttagcattatgtgcacccgtaaactatgagaaagagacttcaaactaggccgtcccctggtattgataagcaaccagttgctccttggtcatctctacttttccattaaaaactaccacttaatt

SEQ ID NO: 6569 - DNA, 414 bp, Glycine max
gccattgtccatcccaagatggaggagtccttgtttgggaacttggagcagcacaatcatgtccaagtaggaaaccaccccaggagtgagttctacaatgagtttctaggggtggccaaggcagtgtggttgcttcatttactggcattctcgttgaaccctgcaccaagtcagtttgaggcaagccgtggagctgagttccatccccagtatatggacagtgtagtgaaattttcaggcgggcgagtgccggctggtcaggttgtagggtttccagttagccctggatttaagcttgggaatggctctgttataaaggccagagtttatttgatagccagaacataaagtttttctgaggggaaattctttttgcaccattttcttttctggttccaccctatcacttgttta

SEQ ID NO: 6570 - DNA, 339 bp, Glycine max
agcactagttggcaactttccacatacggagttacagttcgtcatgaatgagtactttttccaactcatttctcttcttacaaccccaacggcatttctttgaacacaaggaattgaatagggctagccttgtggattgaagggatataatgcttgaagtggaaggtgattttgagagaacaattgaatacccatcatccatgtaatctgttccatcaggaaagagctgccacacaaggcttccagccccactacctcctttctttgtagagttcaggatggtcttgtacacagtgtttataaggttgtctctatatgttgaattgtagccaggagctt

SEQ ID NO: 6571 - DNA, 765 bp, Glycine max
ttctagaactcccaacttcgaatcaatatgaaggtaagactttgtaccctctttcaagttttgtctccttaagaaccatataaatctatttataaatttttttgagatttgctctgcttccaagcttgaattatactcctttttctagttaagtacaatttgatgaaatttgagatcaagttttagtgttcaaattacaaccttgcttgctttcaacctttttattctttttccttttaccgttcaaggaatcaagttttggaacgttcatgcttagaaatgattattactatagatcctaaaagttcaataatatttgtccgacagaaagtggtgctaaaggtggaactccatgatgacaaaatcaagaaaaaggccatgaaggcagtatctggtatttcaggtatggaatctcagcatccaataatctttgtcaattgtcatgttaattatatacatctttttttatgcttagctaattattcaaggttaaaaaaccaaatggtacacaaaattgaatgtttttggggtgattttttcaggggtagagtcagtctcagtggacatgaaggaccagaaaatgactataattggggatgttgatcctgtaacagtagttggaaagtttacaaaattcagtcttggcaagcttagaaaattctgtcatgttgagatactttcagttggaccagccaaagaggaaccaaagaaagaggagaagaagccagaagccaagaaagatccaaaggaggaatatgctgaact

SEQ ID NO: 6572 - DNA, 419 bp, Glycine max
gggagggtgggtggcggtgcctccgcttcccggagggctcgtgatcaacgtcggcgatctgctccacattttgtcaaacgggttgtacccgagtgtgctgcatcgagttcgggtgaaccgaacccggcagaggttctcggttgcttatctatatgggcccccaacaaacgtccaaatcagtccacaagtaaaattggtaggcccaacaaggcccgttctttatcgatcagtgacttggaacgagtaccttggcaccaaagcaaagctttttaataaggctctttcagctgttaggctttcttcatctattaacggtttgtttgatgtaaacgaggataagagtaacgactttcaagtgggctagaatctagatagccataggcttgaactttttttacccttctcggtcaaatcttgta

SEQ ID NO: 6573 - DNA, 370 bp, Glycine max
cgttgcaaccttattatcctcgaactccggggcgagccagcgtcgacgaaactcaaattcgcgaacctgaacgcgttgagcgtgtacccgagcacgtccagtccacgcgcccagaacggcttgttcgtcttcccctcaggaatcagatcctcgatcggagaatttaccttctccacgctcgcctcgtcgccgccggcgacgaagcggaggagctcgttgagcagcgccacggcggcggcgcggtcgcacgaagcggtgtggaggcggaggaacacggcgaagcggtcgtggctgatgctatacacggcggcgtggagtacgtcgacgtcggcggcgtaattgcgccacgtgtcctcctggttcatctcgt

SEQ ID NO: 6574 - DNA, 465 bp, Glycine max
  misc_feature (351)..(351): n is a, c, g, or t
  misc_feature (454)..(454): n is a, c, g, or t
  misc_feature (456)..(458): n is a, c, g, or t
ctaacctaatctcccaaacaaacaaaccaactcaaccttatcaatatcgtttaaataaattttgatcgcgcacgcgctttgagatagatcatgctgcgtttgtgctacggccctctggattgctgcttcggacgccgtggtggccgcgccgccgacggacttctctggcacaccgacttgaagccccacgcctccggcgacttctccatcgccgtcgcccaggcgaattacagtcttgaggatcagagccaagtcttcacctccccctccgccacctacgtcggcgtctacgacggccacggcggccccgaagcttccagattcgtcaacaagcgtctcttcccttatttnaacgatattgataaggttgagttggtttgtttgtttgggagattaggttaggtatctgaagaagaagcagagagagagaaatgggaatgaggggggggacaancnnnccccccc

SEQ ID NO: 6575 - DNA, 335 bp, Glycine max
cggctcagatacgggactgttgagcagcttgcagatcctcggacacagcttttgaaacgctgccaccggcaccgcctcccctcctccgctgccaccaccacactccaccatcttggccatgcacaccgccgcccccgcctgcacccccttgttctgcttccccattgcctcgaacagccccaccactgtccctacacctcctccgccacccctctgccatctcccttcaaatactgcgtggcaagggcgcccatggtgtcgcgacaggcgttgcggatggcaaagtcagccccttgggtgcttcattgtgtgaagggagtgttgtgtgaagtgag

SEQ ID NO: 6576 - DNA, 388 bp, Glycine max
aaccagtacactctctattttttctttcactaaattggattcctagaatctcagtggagccaattaaggctctgcgatatgcaccatacgttattcggtgttgttgtgcttttgggcggcgagattgagtgggagaaggagagataattcctcactcaaatttacatatcatcattgtaatttattgttttccattctgctccccttttgattgcattgcctaaatatccagcaacacggtaattttaaatttttaatgatttccctttttcaaattttaaacactcttaacaccgtaattactaattattgttgcgttgcatccttagttattaccagtattactatgctttccttgcaaacatttcgttactcctaacgttggttg

SEQ ID NO: 6577 - DNA, 343 bp, Glycine max
ctctttccttcttttgttttctgccatggaagacgagccatttctcactaccacttcccaacccatcgccgattgccttcttccatcttccaagtccttcaacgacgtcaccaccacacgcgcgcgtgacgtcgccgccgccgccgccgaggagattcaatccgaacaacaacaacctcccaagaagaaaaaactgagccgctgcaagacggcacctgcgatggtcaccatgcgagacctcaaacctaagacaccccaactccccaaacctcaatcaagttccataattcgacaaggcatgtggttactcgccgtgtacctctccataggagtagtcatatac

SEQ ID NO: 6578 - DNA, 370 bp, Glycine max
ctctactaatggttctcagttcttcatatgtactacaaagacaccatggcttgatgggaaacatgttgtgtttggaaaagttgttgatggatacagcgttgtgcaggagatggagaaagtgggttcaggaagtggcaggacatctgaaccggtagtaatagaagattgtggccagattgtagagaagtgagtcttgatacaacgatgtttcgagacatgtttgttgctattcaatgcaaatcactagtattataataagtgatttgtgtaactaggagtcaattgtccagtattaatgtaactctcaaatttgtactcctaaatctgcttttacatttgttccaactaaaaatgcgtagctgtctgtagt

SEQ ID NO: 6579 - DNA, 369 bp, Glycine max
  misc_feature (362)..(364): n is a, c, g, or t
actcactgcaaagaccccggctcacaaaattgagagtttcagttcccccaaggtggacgcctgaggaatttatggcagatgtgaaagttccatctgctgctagtgcaagtgagtctgctgggaaggacaatgaagtatctaaaccagagccttctaagcatgcacctttggtggactgcataaggacacgctgggcgcgtgctgtctgcagctggtcaggggatcctcctagtatagtttgagaggacattatttggagtcatttgtggtggttcttacaagtgtttttacagggaaagcactattggttcagcaaagagtagatacagtttttatgtaatttgatgtggtacctcgaggannngagaa

SEQ ID NO: 6580 - DNA, 408 bp, Glycine max
attgagttaatagacctcatttaattttccagtaatccgcactagcaaactaatttgctttagaggagattgaactgaaatgcttatttaacttgcgctgtctaaatatttgtatatatagctggcactgaacttatattcttaattaaaaggtgtgaaatgaagaatgtgttgctggaaatggaccggatattacgtccttgggggcacgcaatcattcgtgaatcccattattttacagatgctatcacaaccattggtaagggtatgcgttgggaatgtcgtaaagaagatactgagaatggcagtgacattcagaagatattagtatgccagaaaaagctatggtattcatccaaccagggttcaagatgacaaactatggaacttaagccatggtaactggta

SEQ ID NO: 6581 - DNA, 1026 bp, Glycine max
  misc_feature (998)..(1000): n is a, c, g, or t
tggggtatctttctacagcatttcttgttgcatccactgtgactggatatctgtctttgttttacccttacaaaggaaagtctattccacaaggggttctgtttaagcacaccactttcacagtgttcttcaacatttctttgtaagtactgtttccttataagtactttgtttaccaattgtcatgattaatttttcaggtattaaattataatacgtgatactttttttcaattgcttttctccttgttcatggaaatggaagattcaaagatagatactgattgtactaggagttgattcttgggggttgtttgagattaaatttctggatctcgttctccactattttaatttatataagcaattctgagtaatgttttaacatgcttcttttgtgtgccatagatattgggtttaggattttactgcctattttgattactgtgattcaatataccatctaaaataggcattcttctttttaaaaaggagcctccatttgatcagtgtatatgcaaaatacctgtgtacgtgttgctccaagtagaatacacctactttgtggacatgctaaatgtagaatggtaatagatgaacttctagtagtaaacagttatgaaaaaatcttaacaaaagattttacagtggatcatgatggcattattagttgcacttggtgtaggaaactaccttgtacttcatgaaaaaaacagcattggtgatatggttttgattaatgttactgcaaaatgcgatgactatgagattctcatctctattataaatggcttttcttctgggctatggtttctttacttaggttcaccactggattagctgcagctatgctgttatggccaacaatcaccgaacacattcacctgacacgcaatgtgcaccgcaatatcaactatgaatgtcctacagctaaaactggtctacttggaggtggtgcctttctatcacttgattcatctctcctttggttgattgcnnnttatgctagctgacaatgctcgcgag

SEQ ID NO: 6582 - DNA, 344 bp, Glycine max
cttggtcacagatccaactcctcaatatccaggtggatgtactgctgctgatcttgcttatgtgaagggatgtgatggcttagctgcttacctttctgagaagtctctggttgagcagttcaatgacatgagcttggctggaaatatcagtggctcactggaaactagctcaactgatccagtaaatgctgcgaaccttaccgaggaccaactttacctaaaggagactttggaagcttaccgtacagctgccgaggcagcagcacgtattcaagctgcatttagggagcattcatttaaattacgatatcaagcagttgaaattatgagcccagaggaagaaa

SEQ ID NO: 6583 - DNA, 392 bp, Glycine max
aaagctcaatacattggtattgacaccgttgctcaatattgaactcaatcttactctattttcctccaaccaaaataagttgagtctgagatgactagcccaatttttcaaggttcttttttttaaagtccatattatctataagtgttttaaattgaaactttcacggtctaatacataaaatttggtacataatcatctcagtttgatatggttgtagcaataacagataaaaatgaaataaatgcttaactgtttgaattgaactgagcgcccaaaattgaagtcttgattagtgtctttagaaactgttctagaatcaaattctactaaagtgactttgcctgtcttttattttattattatcatcattcctacactggtcttagaca

SEQ ID NO: 6584 - DNA, 498 bp, Glycine max
acaaaagctgaggaccccgctgctcgacgttacattatttcattgaatgcaaacaccactcttgtagttgaaggcatggaatttgtaaagtgtgaggtcgtgggacagagcttcatgcttcatcagatacggaagatgattgggatggcagtggcaatcatgagaaattgtgcaccggagtcacttatcgataaagctttgcagcagtgagtacaacttctattgtttattatgacaagtttctatttaaaatgcagtgcgattctcattggatgtaattttttattttcacttttgttttcctaaatgcagggatgttaacattaatgtgcctactgcccctgaggttggattatatttggatgagtgcttctttacttcatataaccagaagtggaaagatcatgaagagttgtccatgaaagcatatgaaaaagatgctgaggagttcaaaatgaagtacatatactctcatattgcttccacagaacagaagga

SEQ ID NO: 6585 - DNA, 350 bp, Glycine max
gatttgcactttgtgtgtatacaggtattcacacaaccagttttccagcttgtggaaacttgggttgcgaagcgttggcctgaaagcaacttcatgggaaaagaatatcgtgttggcaagttcagattcaatggattcaggatgatatggaggacagtgtacgtgattttcacagcagtggttgctatgatacttcccttcttcaacagcattgtgggtttgcttggagctatttccttctttcctttgacagtgtattttccaacagagatgtatctggtgcaggctaaagttcccaagttttctctggtctggattggggtcaaaattctaagtggcttctgcttgat

SEQ ID NO: 6586 - DNA, 267 bp, Glycine max
agttgtgtgcagcgtctcttctcatagcacgtaccaagtccctccaacttcaccatcaccgccacgtgcgtcactgcttccccttcttcttcttaaaccgcaatcccactcttcaggtttcacccttggctctcttccttgtgcaacgcgaaatcactcatcaccacgcgcctcttctccagctactactccctcgaacagttctctgatgacgaatacgactgcgacttcgagaaccaacaggtttttcttttctctccttttttt

SEQ ID NO: 6587 - DNA, 558 bp, Glycine max
tcccttaaacgtgcccttttgactgctttgaggtgtgttgatccagattctgagaaaagaccaaagatgagtcaagttgtccgcatgcttgaatcagaagaatatcccataccgcgcgaggtttaagttctcataatctcatacattaaatcacaagaactttccaactttgtgtggcagttgttttttgttttaacttcatcatgttccttgcaacaaccattaaactcttttttcttaagaaacatgatatgtttctcaaatgaagtgggtgacatttcaggatcgaagacgccgaaagagcctggcaggaaatattgagctgggggaccagaaggagacttctgacacagaaaagactgagaatccagattctaagtctaatggcagaaggaaccaaaggaagtagagccatgaatctcaattctcaaagctaaaagtaccaattcgaggataagatacactcttgaagggccatttttgcattcttttgagcttgagtttggataactgccacgtttgacatcaaagacatggaaaggaaagagttactttggg

SEQ ID NO: 6588 - DNA, 494 bp, Glycine max
gagtagagtgagcgaaagtggaaaacaaaaatggaggagactcaagtgctgcacgaactccacaagctatcacagatagaatcagaggaaaccctaaaccaaatgctatgcaccctttggtccactcgtaaaacgggtcttcccctctccgacaagtcccatttccaatccctcctccacctcccttccccctcccatctcgaccccgtaagtctctctctctctctctccctcttttcgatcatcacgtgaccaattccaatctcacgtaacggatttcaacgttaataataggttttagcgtgcctccgttccctcgtcagaaaatgcgcgcaccagaacctcgcccgcgacgaccttctcagactgtttccccgcgatcttccgattcagttgcaaacgaatttggtatcagcgttgcagagaaacagagatcggtggaaggaggacgtgagtcacgtgattccgcagctgaagggaacgataaactttgc

SEQ ID NO: 6589 - DNA, 402 bp, Glycine max
caaagtatgcaccaaaacaatttgcagagacaaaggtacatgggatcttagctgcttcaatttcccttctaatttttcttttcttatcaagaacagcttggaacggaggaaaagggtttactctatcctcttccaccccaaaatctgatggaagaaatctctgcaacaccaatataaaaacaagaatatggaaaagggtttacgctatcctcttcattataaggtctgcagaaggaaatacttaaagaaagctagtgaatcacgttggatacatcaactttacatgaattcaacatatatatataataccacgataaagtgatatttcaaaatatgacaatgattggatcagactcttatttgaacaataacactttatattcaagatgtaacggttggttg

SEQ ID NO: 6590 - DNA, 469 bp, Glycine max
  misc_feature (403)..(406): n is a, c, g, or t
  misc_feature (409)..(426): n is a, c, g, or t
  misc_feature (430)..(431): n is a, c, g, or t
  misc_feature (439)..(439): n is a, c, g, or t
ccaacacaaacaaaaacatctctcagcaaatgaatattctcggacaatcactccaccaatcaaacaacggcagctactcttgttcgtcgccggagactgcaaactcctctaaccttccgaccactccgaacgccgttcactccgacgaggaagtgaacacattagcatcggcgcatcctaagaaacgtgcggggcgtcgaatttttaaggagacaaggcatcccgtgtacagaggagtgcggcggaggaacaacaacaagtgggtctgcgaggttcgtgttcccaacgacaagtccacgaggatttggctcggaacgtatccaacgcctgagatggccgcacgtgcgcacgacgtcgccgcgctctcgcttcgaggtaagtcggcgtgtctcaacttcaaaannnnagnnnnnnnnnnnnnnnnnnaagnnaccccccntggggggggggggggaaaaaaccccccccc

SEQ ID NO: 6591 - DNA, 683 bp, Glycine max
gcttgggtggcttgcaggccccttctccatccttctcattgcttccaccactctcttctcttcttttcttctatgcaacacttatcgccatccccatcccgaatacggtcccaacagaagtgcctcctaccttgatgttgttcatttgcatttaggtacctacaattccctttcttctcttccttctacatcaagtgtctccagatctcgatcaccgatccagaatactccttactatcatgtgtaccaacaccatttggaacatttaatatctttctatagtaaaataagatcctcttatgctggttacaggaataagtaatggacggctcagtggccttcttgtcagtattagtttgtatggttttgcaattgccttcgtcattacaacagctatcagcttaaggtgtgttgatttatcaccacttatcatactgcttcctctcctgttatgtcatttcctttaatttccctccgtttatctgtgcaaaaccagattttttcaccatatgattgccaatattaaatttgagctgctatttttatttgtggctgcagaacaatccaaaattcattttgttaccacaacaaagggcctgaagcagcatgtgagtctgtagatgcatattatatgctactttttggggctatccaaattgttctctcacagatacccaacttcc

SEQ ID NO: 6592 - DNA, 343 bp, Glycine max
ctctcggacacccaccttcctccgacactccctcttcagacaccgcaaccaccaccatcctcaccggcgtcgaaaacgaaaatgcaaccgaaagcgacgatgacaacgacaacaacgacgacgacggccccttcttcgacttagagttcaccgtgcccgacgaagacgcaaatgaaaatccaaacgccaaccacacccaagaagaagaagatattagcttagaagaatccgacggcgagagagagtttaagttcactctgtccccttcgagcaacgatcgtagtgatcccaacctttccctgcagtctccttcagaggatatcttcttcaagggaaagctggt

SEQ ID NO: 6593 - DNA, 476 bp, Glycine max
cacggaaatagtgcgttcgaacttcgaaattagtaattgaagcatgcgatcacctcagcctcttcgcagcggcggcgataacagttgttcgccgtcgcataaccctcgtttccactcgacggtggcggaacacaaactacgtcgcttcaacttgctaatactcgtgttccgcctcacctccttctccttctccctcgcctcctccgttttcatgctcaccaacactcgtggctccgattctcctcactggtaccactacgacaccttcaggtactcttattacttactatttcagacctaatttctaaattcgtgtggaaattggaaagtaagttaccgaaatcggttcagattcgttctagcggcgaatgcgatagtggtggtgtactcaatgttcgaaatgggagcgtcggtgtgggaaatttcacgaggcgtaacactgttccccgaagtgttgcaaatatggttcgacaaac

SEQ ID NO: 6594 - DNA, 446 bp, Glycine max
tactgtgccacgtttgatctcatcacagcatgcttatggcgttgtcacacaaaagcattgaagatagatgcagataaggatgttcgaatgatggtcgccgtcaacgcacgtgctaagttcaatcctcctttacctgttggttattacggtaatgccattgcatacccagcagcagtcaccacagcagggaagctttgtggaaatccatttgggtatgctgtggaattaataaataaagtgaaaggtaaggccacacaagagtatatgcattctgtggcagatctattggctattaagggacgatacataccaagaatggtgaggtctcttactgtgtcagatttgagaggttttgatcccagacaaattgattttgggtggggccatgctctctatgctggaccagctcaaggaggccttggaccctttccaggagtaacgtttaa

SEQ ID NO: 6595 - DNA, 878 bp, Glycine max
  misc_feature (584)..(585): n is a, c, g, or t
  misc_feature (595)..(597): n is a, c, g, or t
  misc_feature (613)..(613): n is a, c, g, or t
  misc_feature (621)..(621): n is a, c, g, or t
  misc_feature (625)..(630): n is a, c, g, or t
  misc_feature (641)..(643): n is a, c, g, or t
  misc_feature (649)..(652): n is a, c, g, or t
  misc_feature (658)..(660): n is a, c, g, or t
  misc_feature (672)..(676): n is a, c, g, or t
  misc_feature (684)..(689): n is a, c, g, or t
  misc_feature (693)..(702): n is a, c, g, or t
  misc_feature (722)..(727): n is a, c, g, or t
  misc_feature (732)..(739): n is a, c, g, or t
  misc_feature (774)..(777): n is a, c, g, or t
  misc_feature (796)..(798): n is a, c, g, or t
  misc_feature (800)..(815): n is a, c, g, or t
  misc_feature (817)..(827): n is a, c, g, or t
  misc_feature (839)..(839): n is a, c, g, or t
  misc_feature (841)..(843): n is a, c, g, or t
  misc_feature (849)..(850): n is a, c, g, or t
  misc_feature (853)..(856): n is a, c, g, or t
  misc_feature (863)..(864): n is a, c, g, or t
  misc_feature (866)..(874): n is a, c, g, or t
ttgcttgcagcaatcaattccgagaggttttttttagtcttcttctatgtactaaatattaaactatatacagaaaatcattcacacactattcacaatttgattcttgaatttatactgcatatgttactattgttcttttgttggaaacatgggatcatactctttaaatatattctgttttaccaagagtccttgtactatatcatttgaaaaaaaagccttagggtttgaacaagggatcataccctttgagtatattctgttaagtgtccttgtattgtatcatttggcaaaagcataggatttgtagatttcaagcatgctgtatgcaatgctgttattgttatgtattaaagtacattatgtgacttagcttccttgccccataaggagacaaaagggtgaaatcaaccactgttacctaacagttgaacaattaaaaaatttactgtttaaaatctgtatagattgtttttaattttcatatgatgattctttcaggcagctgctgtggcacactccctcttctgtatgtgctacaaataacaatcttcaagttgagaatgcttcagttcttcttnnactttgctgnnnttcacaaggtaaatcnctgacatncttnnnnnnttcatgtggtnnngatcannnnacaaannntttttttgtttnnnnntaaaaaannnnnntcannnnnnnnnnaatgaaatccttttttattnnnnnnttgcnnnnnnnntatgatcattttttttttcttttctttttttaatnnnngaaccaaaggaaccatccnnnannnnnnnnnnnnnnnnannnnnnnnnnnccccacccctcncnnnccctcnntgnnnngggtctnncnnnnnnnnntttt

SEQ ID NO: 6596 - DNA, 1430 bp, Glycine max
  misc_feature (442)..(448): n is a, c, g, or t
  misc_feature (457)..(460): n is a, c, g, or t
  misc_feature (462)..(462): n is a, c, g, or t
  misc_feature (464)..(464): n is a, c, g, or t
  misc_feature (467)..(469): n is a, c, g, or t
  misc_feature (474)..(475): n is a, c, g, or t
  misc_feature (478)..(479): n is a, c, g, or t
  misc_feature (481)..(484): n is a, c, g, or t
  misc_feature (494)..(496): n is a, c, g, or t
  misc_feature (502)..(512): n is a, c, g, or t
  misc_feature (515)..(515): n is a, c, g, or t
  misc_feature (517)..(523): n is a, c, g, or t
  misc_feature (526)..(527): n is a, c, g, or t
  misc_feature (533)..(534): n is a, c, g, or t
  misc_feature (537)..(539): n is a, c, g, or t
  misc_feature (544)..(547): n is a, c, g, or t
  misc_feature (549)..(550): n is a, c, g, or t
  misc_feature (557)..(558): n is a, c, g, or t
  misc_feature (564)..(567): n is a, c, g, or t
  misc_feature (575)..(598): n is a, c, g, or t
  misc_feature (600)..(605): n is a, c, g, or t
  misc_feature (614)..(615): n is a, c, g, or t
  misc_feature (618)..(618): n is a, c, g, or t
  misc_feature (620)..(626): n is a, c, g, or t
  misc_feature (636)..(639): n is a, c, g, or t
  misc_feature (644)..(646): n is a, c, g, or t
  misc_feature (649)..(662): n is a, c, g, or t
  misc_feature (669)..(669): n is a, c, g, or t
  misc_feature (671)..(683): n is a, c, g, or t
  misc_feature (689)..(692): n is a, c, g, or t
  misc_feature (694)..(710): n is a, c, g, or t
  misc_feature (713)..(722): n is a, c, g, or t
  misc_feature (724)..(725): n is a, c, g, or t
  misc_feature (727)..(731): n is a, c, g, or t
  misc_feature (736)..(752): n is a, c, g, or t
  misc_feature (756)..(769): n is a, c, g, or t
  misc_feature (773)..(778): n is a, c, g, or t
  misc_feature (780)..(787): n is a, c, g, or t
  misc_feature (797)..(802): n is a, c, g, or t
  misc_feature (805)..(812): n is a, c, g, or t
  misc_feature (814)..(824): n is a, c, g, or t
  misc_feature (826)..(850): n is a, c, g, or t
  misc_feature (852)..(860): n is a, c, g, or t
  misc_feature (862)..(870): n is a, c, g, or t
  misc_feature (874)..(875): n is a, c, g, or t
  misc_feature (877)..(877): n is a, c, g, or t
  misc_feature (879)..(879): n is a, c, g, or t
  misc_feature (881)..(883): n is a, c, g, or t
  misc_feature (885)..(892): n is a, c, g, or t
  misc_feature (897)..(900): n is a, c, g, or t
  misc_feature (905)..(908): n is a, c, g, or t
  misc_feature (911)..(913): n is a, c, g, or t
  misc_feature (915)..(915): n is a, c, g, or t
  misc_feature (919)..(932): n is a, c, g, or t
  misc_feature (934)..(934): n is a, c, g, or t
  misc_feature (936)..(936): n is a, c, g, or t
  misc_feature (939)..(946): n is a, c, g, or t
  misc_feature (950)..(963): n is a, c, g, or t
  misc_feature (971)..(978): n is a, c, g, or t
  misc_feature (982)..(987): n is a, c, g, or t
  misc_feature (992)..(998): n is a, c, g, or t
  misc_feature (1002)..(1004): n is a, c, g, or t
  misc_feature (1009)..(1029): n is a, c, g, or t
  misc_feature (1034)..(1034): n is a, c, g, or t
  misc_feature (1037)..(1058): n is a, c, g, or t
  misc_feature (1060)..(1060): n is a, c, g, or t
  misc_feature (1069)..(1071): n is a, c, g, or t
  misc_feature (1073)..(1085): n is a, c, g, or t
  misc_feature (1092)..(1096): n is a, c, g, or t
  misc_feature (1099)..(1103): n is a, c, g, or t
  misc_feature (1105)..(1107): n is a, c, g, or t
  misc_feature (1109)..(1152): n is a, c, g, or t
  misc_feature (1154)..(1157): n is a, c, g, or t
  misc_feature (1160)..(1202): n is a, c, g, or t
  misc_feature (1205)..(1212): n is a, c, g, or t
  misc_feature (1214)..(1220): n is a, c, g, or t
  misc_feature (1222)..(1233): n is a, c, g, or t
  misc_feature (1235)..(1243): n is a, c, g, or t
  misc_feature (1245)..(1251): n is a, c, g, or t
  misc_feature (1253)..(1259): n is a, c, g, or t
  misc_feature (1261)..(1261): n is a, c, g, or t
  misc_feature (1265)..(1273): n is a, c, g, or t
  misc_feature (1276)..(1280): n is a, c, g, or t
  misc_feature (1282)..(1296): n is a, c, g, or t
  misc_feature (1298)..(1302): n is a, c, g, or t
  misc_feature (1304)..(1307): n is a, c, g, or t
  misc_feature (1309)..(1314): n is a, c, g, or t
  misc_feature (1316)..(1320): n is a, c, g, or t
  misc_feature (1322)..(1328): n is a, c, g, or t
  misc_feature (1330)..(1333): n is a, c, g, or t
  misc_feature (1338)..(1338): n is a, c, g, or t
  misc_feature (1342)..(1342): n is a, c, g, or t
  misc_feature (1344)..(1351): n is a, c, g, or t
  misc_feature (1360)..(1361): n is a, c, g, or t
  misc_feature (1366)..(1373): n is a, c, g, or t
  misc_feature (1379)..(1389): n is a, c, g, or t
  misc_feature (1394)..(1394): n is a, c, g, or t
  misc_feature (1400)..(1416): n is a, c, g, or t
  misc_feature (1418)..(1425): n is a, c, g, or t
caatctgaagaacgccatgatagcattcttggtccctctaccctccatcctattctacctctcattccaatcggccattagtactccttcttcttggtcttctctgtggacatggtgctatcaccaccctctgctattggccaatgtccttttcttcttcaatgtcaatttcctcttctggctcatcggcctaatccaatccagccactgggtacactttccactttttccttcttttctgctttggtttttcaaattgacaccttttgctgttgctgttggtgcagatgattgacccgtattggacagtgatacctgtgatgcttgttcattactattcaactcaccctttggcacagtatcagtggtggaggtcgaggatcgtaacgttgttgacttgggcgtggagtgttaggctgatccacaactacttcaggagggnnnnnnntatcttcgnnnnantngannnccccnnccnngnnnntggggcctannncaatcnnnnnnnnnnngancnnnnnnnccnntttttnnctnnntttcnnnntnngggattnnccaaannnnaacacccnnnnnnnnnnnnnnnnnnnnnnnnannnnnnacgaccccnnaanannnnnnnagatacctcnnnntgctnnnttnnnnnnnnnnnnnnacccccncnnnnnnnnnnnnnaaaggnnnngnnnnnnnnnnnnnnnnnaannnnnnnnnntnngnnnnnggaannnnnnnnnnnnnnnnnaccnnnnnnnnnnnnnncaannnnnncnnnnnnnntggtcaattnnnnnnctnnnnnnnnannnnnnnnnnngnnnnnnnnnnnnnnnnnnnnnnnnncnnnnnnnnngnnnnnnnnnaatnnancnannntnnnnnnnnccctnnnnaaaannnnctnnnancacnnnnnnnnnnnnnnangnccnnnnnnnnacannnnnnnnnnnnnnatccttannnnnnnncctnnnnnnactannnnnnntacnnnaacannnnnnnnnnnnnnnnnnnnntcatnacnnnnnnnnnnnnnnnnnnnnnntnaatccctcnnntnnnnnnnnnnnnnaaatacnnnnnacnnnnnannnannnnnnnnnnnnnnnnnnnnnnnnnnnnnnnnnnnnnnnnnnnntnnnntannnnnnnnnnnnnnnnnnnnnnnnnnnnnnnnnnnnnnnnnnncannnnnnnncnnnnnnncnnnnnnnnnnnncnnnnnnnnncnnnnnnntnnnnnnnanctcnnnnnnnnnccnnnnntnnnnnnnnnnnnnnncnnnnntnnnncnnnnnnannnnncnnnnnnncnnnncaccnctcncnnnnnnnnccctccacnncacannnnnnnntccccnnnnnnnnnnncactnatacannnnnnnnnnnnnnnnnannnnnnnnacaca

SEQ ID NO: 6597 - DNA, 360 bp, Glycine max
agcttctcgggtggtgggtttgtacgaccatctccgagaccttaaaaagactctctcattagtcaaggcagtgctgttagatgctgagcaaaagcaggagcataaccatgagctgcaggaatggctgaggcagctcaaaagtgtcttctatgatgcccaagatgtgttggatgaatttgaatgccaaacactgcgaaagcaagtgctcaaagctcatggtaccatcaaagacgaggtaagccacttcttctcaagttctaatccacttgtttttcgttccaagatggctcaacaaatcaaagatgtcagcaagaggctagacaaggttgcagctgataggcataagtttggtctccgaaa

SEQ ID NO: 6598 - DNA, 547 bp, Glycine max
tctttgaggtcagacacttagacttgtctcatgtttttgtttcatttaagttgttgaatttgttgttcagcttctgaaaaatgggaaaaaaaacaaaaaacaaatggtattcttgcagttctggcactactcagggaaagccaaaatatgtaccatggaatgatgaattgtttgacaccacattgcagatatatcacacctcttttgccttcaaaaacaggtatgtaattcaaattcacagtgatttttttcatttttcaagctagttggaattggcaaatgacaccaattccattgtgtagggaatttcccataaacaatggcaaggccttgggctttatctacagcagcaagcagttcaaaaccaaagggggtgtgctagcaggaactgccacaaccaatgtgttccgtaacccggggttccagcatgcgatgaaggcgattcagtccccactttgcagccctgatgaagtcatatttggtcctgattttcaccaatccttgtactgccacctcttgtgtggcctaatcttcagggaaaaagttc

SEQ ID NO: 6599 - DNA, 908 bp, Glycine max
  misc_feature (898)..(898): n is a, c, g, or t
  misc_feature (900)..(900): n is a, c, g, or t
tatacacgatcaacaggttttcaaatgtaagactatctaattcaagtcttttattatgggattgaatttaagatatcattaacagaactaaaagagcacatgtctttaagctgaaaaactaaagatattttttgggtgcagatgtgattgcatacacgactcatgtaccatcatttgccgacacatggggttgggttatggtatgcgaaaaaaaaaagccttgtttctttttgtacttataattaaacattccactaaactcttgttcaagttattgccattacatgtttcaattatttttgttccgaattccttaaaattttactttactttttgtgactttaaaaaatatcattcacgacattttaaggctaacagttaaaattaaattttaataaagttagatactaaaatatctaatgtattaaaacaattatatataatatgagagactaaaatgaagtactcttaaatattcttcacaagaatttttatgctttcgattcaggcttcggaccaaccactatcgatttgcgctaatgaaatggacagaagaatcgaagcaagaatagatggggaacttctatatctaaatggtgcttggttccattcatctacaaccatgaataaaactgtttaccaatcgtaagtacttgctactcaaatccaaacccaaaaatcttaaaataaaattaagaccctgataatccaagttaacattctcttgtcagaacattattcaataaacaatttagatgcatgatgatattaacatgttcactttattggattttgacttccttttatgtaatcattcttgcaggctgcaaaatgaaactcacgtgtacacggaagaaagtgctagatttattcctggacatggcatggcttttcatcncnaagattca

SEQ ID NO: 6600 - DNA, 488 bp, Glycine max
ggttcttgattctgcagaaaaggttatttcagaagttgtgcaagagccggtgataaggcatgttcttgtttaataattattgtttttagagctggtctatctgtattttgtctttatgctgtctcttgtgctttttgatgtatcaggagattgagactatcatcgacagtgtgagatatcagtagcaatatctggaagtggcaatctttcagtggagaaagaagagagccagcaatttgggtaagtactaatttaaatggctggccttcatttctctatttttttcaggcttgcttgatcattcaagcttgcaaattgggactgatccgaatcaagctgaagagctggagctgagatttgtcagccctttgtacagttttgcattttttgtgcatttgactcgattaactttactagaagctctgtttaggattcttactaaacttaggggcatattttaaaggctcttgctgtactttgctgttgta

SEQ ID NO: 6601 - DNA, 814 bp, Glycine max
tcttaactttgttaccttgtttagtattctttctttgtcccatggaagaagagcaaatgcaaattttcgagtgagagcagttaatctaggtggttggttggttactgaaggttggatgaaaccttctctcttcgatggcattccaaataaagacttcttggttagtaaatatataaatgtttgtgttacaattatcctatatacgtattcttttatgcttttgttttgttgaaaatcctacattgattcgtgatatgaccaaagcagtgtatatatctggggcaatcctcatcttaaaacccgatttatataattgagttaaactctgatacacgttataagatgtttatttatagctctcttattttgcgatgatgggaagaaattgtttctctcaatttttgtaggatggaactggtcttcagttcaagtccgtgacaacacgaaaatatctttgtgctgagtctggtggaggaaccatcatagttgcaaatcgcacctctgcttcgggttgggaaacatttgcagtgcgtgagctatcctatgtgttatattattcattctttaattgattgtagtgttgaagatgtcatgtggactaataatataacatgattaaattaaagtatataagtaaaaaataactttcatcttacggactttcttgaattaagttaagctcaaactcaaattctaagatataatcctatggactattatattctcatgatgttacctgttatattgtgtacagttgtggaggctaaatgaggacactttcagattcagggtgttcaacaaacagttgtggggt

SEQ ID NO: 6602 - DNA, 736 bp, Glycine max
cataataagaccaatgtggcagaaaccataagctgcattcagtttcagtaaaaattaaattcacatattgctgagtgaaacttgtggttaaaagacaattaccttgtcagctactggatctaaaaaggcaccaaatgtagatttcattttcatctgcaatgcaagtatataaaagaaattgtttaagaaatgagtaaagttgaaaacagaaaatggtggctacgtgaggtgtaacaaaagggagtatgaaaaattaagagtaggtaccttacgagcaatataaccatcaagccaatctgtaactgctgcagcagtgaagatacttgtagtaacaactgttcctcgccaaccatccatgtagaaggctaaacaaaatatgagagaaaagatttgattagatcaaatcaaatcagtgcacaagaagatagcattgtaacaagtgaatctagatgacgcaagcacgtgtgtgtaatttgagaaaagaaataacgaagaaacaaattgaattgcatcccttcgagataaaaaaaaaatagaaaacgaaaacgaataacaaacatactggcaacaagaagaggtacagcggcgacacggccaagagtcaaaatggtgggcaaggtaagaaatttggaattggaatttgaagtacggtcattcttagagatggaaaattcacggacattcatctcggcaaccatatgtttggcacctacaattacacagacgcaggtcgtat

SEQ ID NO: 6603 - DNA, 706 bp, Glycine max
agttgggaattcctcctcaggtacagactcatccattcttgagcatttactagcctttaggttttctaaaataatcaaacatgagaaaaaaatagccttgatgcatgtgttctctgtggcaggttgctagtgctacatcaacttttgctatggttttctcttcctccatgtcagtggtgcaatattaccttctagaacgcttcccagtaccctatggtatgacacaataaataaaactaattaaaatcactcctgtgtagtgagtgtgcagcaggtttcttgaaagataagagaaacttatactaattaaagccaatgtactctggatatgcagcttcttactttattttggttgcaaccatagctgcattaactggccagcatgtggtgagaaagataattgctatcttcggtcgagcatccatcatcatctttgtactagcattcaccatttttttgagcgcgatcagtttaggtactctccatgattttagttggaagtttccatcaatatattctttttttgttgattggtttattcaaacatacttattttctctttttgggtatcacaggtggagtgggaattgagaacatggttgagaagatggaaaataatgagtatatgggatttgcaaatatctgccattaatcttaggtacatacagaagtggaagttttctatagataacatttcccagacagg

SEQ ID NO: 6604 - DNA, 789 bp, Glycine max
  misc_feature (379)..(383): n is a, c, g, or t
  misc_feature (396)..(396): n is a, c, g, or t
  misc_feature (398)..(399): n is a, c, g, or t
  misc_feature (426)..(426): n is a, c, g, or t
  misc_feature (431)..(464): n is a, c, g, or t
  misc_feature (466)..(497): n is a, c, g, or t
  misc_feature (499)..(500): n is a, c, g, or t
  misc_feature (502)..(503): n is a, c, g, or t
  misc_feature (505)..(511): n is a, c, g, or t
  misc_feature (513)..(577): n is a, c, g, or t
  misc_feature (580)..(617): n is a, c, g, or t
  misc_feature (624)..(624): n is a, c, g, or t
  misc_feature (626)..(707): n is a, c, g, or t
  misc_feature (715)..(761): n is a, c, g, or t
  misc_feature (764)..(786): n is a, c, g, or t
tgccccgccccgccagcacctcccccaaggacatccaagctgcggcggctaaagccgctgccttggatttcggccaccgaagccatgacgccgagtccgagctgagccgagccgtttcctcctcaatcctcacacaagcatcatcatcatcatccaattcatcatcgttgaagggtgtggatgacacattcttggaccttcctgatctctctctcgacttgagccatggagccgatgagtttcattattcgtcagcttggcttgtagccggagccgaacatatagagctgggttttcggcttgaggatccttttctatgggaatcatattaagttaccttcctcaagtaggccaaattagggatggacttctcgcatgnnnnntaaatatacaggngnnttaatatggaagacacagaatccctgnactgnnnnnnnnnnnnnnnnnnnnnnnnnnnnnnnnnncnnnnnnnnnnnnnnnnnnnnnnnnnnnnnnnntnntnntnnnnnnncnnnnnnnnnnnnnnnnnnnnnnnnnnnnnnnnnnnnnnnnnnnnnnnnnnnnnnnnnnnnnnnnnaannnnnnnnnnnnnnnnnnnnnnnnnnnnnnnnnnnnnnaatttcntnnnnnnnnnnnnnnnnnnnnnnnnnnnnnnnnnnnnnnnnnnnnnnnnnnnnnnnnnnnnnnnnnnnnnnnnnnnnnnnnnnatcaacannnnnnnnnnnnnnnnnnnnnnnnnnnnnnnnnnnnnnnnnnnnnnnccnnnnnnnnnnnnnnnnnnnnnnncca

SEQ ID NO: 6605 - DNA, 475 bp, Glycine max
aaacccataagatgtaaaggtgtgccatgccatgattcatgaaaaacaacaaattttatatgctcttttttattatttcaaatagctttttagctatttgaagttgatatttatatttcatatgaataaaaggtactacctgttcttctttatttgcaaactgtagctgcgatttgtcgcaagccaggttctccattgagtattgaggagatcattgtggcaccaccaatgcctcgtgaagctcggattcgtgttatatgcacttctctttgtcacagcgatgttactttttggaaaatggaggttattaccatcattttctttctctttgaatgatttaaaacatttttcttagtcaatgtcttccctttaccattttttatttactttcatactctttcttttgatctagatatctttcttttcttaaaagtcttagtggaacttcttattgaattttttaagattttttttt

SEQ ID NO: 6606 - DNA, 395 bp, Glycine max
ggggaaagtgtatgtgcacgtcatcctcccaggcctcagaaccgcttgatcaacctcctctttagtttcgttcatcgtgaacaccatcacgcgctcttctccgcagcacgatacgattccgtccatgaagttcaacacgctcgataagctcgttgtgtttgactttgacttctccgtgagcaagcgatctaggtcctcgatcacgatcagagacttcgccgtcgtttgcatcagcatcaccttccaatcggcgccgtcggtgaacttcgaaacgtccacgtcgtagacgtcgtagcagaggaacttcgccatcgcggcgacgaaggaggattttccggtgcctggcgcgccgtagaggaggtagctccgcttccaaacgcggcctagccggtggt

SEQ ID NO: 6607 - DNA, 353 bp, Glycine max
taaaatttacacatactgttataccaaaattgtttgattcactttacacatactcataaaattatggttaacatgaaaatggtgttgtgtacagaattgtgaaatagtgtctatagcgaacccggtacctgcgggacaaaagagcataaatggtgcagttacagctcatggtagagtttcaggggatgaaaacacaggatttgcatttgtgaacagtacaataggaggaaacggcaggatatggttgggtcgggcatggagaccttactctcgtgttgtttttgccttctcaataatgtcagatatcattgcccctgaaggttggaatgatttcaacgacccttcaagaaata

SEQ ID NO: 6608 - DNA, 809 bp, Glycine max
  misc_feature (779)..(784): n is a, c, g, or t
  misc_feature (786)..(790): n is a, c, g, or t
  misc_feature (795)..(803): n is a, c, g, or t
  misc_feature (806)..(806): n is a, c, g, or t
aactggtgagtttttccactcttctgctgtcgcacttgtgcaaatacattgtatttatagatgttttaattaggtcgctctgtagatattcttggatcttgcatgtattcgaagaatgagatgcttaattaatatttttcaacattgcagccctataaataatgttttcatttgatcacagctttttccctaattttatattttcttactgggtgttgtaggacgaacacgggtggatgggaaagagttttttcgccaagttaggtgaggggtctttgaaaattatggaaaaatatcaacttttgagctaaatagttgaatcctctattttatctcctgtttgttattgttaggaaccgtttgtcttatgagcaatttggtgcattcttggcaaatgttaaagaattgaattcccataaacaaacaaaagaggtacttcctcctgtcttctcagttctctcctccctcacgtttcagttaattgatacatataattcaccaaaaaaaggttaattgatacatatctgtgtgcgtaaaattacaggagacgctgcggaaagctgataaaatttttgggcctgaaaacaaggatctgtacactatatttgagggattgattaatcgcaatgtccattgacactgtgcttaggagaagttttattccaaattagtaataacggatactatcgtgtctccttatagcaactcgtttttttctctcctatgtataccatattatcacgttaattattgtctaatacaataattttttgaacatnnnnnncnnnnngtatnnnnnnnnnctnaaa

SEQ ID NO: 6609 - DNA, 390 bp, Glycine max
gaattgttgtaacaatagcttatggcaaaccgagaaaattattggctgagtcgcggacaatgtcgctttttttaagacgtttcgtggcactgccaaaaattatgcaagcagactatctaccacgaagtccccaggataaaacagcccaaattactgtataagattcccactgcaccgagagaaccttttctagaattacactctcttgtatttgagaagtcactctaaagccacccgaaaatatgacttgaaaaatcactttaacagccaaccaaaaatatgacttgaaaagtcactctaatagccaaccgaaaaatatgacttgaaaagtcactattataaccaatcgaaaatatgacttaaaaagtcactcttatagccaaccaaaat

SEQ ID NO: 6610 - DNA, 719 bp, Glycine max
ggaaatcaagcctgatagccgccatagcgacggagtcattcgccgaggcggttccgccggtccttccgcctactctcctgccccccgatttgtaccccgacgccgttcctctcaccgtcgttgacacaccttccaggtcctcctctttcacttttcaaattccacaattaatttcattgaaattttctcgaagcaatcgttctttcacgaaacaattcatcaattaaagtcgcgacctatgtttaactgaatcgcatcttttgactgaactaagttatgcgtttttcatattcttaattgtgatgatcgttgatggctagattgaagtgtctctgattatttatactccgaatgaacgcgtgcttttgttctgtgtagcttggagaagcagagaaagcgtaatgaggaattgaaaggagctgatgttgtggtgttaacctatgcttgcaatgacaccgcgtcattttcgcggttgagttcttactggttcccggagctgcagaagttggaggttggtggttttatgcatttttcaatgaggaatgaagtgtgagtggtaaacaaatagtcttttatttatgattgttatttttttgggtggtacactgatgcaggtgaaggtgcctgtaattgtggttggttgcaagctggatcttagggatgaaagccaggaagtgagcttggagcgcgtcatgacacagctcctgcaacagttcaag

SEQ ID NO: 6611 - DNA, 262 bp, Glycine max
accaccggtagtgttctccatcaagcaagacgtatacccattgtttaagataccaattttttcaaatgtaattttcctttgaagatggttttttccccttttttccttcttgcatcaaagaaaactgcactgtgattcataatagtttgattctgatgcttatgatatgatgctttatatgtacatcatgtctaacagattttgtaacgagagttaagtgtcagaacacttccagtgggagttgcttccaagattcttaaaa

SEQ ID NO: 6612 - DNA, 867 bp, Glycine max
  misc_feature (850)..(856): n is a, c, g, or t
  misc_feature (859)..(860): n is a, c, g, or t
  misc_feature (862)..(864): n is a, c, g, or t
atgttcaactgctgaattgtcagaacacgataatcctagaaatccctttaaaagctcaaaaagacataaaaataagtttactgagcatttgggtgcccagtgggatgtctttcgcagacaagatgttccaaagctcatcgaataccttgaaagacactatgatgaattttcttatacccatgactatcacaagaaggtaagttaactgagttcataataagacattccttagaaggattttgatacagttgatggttattcattttttcttgtctgcagatggttcatccaattctagatcagagcatttttctagacagtactcacaaaatgagactaaaggaggaatttagtaagtaaatatgcttctatttgtttgatcattcgttacattccttgataacttcattgacatattcctgtcactattacagagattgaaccatggacttttcagcaacatgttggacaagctgtcgtcattcctgctggatgtccataccagatcaggaattctaaggtgtgcattagcataaaaaattctctcttgctggcttgaaaagcagaaaccttattgaattttgtttgttattgaactggatatccattcttttggacttatattttaaatattttaatattttgaaaattcctactaatttcaatatgttatgttaagctgctccttttagcaaatgatttctcaagaatgtattatatatttacctatcaacactgaaaaagcaagaatatcattatctcaatattagtctttgtatccctttcatatactctgaattgtattgagtgtatgacaaacatttgtttcttgatctgcagtctagtgtcnnnnnnnggnntnnnggg

SEQ ID NO: 6613 - DNA, 339 bp, Glycine max
aagcaaccaaggtcttagaaatctcaaaaatgagcctggcctcaaattcatcacgggaatagcccttagacacttgacgagcctttggaatccgtttcacttcaaagatgttatcactgttcatagcacctacgttccctgacagcttcaacataaagttcatataagcattcttgagctttgtcaaaatcgtcaatggtgatctcatcacccatctaagccttggaactgctctgatcctccaatacctacgtggccctctcaagcggatgatcgccatcttccttctaacgacggtggcgccgccgtggagacgccggtagcgccgccttctcaagt

SEQ ID NO: 6614 - DNA, 413 bp, Glycine max
atggggttaggtctgtgtggagggaaacaggagacattaatcaaattgttgattcaagccttgcagaggaatttctagatatccatataatggaaaatattaccaaagtgcttatggtggctctgagatgtactgagaaggatccacacaagagacccacaatgagagatgttaccaagcagttagcagatgctaatccacgggcaagaagtacaaagggctaggtaatggtatggtatctatgagaatgcattttcctccttatctggcacaagcgtggatgcaatttacataggcaagctgtagctactagttgtgcttgtgccatttgaatctcagttgctaaatacttcttcatgtgtttgattatctcacaaactatataaataatagatagttatctgcgcaatcgc

SEQ ID NO: 6615 - DNA, 618 bp, Glycine max
tctgttttagactaaataaaaaaagaacaacttgaatccagagatgcatcattgttatagaaagccactccttaaatgaatgcaattatgcagggaaaattattgggtgggcaagaaattgctgtgaagaggctttcaagtttgtctggacaaggaataaccgaattcataacagaagtaaaactgattgcaaagcttcaacacagaaatcttgtaaagctccttggctgttgcattaaaggacaagaaaaattactagtatatgaatacgtggttaatggcagcctaaactccttcatatttggtatgcaataaatgaagaatgcttaaattaggttcacttgtgttctttcttttctttgagttatacttagcagcttattaatcttgaatatctaatattgaacaatactttttaactccttcagatcaaataaaaagtaaattattggattggccacgacgcttcaacataatacttggaattgcaagggggctattgtatcttcatcaagattctcgattaaggattattcatagagatctcaaagcaagtaatgttctactagatgaaaagttaaatccaaaaatatcagattttggaatggcaaagagctt

SEQ ID NO: 6616 - DNA, 781 bp, Glycine max
gagagcattttgcaatgtgcactcgatttccggtcttgtattacagttggttcttgggattctggaagtgatccagaagatttgctaggcaaactttctaaaatcaatatatcccaggtaaaccaggaaatttttcttgaatctctatacatcatttatctggtacatttatgctttagaaaaccaaattgaatgaaaataccatgtaggctagggctgtttgttacctaaaaaatattttgggcactttggcattttatatatagatattagtgattattcttaactggctatgcatccataggaatgtctacatatgatgtaaggcaatatacatacattcctttattcgagagggccttctcaatgttctcattaagttgtagggtctggttccctcaaaataacctaagctttgccaaaaggtctcttgaaaacatccacacattagataagaatgatcatcctatctgggatatgttaggtatgctgtcaaataattggtcctaagctggggagtaaaatatattgacctgtagtttgaatttatttgcaggtgctttctataaagcagaagtttgatagaagtctaaaagaactgcacatatgttatattaagggacctaaacatgggaattttgggctttctcgtttctgggattatctaaactataatgaatattattcaaatgtcagcaatgagatggggtactatgccgtctgaaatttgccagctttgacgatgaattacataatgcacagctaagggctaggaatcaag

SEQ ID NO: 6617 - DNA, 367 bp, Glycine max
gggcattatgctgttgattttcatgcacaattatccacattacaaacattctccatctgtgttgccattttgcatggaacttctgccttcagcagtgcaagtcacgagaaaaaccaacagttatctcagtgcagttcactgaaaatgcttcttgaggaggatgttgatttctttttcaaatcagtcacaactgagaagaagactgtttgcaagaatcaaaaaggaattcctcgatcctatgtgctgaacccgcctttttctcctattgcacgtgtataaagtatagtagacctgaccagccctgctgtagtgattaaatggaaaacacatcgtctatagggagtttggttagacgttgttgacgagg

SEQ ID NO: 6618 - DNA, 454 bp, Glycine max
tttctcgtatcgaaaatcatttccaccaccacaatttttttttatttccgtttactaaagattagtaattgtttggtttgtgtgtagattttgattcgattcgattcgattcagtcgaggttttaagcagcagcaagatgtctgggcgtggaaagggaggaaagggattgggaaaaggaggagcaaaacgacatcgtaaggtgctccgcgacaacattcagggaattacgaagccagcgattcgtcgtttggctcgcaggggtggcgtgaagcgtatcagcggtttgatctacgaggagactcgcggtgttctcaagatcttcttggagaatgtcatccgtgacgccgttacttacacggagcacgctaggaggaagaccgttacggctatggacgttgtttatgcgcttaagaggcagggaaggaccctctacggatttggtggttagggttt

SEQ ID NO: 6619 - DNA, 513 bp, Glycine max
cgctatatcatgttggagccaattgttgctgtcacgtttaattttcatcattactaagttagtttaatagactctgtgctccattcattcaaatttcatatttatataggaacaaaacacactcctctccgttcttcccaattcctcaccccattgtcgattcccaaaccctacattttcgcccaacggcggatcagtttccctattcctcactcaccaattaaggtacgctgcttctactttcgaggccgtgtttgtttcgccatcgaaacttatttattacacactactttagcttagggctagtattttcgtcttcttccccatgagtcatgggatgattctaataatgtagtgatttatgtttacgtggttgtgtagtgtaagatggaggatgatgagaaacccacgggtaactcccatggcattgctgatatggatgttgctgatgctgctttgcaaggccaacgtgttgcttcttcccctgctccgctacaacaggatcaagtaatg

SEQ ID NO: 6620 - DNA, 408 bp, Glycine max
acaccagccacaggttggcatgcctcctcccccctctggacagaagcaccctaagttcatggacttcaatcagcagaagtagctaataatagttgtagcagtaaatgattgattacatgcaatattcatcacaagtaacatcctgtgcatatgaatgtataactaactggtgagacttgtgaaggatatattgtgcagttcagtgtctttagtcatgtgttgtttatctttagttctaggatatgtgtactttctgcagttctaggtgagaagcatagcctttgaaatgtaagcgtcatagctcttgggtgaatgagggtaacataaaggtgtagaaagactagttaataatagtatagatggtgaatgaagtttattaactagcttctggacttaaatagcatgcta

SEQ ID NO: 6621 - DNA, 1066 bp, Glycine max
ttctggcattaaggttaagactgaagataatcatgaaaagcttggaggatgtaccacttctaatgtagcagacaatgcaagagctgttaatgggaacttttcttgtggtccaaacaattaccgtcagaaaggtcctcggattgcaaaggttgtccggcgcatcaactgcaatgttgaaccattagaatttggagttgtgctctctggaaagtcttggtgcagtagtcaggctatctttccaaagggtatgtatacttggtccataatgaattacagcttttatgactgtttaattgagtttgtaagctgtgtatttatgcaaattaaattaattgatgcaggatttagaagccgtgttagatacataaatgtcttagatccatccagtatgtgttattatatttcagaaattcttgatgctggacgtggttggcctctatttatggtactttctccctattttcaattgcaagcttttgtcatgcaattggccttgtatatttattttttgaatgtatgtctggaaaggtatttcataaatctggtgtaaatttgttgatatactgggactttaaatcctttgttgctaatatctttgctgagttttatcccttatgatgtggcttaaagtttggtggaagcttcttggctcctctactttgcactttatgacatactgttggtttaaggccaagtatttttttttcagaagttgctccctttaagatgttaatgttgttgagaattgattgcccccttattaagtcatttcactacggattattctgacttctgggcatctaattgtaagaatggagtcatggagaaaatgctaacaaggtgttgtggtatgggttaatctttgacgggagcattcatgtgtttaacctattgagtatcttatctccttatttagcagatcaaaattgagactttaaaacttttatgtgttggatgcatttagttaaaaattactttggacattgaaatatgttgccgtgagtaattagttgtctggaattgggaagaggtggtgtgtgaaataactaaaatcttgtttatccca

SEQ ID NO: 6622 - DNA, 566 bp, Glycine max
aaaacctgtaattcggcaggttggttaagtagatcatggcttgaagttgtcaattattgtttctctaaagccttatgaacgtcattttatattttaacattatatgtatactctgcagataaagtttttgaaaaatgaaaagaaaggaaatgttgctcaagaacgctattcacggggagttgcctttgttgaattttcggagcatcagcatgcccttgtggctctgagagttcttaacaataatcctggtgacaaccatttcttatttctctgctagtgagactatttttgtaccctcatttctgtttaatttaacgttgtctttcaatgactacagaaacttttggtcctgagcatcggccgatcgtggagtttgctcttgataatgttcaaacacttaaacttcggaaggcaaagctacaatctcagctgcaggctcctcaagatgacaacaatgccatggataatgacaaacctggcacagtagaaggtcacaagcctgtaaagaacagaaaacgaaaatctcaagagcatgacaaaccagcaatggaatcagcactgaatac

SEQ ID NO: 6623 - DNA, 395 bp, Glycine max
  misc_feature (20)..(21): n is a, c, g, or t
aaaaaacatgaatccccgtnnttgcccctctctctttctcaatcccttctcttcgaaaaacaccttcttctctcattggtgctaaccacacctccgctcgcttctgctcccgataaataataccacacaaaaaaaatcccaactttttttttcttcttcttcttttatttcaattcaattcatttttttttgtgattttttctggttattgttattaatttctgtgagaagtgcacaatttgtttccatggatccaaccgtagcgaagcctggctttctcagaaacgttctggttcggttactcctcttcggcgttttcatcgtcgtcgtacggttcgcttacgtcatcaccctcgccggggagtcctgcaccgtcggcgacttctgcttcttct

SEQ ID NO: 6624 - DNA, 759 bp, Glycine max
atccaccggttcagctcgaccttcttcctttctctccggttctcagaccccaacaacatcctccctctcaccttcggatcccttggctcacccaagcatgtaaataatctcctctctccctttttcacccttcttcacactttcaaaatggttcactcaatattactgcacgtttagtatttaactttttattaaaaaaacatttatttgtaaaaggtgtttacttgaatccaaggccaacgttcaaactgcagcatgcttgttttgatgtttttgttttgaaaaatgtaatttttgggtttaatatcgtggatacaatccttatccaaacacactcttactcttagtatctgacaacgacaacgtagtttgagtaaaattattttttttatgaagataaatggagatgggaaagaatatttgatttttttttatgaaaagattgttataaaaaaatgtgttgttaaatactttgtatttttttgttggttatgataggtggtggagcggcgagggttctggacgtgaacctatttcccgcggccaccgcggaggatggcgacgacggcacgtcgctgtcgtcgtcgccgaacagcgcggtgtcgccgtttcagatggatttctgcaccaggaacggtaatgcggcggagttcggaagcagaaacaagagagagcagcaagaggctgagggtagagcgagtgatgacgatgaaaatggctccacgaggaagaaacttagactctccaaagaacaatcag

SEQ ID NO: 6625 - DNA, 379 bp, Glycine max
atttgaagatgaggtttctgctttactcagagttgcatgtgactgtgttcatcctttacctcctaaaaggcccacgatgcttgaagtgtatagtaagatgagcaacatatgggagagagatggcctttttgaagattcttccacgttctagtgttttttattacgtttctatattgatatgtctagccgaaatgcctcacattcttgaagcttggaatagttagcttgattggttaatttattacttgttagatacttagtaatataacaacatgaaatccttatcccactacatgagatacacactaataagttctgtaaatagaacacatctcccacattattttgtatctttctggttcctattggtcctagtttg

SEQ ID NO: 6626 - DNA, 618 bp, Glycine max
  misc_feature (33)..(34): n is a, c, g, or t
  misc_feature (573)..(575): n is a, c, g, or t
  misc_feature (578)..(578): n is a, c, g, or t
gcagtatattacattacactataaaataagagnncttagtatagggtaaaaagtattcaccaatttcttattgtaagccaaaatagttttcttatactcttgtttcttctttttggccatagcaacgaagggactttttcatgaaacattaaattaatgcaaactaggttacaaaaatgtggatatcatcaataaattaggatgctccttcttgaactgctctctgaactcggacctaaaccaaacaatcacaaaaacttcaatcgcgagaacacaaaaaaaacgaaatgaaatgaaaacaaattcagtatcaaaagcaaacaaaaatctgtacatgaaaatgaaaaaaacgcttggaggtctctttcgcttgttaggaaccttagcagctttcttcgattgtttccttccagcagcaccagtgcccttgcgcttcaacctaaacgacgcattgaaaaaaaaaagttaaatgacaaccaaaagataaaaatgcagaacacaaaatgatgaatgacagatcggaaaaaccagatctaaaaccagatcagcacgcgtatgatttttatttaccannnagntgctgattcccgacggcatgcgtcgttgaggccgatttca

SEQ ID NO: 6627 - DNA, 1161 bp, Glycine max
  misc_feature (1152)..(1153): n is a, c, g, or t
ttctcctggaggttgggatgacatatatcaattaacgaacttttacttatgcaggaagccttgcaaggttggaactaaatatcttgaagatggttctaaagtcagagtatccagaggaataggagcatctggatccataatccctcgacctgagatcttaaagataagaactaccccacgacctactgtgcgtaagtatctaaaatgcttatgtctttttcttgtttgagttgtgttgttgataaacatggcaagaaccaagagaggattgtcaaaaagtgagaaactgaaattgtacttggattgaaatgagaaaggtgtgtgcaaaaagccaatattctggcttatgtagaccatatttatcagaatctcacgattctctatttgaatgttacgattcgatgctattcagctacctaccaatatgtttcctaagatgaatcttaaaagacttaatatgttatgatgaatgaatcatgtgaaaaaaattgaaaactatgaggatttattgtttttttttatttttctttcacaattctcatgaaaaaattgaaaactcataagcttaaataaagggaattggaagaacacttgtaaacatatcctatttgattactccactactttatttgttgctcactcatttaatgcatgtactctatttagctatttaattgcttcatttccatctactaaaatgaaggcttcacaaactcagatttaatagaactcatgcatcatatcaaccttgtgttgttaggagctctacttactcccgttgtagtaaatgcaaaacttgtatgcatataaggaattcagtgggaaatctatgatttttcaattatcaattatttcaaagatacatttaaacagttttcagaaatccaaaatatcttaccctatttgttacttatttttggcagttggtcctaaagatactccaatggatcttgtgttagagaagacttatgatgctaaaacaggaaggggcatgcctgagctttaaggagattaggtaccttacaatttaggtagttgctatcacgatgaacaagatagggaatgaggttgtcacatgctttgtctatcgtgattctgttgaattgctttcaaattttcgtgtttaatgtgatcgtatgagttacctatagnnaaaaaaag

SEQ ID NO: 6628 - DNA, 950 bp, Glycine max
  misc_feature (888)..(892): n is a, c, g, or t
tagttgtcccttgattttgttgagattagttttttgatatacaatggactgcgataaggttagaacctaagacttcatgcaactacctaaatccctaccaccaggctgaccttagagagttatttgtttggattatttgtatgagtttgattttattcacaatgtaattcctcaaagtagaaattatgactcatgcttcttctactaaatgcaaattttagtacagaagtaaattctgaagagcgaaattcatgatacttttcaggatgaaacagaacctttcaagcctttccgccaccgttatcacgttccttaccaagcatcgggaagtactgaacccttttggtattctatcaagatagcttctgcacacatcatagttttggcttcatattcagcttatggtaatattggatacacccctttctcttgagattaccttataatcttaaagttttgctgaaaagattattgttcataatttaaagctgaatcgcctccttatatgtttcatatatacaccttttttgcactaaacatcattttccttgttcaggcaaatatactccccaatatgaatggcttgaggcagagctaccaaaggttgatagaaccaagaccccttggttgattgttcttgtgcactctccatggtataatagttacagctatcattacatggaaggtgaaaccatgagggtaatgtttgagccttggtttgtgaagtataaggttgatgttgtgtttgctggtcacgtccatgcctatgaacgaagtgtaagtgctccatttcattaggtgtcatgaatctctaacattgctggggagaatgataaaaccacaacaatgcaataaattttttacattgtcaatcaattataaatcatnnnnnatataaacaatcttatcgtacttgataatttataattatatgcaccccatatcagaac

SEQ ID NO: 6629 - DNA, 375 bp, Glycine max
ggtgtgaggagcacccatatgataagcaatcaccaggtgtttgctcctcttgcttaagggaaaagctatctcagctatacaacacaaaccctattattgatcctcgttgtttttcttctccttcttctccttcttcgcctcatcaatcttttttttcttcgaagcacggttcttccggtcaccggagaccgcgctttcggaggaacgcttcgcaagcggcggaatctgcctcgtgcatgctgagcttgaacttgaagaagagcaagtcgctggcgtttgcttcgaggaatagggagagggatgtgatgatgagtggaaggaagaaagatgggttttggacaaaggtgctcaaactcaagagaaaggatacacggg

SEQ ID NO: 6630 - DNA, 406 bp, Glycine max
acctttacatttcaagaagcttatgacatgacaggcagaattcttgggattactgtttgttccccaaggaagcatgaaccgcctagatgtcttaactacttgacttcaccccatgtggttatatggagtgcagtaaccgcttcttgtgcctttcctggcctttttgaggctcaagaattgatggcaaaggatagaagtggagagattgttccttaccaccctccttttaacttaggccctgaagagggctccacaccagtgcgccgttggagggatggtagcttggagattgatttacctatgatgcagttgaaagaactattcaatgtcaatcattttatagttagtcaggccaaccctcatattgcaccactattgagattgaaagaatttgtgcggacttatg

SEQ ID NO: 6631 - DNA, 399 bp, Glycine max
taggaatgccgtgttgctttggcacctatcatattttgactacacatcagattcttcagactcccagaatgcactcatcttaaggagatgttttgatgccattctagtggcaaaaatgagggggttgtttttgcttcttgctgctgctggtatgaatcaagatttgtagcaaaaatgagttgtttaaattgctacgtgctaacatgtaataacctttctcacacaaaatttacatgtaatgacatgtgtttgtgccccttatgttaaagtccaacagtatcctatagtagtattgaatgccctaagtaccctatcttcagtagtttctttggtgcctgtttcttatatcaagtcaatgctcctagcagcaaaggtgtggaaactgcaaactacagacaa

SEQ ID NO: 6632 - DNA, 392 bp, Glycine max
tgtttttgtgattaaacctgacatgccatcctcagtggataatgcctcgagtagcggtaatatgcagaataaaagtggtgcattcgaccaaggttattttgtaatgccgaaatcaagacgtgttgttgtagatgaatatagtacatctgtttctgcccgcaaagggaaaggtgtcatcaccatcagattgccctattctggctctgcctgtggaatgggctatgaagtccgagaagttgacagtaaagagtttctgtgcatatgcagtagcaaaattaaaattgaccgagttgggcttcttgaagatattagcagttctgtttattcgaagactgttcagctgctcatggatttgaaatcagatggaaataagtatcctccagctttggatc

SEQ ID NO: 6633 - DNA, 449 bp, Glycine max
ctctcaatagaagatggcactgttttgaaatcattcaaccatctccttcatcggaataagaaggtggatttcattgaacaattcaatgaaaagcttcttgttaaacaagaaaatgagaatctccaaattcttgatgtaagtaattttctggtttatacatgagataagttgtatatatttacaccctgatatctgactttttaattaaatctaggtaaggacttttgagctaacagaagttagcagaagtgaattcatgacaccgtctgcatttatatttctatatgagaatcaattattcctgacatttcgaaaccaaactgtggcggtgtggaacttccgtggagaacttgtaacttcttttgaggatcacctcctgtggcatcctgattgcaatacaaacaacatatatataaccagtgaccaggatcttatcatatcatactgca

SEQ ID NO: 6634 - DNA, 383 bp, Glycine max
tcgtcatccatcgagcaaaatacctgctcgaaaatggctttgggtgctataatgttttcaagaaaaactgtgaagactttgctatctattgcaaaaccgggctcctagaaatcggacaaagtggccaagcagtttccatcatagggggacctcttgctgctgctctatcctcgcccctccgtatggttactactaacgtttatggaatggcagcgacggcggttggagtctactgtgctagtaggtatatggcagacattggaatgaggcctaatgcggtgaaggtaccggttgaacagttaaccacaaggttggccactggcttgctgcaagtggttgaaccccaaattccaacgaatatttctcgtcaatctcctcagctt

SEQ ID NO: 6635 - DNA, 359 bp, Glycine max
ggagtgaagcggaagaaaaagaagacataaagtatcgtgtatatttggacatggttacgcacttagattatgtcaatgacctgagtatttcaaccacggtgggagaaatttgcgtcgactgtcggaagtgattgatgaaacactgcagattcaaagcaaagttgtcataatatcaccttcaacgagtagaggtttggatcaccagaaaaaggctttatgaccttgtcagcgcgattccttttaccagataattttgctgttttaatctgcggcttatatcttttgatgtcaagatgatatcatttgaattttgaagagcgagtttttcggtatacgattactgatgtgggtagatcaga

SEQ ID NO: 6636 - DNA, 240 bp, Glycine max
tgggcgatctatttttaccccgacgggaagagcgtggaggacaatgctacgtacgtttcgctcttcatcgcgcttgctagcgaagggaccgacgttagggcgctttttgagttgacgcttttggatcagagtgggaaggagagacacaaggtgcatagccattttgagaggaccctcgagagtggaccctacacgttaaaataccgtggtagcatgtggtgagcgaattggacatgctgc

SEQ ID NO: 6637 - DNA, 637 bp, Glycine max
acttccacacttactctatcatttggaagccccagcacatcatgtaagtcacaataaacaaatattaaaaaaaatacacattttttttattagtaaatattctatacactaatactgcaaaagattttatatcaactatctttgaactataagtcataccatttgaaagtgtaaaaaatttacattgaaactggatagaaattaaactttgtttatctctatgcttttcaccaatatccatttaccaaatcatgaattgggttaactgcagattcttggttgataacacacccataagggtattcaagaatgctgaacctcttggtgttccttttccaaagaaccagcccatgagaatctattctagcctctggaatgctgatgactgggccaccagaggaggattggtgaaaactgattggtccaaagcaccctttacagcatactaccgcaatttcaaggccattgagttctcatccaagtcttccatttcaaattctggggctgaatatgaggcaaatgagcttgatgcttatagcagaagaagactgagatgggttcagaagtacttcatgatctataactactgcagtgatctcaagcgattcccacaaggtcttcctgctgaatgtaaacg

SEQ ID NO: 6638 - DNA, 402 bp, Glycine max
ccaaaccttatgatgttcgaatccgaggttcctgtcggggccttgtgctcttggagtgctgtcaaagtctctgggtgtgaaatccatccacaggtttccacggacaactagcttacccacctataattgctcccagtaagaatgtcatgtttttgacatttctctatggtttttggtatgacccatcaacagatgactacttggtggttaaagtgttctgccacgcttgctcagctgttagtgctaactgatacggaagcagaggcagcaaacacaacaacaggaacagcagtcacaaagccaaaaacgaaggtgcaagtagaagaaaagcccaagagaaagatcacaaagccatcttacctcaaccactacttttgaggaaatggacaaagctagtagcgt

SEQ ID NO: 6639 - DNA, 513 bp, Glycine max
cttagattgggaaaagaattaatttctgcatttttatccttggttaaacctatatgtcttctcatgctcatcaagtaagaaggattttaatcagtagtgtccccattattgctctctaattgattattgagttgtgggaaccaaatgtgtaaatcagttgctcaagattaacacttagtgttgtgacttcaggaggcagtcacattacaccagaggtgcagagattagttgtccatttgtgttcttcaaattttcaactgacaccaacagcagtaagtatattgttttcattcccagcatgctgttatggatgtttttttaatgttgtttttggttggtgcattgaatcatttctgtgatacactgggttttattgtaggtcaattgtcgttgaattctatggccagggagtttgacatgcacttttggaaaccctactggcagtgtaaatcgaccgagtaagaatttttgatgggtactttgtagtatgacctttgtacttgtgtcgctgtc

SEQ ID NO: 6640 - DNA, 480 bp, Glycine max
ctttttttcatgcatgaacaaggacaccctatattatttcttcctttgaaacaccatggcttacccacattaccgatcacagttcggagacacaacgttcactaaggtcttcgttggaggcctagcttgggagactccaaccgaagaaatgcgcaaatattttgagcagtttggagacattcttgaagctgtcattatcactgataagaacacaggaaaatctaaaggctacggattcgtatgtctctctctctctctcacacacacacacacactttactttgcctttgattcttttttcactgcaacgtgtgttgtgttgtttgatttgatcctcattacacacaaaacttgtccctatataaacacaataaacaacaggtaacattccgtgatccagaatcagctagaagggcatgtactgatccaaacccagttattgatggaagaagagcaaattgtaacattgcttctctagga

SEQ ID NO: 6641 - DNA, 343 bp, Glycine max
acagcaccatctccttcccaatccctctctttctcctcttacttccgttaccgaaacctcttctccctctcgcactccctcctcatcggcgtcgccaacctccgcgccgcacgcggcgacgtcgccggcgccgatcgagccagatccatcgccgacggcctcgatcagggaaccgtcttcggcttcttgaagctcctctggacattgtcgtggacggatatgtccttcacggacctctacggcgctgtttccgacatgaacgagttgctgcggggcttgactgagttgactcgcttggaatcggtcgcggaaaggtccgcttgggtttcccgaaattaccaaa

SEQ ID NO: 6642 - DNA, 646 bp, Glycine max
ctttctcactaaacaaggaacattgaagccactagctattgagctcactaggccacctattgatggcaagccacaatggaagcaagtcttcactcctgcttcttattcaatttctcattcaaccaatctttggctttggaggcttgccaaagctcatgttcttgcccatgatgctggtgttcatgaacttataaatcattggtgagtatcatcatagagaaaaaaaggttatgcaccgacattgtaaaagttttacatccaatcacaacacatcatgtatgataagtttgttgacttttgaaataattatcttaaaataactcaaaatgatgatctatgattggatgacgatgtaaaaagattttacattgtcagtgcatagacattaaactcatcatcatatcattctcttctaccttgtaacttggtatatgttgactctatcaatgggggtgaaaagttcggagtcttaataaatgatattatcttgctatgtgtaaattatgattttttgtaggttaagaactcatgctgtcatggaaccctttgtcgttgcaacaaataggcaactaagtgtcatgcatccaatctacaaactactgcatccacatttgacatacactctggctattaattcacttgctcg

SEQ ID NO: 6643 - DNA, 265 bp, Glycine max
gagccaacttactattagattgaaaagaataagtttcttgcactgattgagtactatgttggcttggaaaagtttcatgcagttatgtttttattttgtgcttggcttattttcttcttgttgcacaggtgtatatgtttttttttaatctgcagattttttcacttgttttaatagctaaatcaattccttttggaagttgctagatgtaatattttattttgttattgggttgtgcttgtgctagttggattgcacttggaaa

SEQ ID NO: 6644 - DNA, 389 bp, Glycine max
ctaggagcttcgatggcgattggtaactagctcattctttggttcaaggtgtcatgttattgatacaaggactataattatgcttctttgtcattattcttatttctagggtcttcgcctattcaacctggatattatccgtgagtatggaacaagagatcacttttacgtcattgacataaactacttccctggtaagacgatatattgaagatcttgtttacttaaatcccatatcacactaatagagagtatgccaggttatttggtatgcccaatgagatttcacctgtgttgacaagagtatatgtcagaagagttcgtttataaaaatttcttttgatattctactttgagttgacatataatcctctcaccttcccatcatc

SEQ ID NO: 6645 - DNA, 881 bp, Glycine max
  misc_feature (828)..(831): n is a, c, g, or t
gtaatcatcaactagcaagaaaatggatgaagcgggctgcggatcgtgggcatagtaaagctcaatttgagcatggacttgctctcttttctgtgagtatttatccctgtattgtatggtgctcctttgtgatttgaatgtttgccagagaataaattgtacctacatcatggcacttttgttgaatctgtgattttgccacattaatttgtttccaaagctttttaattagatactaaagccatttgctatatgttttttctatgactttctcatcttaaaactttgggtctattctgtgttacttggttacattctctatgttgtagacatctgttctgctagttttcaagtgtattacaaataagatatagacttacatattattgactcatgcaaaatgtgattttgcacctgcacactgatcgttatttgtttgaggtttttttcaatctggcattctgatatttgctcttcagttggagttccacctgttttatcagtcacttcaattcatatttttttgtttcattcatatgatattagaatagcaatcagcaatgactaaaagtattggtgggattatggtaatgataattgacaactaaaggattgctggacaatttttggtacaggagggagacatgatgaaggctgtggtttacttggaacttgctactcgtgctggtgaaaaaggtgctgctcatgtcaagaatgcagttcttcatcggctttcatcagcttcacgtgatcacgccatgcatctagctaacagttggcgtgcattgccatcaagttgagccaatccttatgttggtttgtgatgannnnagttgcatgaccttggtcggtggcatcagaagagtgaagtcaactaagaa

SEQ ID NO: 6646 - DNA, 395 bp, Glycine max
tgcatttgtgaatatcttactggtgatgacaatcagtgccctgctccaaactgcaaaactcgactaagcacgccttcagtgttttccaaagtcacactgaatagttctttttctgatcagccttgtgataatttgcctgattactctggttgtgaagtggaggaatctgagttttgttctcaggctcagccatatgattcttcaaaaattaaggctgcacttgaggtgttgcagtcgttgtctaaaccacaatgctttgcttcccaaaacaattctgtgcagagcacttctggggaaagtaccgatggccttggtagctcctctagtgctgacagaatgaaatccttgaatgaaattcctgagagtcaaaatgtgcttgaggagagaagctctaa

SEQ ID NO: 6647 - DNA, 656 bp, Glycine max
ttcccatcagttaattcctttaattttctcttttcatcccgcttctttgatttgattctcgtaatcatcgaatgtttttctttaacccttagattagatcctttttattttgagttggataaaattataatatttttttcatttattttgggtggtaataagtaataactaatactaactagtaaagtagtaattggtgtgtgtgatttttgttaatttgattttggattatggaatctgatacgggtatgttttgggattttatggtaagcgatgcaggaggggattgtcgagtcattttgatggaaaatcaaaatcgttctcagatctatctcaaatgagtaatttgagtaatctgaaggagttgcaaaagcaagagagtcctttcaacaagagaagaagggttttgattgcatccaagtggtccagaagatcatctttctattcctggtccaacccacaatccatgcctcttttgcctgtggatgaggatcaggattatgattatgaagaggaagaagaagaagaagatgacgaagaaaaagctagaaaagttccctctgcttcatcttcttcgtcttcctccttggccgaggaaaagaaacaagaagatcaggttcagctaagactcaacagagtgccagaatcttatgctg

SEQ ID NO: 6648 - DNA, 664 bp, Glycine max
tacagccaatgatgaaaccatatgcaaggagatgaaagtgaacatcaaagagacaatggaaaaggaagaagaggatcgtagaagagaagctgcaatcgcatcctcatcctgtctccgacccaatttcaaccctaaaggcataacccaagaccaactctcaaaatttcgtgtgggtgcccccttccattcagttcactattcattcttttctacatctcccacttccaaaaagcttgtaaattttagatttttcctacattctaaaacctgggtatgtaccgttttactgttgtgcttgttcggtgttctgtcatgttaacgttgtctcaatgtttgattgtgataggaactacacaagaggcgcttgcaactgaagtcaaaatcgaagttcaaaatgaaatccaaaggttcttttcttttttcttaattgtaatggtttatgtgttgtctatatgctattgttgtagatgttctagttatgtaatattttggttctgcagatagggccaacaaaaagtcacatggtgatgttctatcaagccaaaacggtggaactcaaggttcaaatgttgatcacaaagaatcaaacttgtggaatgattgtgaaggatttgattctagatatgaagactcaaaggatgatatacctgtgatgtctgcacca

SEQ ID NO: 6649 - DNA, 940 bp, Glycine max
gtatggacctatcagttttctttccagaaaagctgcacaagattaactagaatgtacttgcataatattgcagcttaatgttttggaacttttcgttgactgcttaactgaacccaatgaaaagcttgtagaatttggtataggagggatctgcaattcttgtgttggtaattctagtgactttatcttcggtgatatcattatttcttgcctaatcgtctatcttatttacaaaaataacaaattttgagcagatccggccaattctgcaattgtaactacgtttggtgggatacctcttataatccaatgtttatcaagcccagttaggaacactgtaagtataagagcttttttgcttgttgacattgtttcactttgatggctcctaagttgtggatcatgtagcttgcagaccaaaggggatttgctaaaccacgaatattcaaaaattttgttgatagcattttcctcccttctgttacaatcatgattgtgttttctacttcatcactaaatgtattttattatatatgaaaaatatttgtgtgtttttttatatgaaatttaattatttgaaacttacgttttttgacttctcagaacattctgttattctagggatgcttataattacataactcacattatcactcattctcttctggcacttgcaaagtaatgttccataagttacactgacctgtacattttaagtacattctaaagttaatttacttccatgaaaggttcaattacaatttggtaaattaaaaaatacatttatctgataccaggtaaattatgcacttggggcactttattatatctgtaacgaatctaacaaggaggagattttaaggcccgaagttgttgatgtcattaggaggtatgcagccgctgaagaagttagtgtgagcttcagtaatctggctaaagc

SEQ ID NO: 6650 - DNA, 861 bp, Glycine max
acaagagagaatacttcgcgaagacacaattatcaaggcacgcaaagttgaatttccttctagacctaccatttctaatgaggcaaaggtgagttgcacccttgtctgataattgctgctcatggctctgattgttctttggccttatttcataattctgtttatttatatttgggttattaacaaacaccctaagtgcattgattgaggaaccaacaaataagttttttggaaatcacactgaggtgcactagaaatcatggtagacgtgtatcaataatatttttaataaaaattttccacttttgatttcttaatcagtgcatttgcctttattttattctgattttcagtgatgtacacaactatgcttcttgtaaggttatatttatggtaattttcaaaaaagaactatccaactttatcccatatgcaagtgtaggaaggtggttgtttccattaaagacctcaaatatatacatgcttatatctggttaatagtttctatgtttagctgtagaaagaaaatagttcctgctatctacaatactgtcaaagtcaaacctgacaattgtctgtgctgtatctacaattaatttggtcaggattttattcgacggtgtctaacatataaccaggccgagagaccagatgtattgaccattgctcaagacccatatctcactttctcaaaaaagtaatgggcttcattatccagactccacagagaaagaatggaggatctcatcttctaacttcagttactgaatctcttaaattttgtataggttgtaaagatttaatcttgtcaatgaggcagagagagggatttccccattctgaaacagagtccagtttatt

SEQ ID NO: 6651 - DNA, 681 bp, Glycine max
tgtccagctcctcccagggatgaggttgtcattctaggagatggaaacatcaaaggtaacatacaacaaattaaaatagacttaaaatacatttttcgtctacatcatttaacattttttttttgttcttgtaaaaaaaattattttagttttaataaaatatgttgttttattttcgtagcgtttcaaataatgttttttatttaaaatatttttagatatgcagttttttcttacaagtagaagataatagacttatagacatgcagttcaattcaattgcttcaattgtgcgcttgaaacgaaattcttgtttcaggagtttatgttatcgaggaagatgttgcgacttataccataaaagcagtggatgacccaagaaccttgaacaaaactctgtacctgagaccccatgccaatgttttgaccttcaacgagctcgtgtccttgtgggagaacaagattaagagcacccttgacaaaatctacgttccagaagatcaacttctgaagagcatccagggtcagtgtatattcattcatttatgactttcctgatgtcacaaatgcaacttacaataagaatcttaggtctccgttgtgattttttatttttatttttgtatctttgcagagtcttctttccctgccaatttcatgctagcattaggccactcaatg

SEQ ID NO: 6652 - DNA, 673 bp, Glycine max
  misc_feature (41)..(41): n is a, c, g, or t
  misc_feature (43)..(43): n is a, c, g, or t
  misc_feature (625)..(629): n is a, c, g, or t
  misc_feature (631)..(631): n is a, c, g, or t
tggatgatgattaaattaccatgcattgctttgctatattnanctaaacgaattcatcttgttctagcacaaatcattgaaaaggaaaatagttgatggtttcaccagttcttagaaattgaagggcattaatctgagagtaagatacagtgaatgtgaaggtatcttgtcaagggatttggatcctccttttcttaggaacaagagtttattttttgttagattatcctgccaaatgttcattttctcctacccccctttttttatgttgcacttcgtctttgagtgtatcatatactagcaattatgtccattttattagccatgcaagttaaatcttctttctcccttttttctgcagaagtaccacttgaatcatcactttcggatccaggataaaggctttgggatcacttcatcactatgggataaagtttttggaacacttcctcctaaaatggatgccaaaagtatgtaaattactgtcaagggtagcatatgttcgttggttaaaataatagcaagttcaggaattcctgcttttatttatctaatttatttgacctccccaatcattgatgttttatggggtgttagcgtgccatcattcgtcaattttgtggtnnnnngnttcgacaattaaacattctgtaaaaattgatttcttgtatca

SEQ ID NO: 6653 - DNA, 399 bp, Glycine max
ctcttctaattcaactgggaggagtataaaaacaagtcagacaaacttgagcttaatttacagttcagagaatcaaatcctagttgaattctgtttgcttttagatcatagacgtactgggtgactgaggaaggatgtgtggagtttatgaatttgtatcattgcttttgttttgtcaccttatgccacttctattggcggcggcttgtccacctctgctttcttgtggagatcttggcaatatcagtttcccctttactacaacagaacgccccgactgtggctttttacccatacggaattgtgaagatccactcaagttcaaaatgatccaattaaagaataatggagaatggtttcgggttgtactcgtagctcagcttcggaacagttctatca

SEQ ID NO: 6654 - DNA, 354 bp, Glycine max
agctgaagtgggtactcgcgaactcgtttcacgaactggagaaagaggtaatagactccatggctgagttatgccccataacaacggtgggcccactagtccctccatcgttactcggccaagacgaaaacatcgaaggagacgtgggaatcgaaatgtggaagccacaggactcgtgcatggagtggctaaaccagcaacctccttcttcggttatctacgtttcctttgggagcattattgtgcttaccgctaaacaattggagagcatagcgagggctcttaggaacagtgaaaaaccttttctttgggtggttaagcgtcgagatggagaagaagcgcttccacttccag

SEQ ID NO: 6655 - DNA, 373 bp, Glycine max
aaagtaaaagcaaacgctttggaatatgctattgattttatgaggaactaatgaaggtgagtgtttttttttcccacttggtgattaatttctaatacaggctgcttgaaatgcgtcgcatgtggacaatctgattggagtattgaggatccagcattcaatgattttggtgttctattctatttattgatgcatcatcagaagacagtgaacatcttcctcattatgcttatttcatttttatattggttacaaaatacaaatacatgaacattggttatagtgagggggaagggttttacttttacccaacgcaggcgtttagttttgcgcatgccgaaggggcgtaacctttctctggcacatatatggc

SEQ ID NO: 6656 - DNA, 362 bp, Glycine max
atattattatactactggtgagtaaattaaagtaactagagcttgaaatttcaactgcctttactggggaagaagcctaattgagtgttgaaaagtaagaactaaagacttttcaaagtggttttggagcaatgggtggttcttcttgctttttcataatatgtgttctgcattctgcaatagctttgacttgtggatccctgatggtgttttattccaaagagttaagtgtgttggggcatggaccaaagactgcaagcaagcttcaagggtcaacaccccatgatcagttactgatccaaacctcagattccttctctggcttgctgttgttcacaatagggttccttgtgttcatggta

SEQ ID NO: 6657 - DNA, 852 bp, Glycine max
  misc_feature (828)..(830): n is a, c, g, or t
tgtgactgcctactctcctttgggagccaaagggagcaaatgggatatcaatcaaattttggacaatgaattgaccaagcagattgcacaggctcatggcaaaactgcagctcaggttaccatttttcagatttatttgtgtttttaaagctcaacgacaattacactagtaaaattgagtcaccaacagtgaagttaaaaataaattgtttagcaagctgcactaaaatttgggtaaatagcttaacttagcacttgttgaataagtgtttattatcatataagcttttaagtataattttgtctgtaatcaaataaaaaaacaagacttaactgttttcaaataagttgtaaactgttttcataagttatcttggagaacttattaaaataagctaaacacaatttatggacagatcttatgatattttcataagctctttggaatacttacccgagtatttatgtcataagaatataaggtaagtctaacatgtaaataagttctcctaatacatcccaaatcacgaattcaaacctcataaatcataattgtcactgtactgagtttactttggaagctacttggatgctaatacaatcaaccctttctgatgcaataggtatgtcttagatggttatttgagcaaggtgtgactttcataccaaagagctacaataaagagagattaaaggaaaatttagagatatttgattggtcactcaccaaagatgaccatgaaaagattaatcaagtcaaacaggagcgtatgttcaagtacggaacagcagcattcccgcttcctgatctatttgatggggaaactnnngtaatacattatcagcttcaat

SEQ ID NO: 6658 - DNA, 359 bp, Glycine max
ggcgatgtggtgtgggacaaggtcatcagcgtccgcggccaccacgttcgcccttacgtcgttggtgactggtgcttccctctattgccgtttctgcttaccccgttctcgcctagtggaatggggactcctgcgcagaacctgttcgatggaatgctcatgaagggaaggtctgtggttgtggaggccattgcccttctcaagggaaggtggaagattcttcaggatttgaacaccggtgttcaccacgcgccgcaaaccatcgttgcttgctgcgtgttgcataatctctgccagattgcgagggaacccgaaccagagctgtggaaggaacctgatgaaagtaacctgatgaaagt

SEQ ID NO: 6659 - DNA, 1071 bp, Glycine max
  misc_feature (12)..(13): n is a, c, g, or t
ctgctgatattnngctaaactaagtcaataagatgactcagggaaagatagttgaagctgcagaagctcataaaacacttgaggatttcgatcctccaaagaagcgcaaaaggaacaagtatgcttttgcttgtgctgtgctggcctccatgacttccatcttgcttggctatggtgagtcttatgaatatattcattcctacttgtcttgctctacatgtaacttcttttagtgtgtttagaaaaaactcatggagaatggataaatcatgtttgtaatctgcaagctataactattaggctttgaaaaatacgtctatgacgtgaaaccaaacgtactattaatttgattacacaggagaaactaacatagtcaatgatggaccgaagttcagttgaggggtgcacctgactttgagcgaaatacaagagtatatactagtgcgttcttatttttggcacctcctatttttataatttaatcccgttgccttcaatttattacttattgtcaatttttatcttttaacggttttttttttctcatgtttcgtttcttttatattattttcatatgtttgataataaatattatttaaaattttgtttttgccccaaccgactttaggtcctcctgatccgtcactaaacacagtttcttccgcgcgggccgaaaatcgtaaaacttatccagtttacgtggaaaaaggaaaaaaggaacaagacttttgcgcacaaaacacatacaaaaagataaaggaaaaggaaaaggaaaagaaatagctagtgggacaagagtttgcatgattctttaattagaaaaagggaataatctccgagaacattattttaagtgagacgtggtatgtaataataagtgtattattgtcacagatattggtgtgatgagtggagcagccttgtacataaaaagggacctgaaagtgtcggatgtgcaaatcgagatcctgctcggaatcatcaacctctactctctgataggctcatgcctcgccggcagaacctccgactggataggtcggcgttacacgattgttttcgccggcgcca

SEQ ID NO: 6660 - DNA, 388 bp, Glycine max
ccatccccgcttgcgttcatccttaagtacctgcaagtaataaacaaccaggtatggccaatcttgaccgcatcattaccctaccttgattggtttctgccgttcatgttttgtctccactccagaaggtagcccaaggtgatcctgcccctgctttaccacaacaatatacatgcgtatgcgtatgcgtatgcatggatgttttcaaacgcagaaaatttagggaaagttgattcaggttcaattctaattaagcgcttgggggatcccatgaactgagcggaagggctcaggcgatcacaaattaacgcaaggtgtgaaactaacgtgaggactaaaagcctcaaatccatgttcatttctttgaaagaccgtaacaagggataca

SEQ ID NO: 6661 - DNA, 1067 bp, Glycine max
  misc_feature (1037)..(1039): n is a, c, g, or t
ttaaaactaacaatggttatgttccacgaaaggagaagtcatccccattgaaggatgactgttctgaagacactgaagaatgcaattctgtaaatacatcagattctgaacccaaatcttcaaaatcagcaaagagaaataaatggaaacatgaagaagttaagaagctgattgatatgcgtggggaactgaatgacagatttcaagttgtgaagggaaggatggccctctgggaagaaatatctcagaatttgttggctaatgggatcagcagaagtcctgggcagtgtaaatctctgtggacttctttgttacagaaatatgaggtttgtttcttcatccgagtgacttgatgttaatctgataaagcaaatgattcatcattccctagaaataatcatccttagtttgtggttgtttatgtttaaggaagcctctacatcggatggtgtggaaaggagaacaaaatccatcttctgattgctgctgggcatttttaactataaaattttgttcaacttcttcacactactcatctctttacgtccagataacctattttgaaaaatcaacataattgtgcacctgcctgcttttgcatgtcaatgtgggtatgacattaatttataatttattttctattctgatagtaaatattgaatgcatgatctgtcctaacatttatatctttgctagaaactttgatgagtttgttctacccactttcttctactgaattctcatagactcgtactatcccaaagaatgtttacaaaaaaataaaaaatgaggattatttctttcacgtgtctctcttcatgttaattatattgattaatgtagactgtggagaaagcaaggattttgagactccgactgctgtgaataaagttacacccacacatgacagaaaaggctgttgtgcatatagcctataggaatacaactatgacggctttgtgatgaacgaataaatgctattaaataagacaactaccttttcaacaattgacatctttatttatttttaaagcagnnnggtgaagaagaaaagaagaacaagaaaa

SEQ ID NO: 6662 - DNA, 105 bp, Glycine max
tgacaggcaagttaaactggatactacatatctgcatgcaaatgggactgttgtaagtgtgttatgcacatgaattaagtttatctttcatttgatattctatat

SEQ ID NO: 6663 - DNA, 366 bp, Glycine max
aatggcagcttctgattggatttctgctgtgcttcctggtgaacaataaatttggtatgattgtgtacatttgagatttatgatgattcttttttatttttttcttaaagcaaagatggagcagaagcggtagtcacacctattcaatagtggatttccacttgtactatttttctttttctatattttttgttcccttcttcattgtttcagttccttttggtgacttagttgtttctgatttgaagcaaatgcttcttgtaatttcttgggcatattttagaaaaatgccatttcgtctgtttgtaatatctattactagcaaaaacacgggagcagctgtaattttccgttgttttttttttt

SEQ ID NO: 6664 - DNA, 662 bp, Glycine max
gctttcattgtagtgttctctgaaaactatgggtattccacgtggtgtcttgatgaactttccaagatcattgagtgcgtgaaaaccaggaatcaaatggtttggccaatattttacaatgtggaaaagtccgatgtatgcaatcaaacaaaaagttatggtgatgccatgactgcccaggagaaaagatttggaaaggactctgggaaggtgcataaatggaggtctgctttgtctgaaatcgccaacttggaaggagagcatctcagggaaaatcagtatgtaatgcttttaattaattttggctgatcaagttaatttgttgtttattaatgtctattagttctagttgctgattaaatgactattaatcccttaataatatgcctccctcttgaccatctgtgaaatggtcaaataaatggtaaataggaaatgtatagttcttgtcctagacatggagttttgtttgctgtttggtttggtgcggtcttgtattttgtacgataatccatataagcgagaagattaattactcaagcttaatgtgttaaaaggccttgtacttgtgtaggtaccaatatgaatttatcgaaaggattgtggaaaaggccattaatataccaagtccttgctccaatgacagctacgaggaagagtca

SEQ ID NO: 6665 - DNA, 396 bp, Glycine max
gcagtttctgatttgtgaaactacaaaaaattgaatttagaactgataaagggtctaatagaagagttaccaccatatcatgttataccaaactagcattagaatttatcatgatccttatggatatttgttagtaatgttcttagttcttatatagtactagaaagtggtgcttgaaatttcaactactattattggtgtagaggctcaatcgagttaaaagtgagaaagcaattaaaagtctttgaagtgaatttggatcaatggtttcttctgtgtttacccttatgtgtgttcttcattctacaatagctctaacttgtggagctttgatgatattctactccaaagagatctctgtgctaggccatggatctgagaccgctagcaagctta

SEQ ID NO: 6666 - DNA, 497 bp, Glycine max
tacatgtattatccattgagaatagagatgttctacttaattaatgatggttgaaccagtgattcgaaaatttgtatattattctacaaattttacatttaagttgagatcctgtcatcctacaactgatccaggtgtgactcttcgacaagctacggaggatcccatcagctaataagaactcgcagataatatgaatggaaagaagcaataaatgttgtcatcgcacaaaaagcccaccatgattgagactaagaacctactaagggccgaaacatcaaaattctgtcgtgtcataatcttcaaatactgattccttgtcactagaattgtgccaaacttttctgggtatcctgcaatcgatgatcataaaacattaatagagaaaatattcactaaatgttggtaaaaatgaaccggggacaaaagggcggcctttacctaacatgaatttaccggaactcgtcatgataatcgctatcatcatcttcatcatc

SEQ ID NO: 6667 - DNA, 332 bp, Glycine max
tttgcttactataatacagatatgttggttgatctgcatgccttagatggttaagatacatcattgtactttagtgatttcaaagtatggaacaaaagatagttgttgttgtcgttgttgttgtggttgtctttatacacgtaggagacttgggccagtccttcatcactctctaagcagctctttttattttctactttcctttttctcttagcttagcacaccatatcactgaggttgcttaaatgcaaaactggctcttatttgttgcatacttgacaaactcgatggaaattccaattgaaatttatcacgccttgttatttgactgg

SEQ ID NO: 6668 - DNA, 1001 bp, Glycine max
gtctcctgcttgcatctcatcgcttccacaggcttcttcaggttcgccgttacgtttatcatgatgttgttaggttggaagatcttcagaaactcatagattgctccaacgttcaggtaaatatataaacacactcacatacattaagttaaataaagtaatattatgatggcggcgctgattaataattacctacaattcaactcttctgccacaaaaaataagtaaaattcaacttggtatggtttgctgattgaaaaagctttgaattctattattaggcctataccatcaatagtgccaaggtggtgttcatcaagaagagacctcaaaaccggcaattcaaaggatcaggaaactactgcacctcctgtgatagaagcctccaagagccttttatccattgctcccttggatgcaaggtacataaatatattcataattttatactaaacaaaaaaaattcactcgtgtgttcctggataggttaattattctgtagagagaattatggaataaaactgatatttcttcggtggaatatagcatcagaaaactcttttaatttgcttatcagtaatatatttatttatgtacattgactataagatgaggaatgctagcattcctcttataagtacactagtgaattgaaattgaacttccctaaattaattacgtggctacataatttgattcttgaattatatagttaaagaggaatagctataataaataaaaccaataagagtctattttatttttttattcgcaagaattaaaaataatgtcaaaaatttataataactcatatatcatgatgaaccaactgaattagattcctgaggatttgtttgatcgttaaggagtacataattagtttgattatcattaatggtccatgtgtgtgtgtatgtaggtggattttgttctgaaacactataaggacctctctccctacttgagaacatgcaactccctacagctaagccctgactttt

SEQ ID NO: 6669 - DNA, 376 bp, Glycine max
gttggagaccactctcagagtggttggagctgtgcttgatgatgccgagaagaaacagatcacaaacaccaatgtcaaacactggctcaatgatctcaaacatgctgtctatgaagccgatgacttactcgaccatgttttcaccaaagctgccacccaaaacaaggtaagaaacttgttttctcgcttttccgataggaagatcgttagtaagttggaggacatagttgtcacacttgagtctcatttaaaactcaaggagagtcttgatttgaaagagagtgcagtggagaacttgtcatggaaagctccatcaacatctctggaagatggatctcatatatatggtagggaggaagataaggaggccataata

SEQ ID NO: 6670 - DNA, 324 bp, Glycine max
ttcccttcaagtcaagactttagaccaggaaacctctggatcaacctctccggagtgatggagtaacagttccctatgaacaccctttgcctcgtacacctctctatcctgtaccaacttttacacaccaaagacaaagcatttcgatcactgtgtgacaccacatagtcaaatatgtgctctattacctcgtccgggaaataattcatcatctttttttttcttttctctcactcagtgatcctagctcactaattttccaggaaaattttcatactccaaaaggggaaggggatagaaaaaaaaaaaaaaaatcccaaaaag

SEQ ID NO: 6671 - DNA, 443 bp, Glycine max
  misc_feature (384)..(386): n is a, c, g, or t
  misc_feature (421)..(421): n is a, c, g, or t
tcgttctgatcagctgagatatatgttttggggcttgggtataaggcccctgctaagattgatccacggcttcttgatgtgaagcatctctttcagggatctgtggaaccacagcctaaggtaataattcagtttgttttcggggatgctgggttggcatttttggttttgttcgtttttggttcatttggtttggtttttttgggtggtgattggtgtattggtgatgcaggtggtggatgtacttcgagatactaagcaaaaaaggcaccgtgatgggtaattagtgcttctttaaaaaacttggtttgacttttaatttgtattagcttttctgtggcatactttctcaaattattctggtcatcttcttgcaatggaatnnntgatcttaattttttatctgctatattcatcacangcaatattgcataacaaactaa

SEQ ID NO: 6672 - DNA, 328 bp, Glycine max
tggcttgtgtagttattgtcttcacccgcatgaggaagagaactagagattttctgaagaagcggggttggtgaatgaacttgtgtgtgatgcctctgtggtagggttttatgcatttctctatacactttcaagatttgtttaaactgacataattttgttgattacttatatcatcacaaatgttataggttaataataagggatgccacatttgatgatacatatagatgtttttgttcagcgagtataggctatctatctacatagatgatagatctttttccttttattgttgctcaaatatgtgatcattgattggagtgga

SEQ ID NO: 6673 - DNA, 463 bp, Glycine max
tgctgccgaaaccaacccacaggatgcccccgttccaccctgtatatcccaccttgaaggcggactcgttcaacttgctatagaagtcgaagatcgtgctcaacgttctgcaatcaccagagtcaatgctgatgatgttcgagtcactgttgctgctcctgctgcccgtggagaggctaacaacgaacttttggaatttatgggaaaagttttgggcttgagattgagtcagatgactcttcagcgaggatggaataacaagtcaaagctgcttgtggtcagttacattctaatcaatttcgccttcttctttccattttaactaattctcttttacatttcacgactgtttcaggtagaggatttgactgctagacaagtttatgagaaacttttggaggctgtgcaaccttagctttagtatccatgctgtccttccatagcaagccaggttgaatctcat

SEQ ID NO: 6674 - DNA, 859 bp, Glycine max
  misc_feature (699)..(699): n is a, c, g, or t
  misc_feature (755)..(763): n is a, c, g, or t
  misc_feature (765)..(768): n is a, c, g, or t
  misc_feature (793)..(794): n is a, c, g, or t
  misc_feature (804)..(804): n is a, c, g, or t
  misc_feature (812)..(814): n is a, c, g, or t
  misc_feature (816)..(816): n is a, c, g, or t
  misc_feature (819)..(826): n is a, c, g, or t
  misc_feature (829)..(829): n is a, c, g, or t
  misc_feature (845)..(846): n is a, c, g, or t
  misc_feature (848)..(849): n is a, c, g, or t
  misc_feature (854)..(854): n is a, c, g, or t
tatgtcacgacagaaagttaggttttcaccgacagagatccaatgtaagttcttctattctttgattttttacaatttttttcttgtgtaggccattgctttattattcaatttctttaagcctattagaagaattcttaccgtcaatgattttaatataaggtttttttatataacaaagtcgtcatgaaccgagtattccaaaagcttaagctattggatgaaagtacaagaattgttttacatctaacacatcccctcatgcaaatcatattgtgttggcattcaactttttatttgaagaatggtagcagcaaagatcaaactctacaccacttgacaacattgatatgcatgtgcattcatgctgtaatctggttcattttttaaagactttaattttttgtgtaaaaactgggactatttaaaataccatataaagcaattgatttgtagttttgcacaaggcaaagactattaacttgatatttgtaccatagtctgacttctataacatactttaaatggttacgtaacagttgttacaaggtcagaaggttctgaagaggttaaatcttcaggtttgacaagtgagcttattcctaatcttattgaggttagtattttgaaaatctcactgtcgattcatctcaatcatctataaatcagatacaaatttgtgatgactttattatgcgntcttcatctgttaccttattttgttcatttaaggctttgactatttttaagattannnnnnnnngnnnnctgaggctggacctgatttctattnnctctgtttgntttctgannnanttnnnnnnnnttnataaaaccattttatnnannccacntttac

SEQ ID NO: 6675 - DNA, 400 bp, Glycine max
cagtaaattgaagcattattaatgcatacttgatgcatgtttgtttatgatgtttaatgctcaagaatttgaatgacgagatgtttgattttgaccaaacagggagcaatattatcggctgcgctgccgggtcttcaggagaaggtatgcgtaaaacaatactagaaacttagcttgattatgaattctctttaccacgttgacttagctagccataaatttatatttcttactaatgcaataaaaaaacaataatatattataaaaaaattttaaaaaaaattaattgttcaagtttcatgaagttggagagggatcaagtgtccttaagttcaaccatgtagctcacctcttatcaaaatgtcatcaggtagtcttctacacatgtcttcttgacatg

SEQ ID NO: 6676 - DNA, 905 bp, Glycine max
  misc_feature (871)..(873): n is a, c, g, or t
  misc_feature (884)..(889): n is a, c, g, or t
tctgagttgcaggcagccttggattgggcttgtgggaaagggggtgcagattgtagcaaaattcaagtaaaccaaccttgctatttaccaaacacattgaaagaccatgcttcttatgccttcaacagctactatcagaagttcaagcacagtggaggttcttgctacttcagaggagctgccataacaacagaagtggatcctagtaagtattaaatagattcctgataaccactcacttatttcctactttggtttaactaggacataatgcatgttcacatgacaatgagtcaatgagtgcaatttaaatgaacctgatgcttgaaggttaatctgtcaagtatagattttacaaataaatccaaaacccctaaactacattcaaactacttcggtgagcgtgcaggaaacagaaaaatttgaactgaattggcaagagtaatgttctcactctcactaaacaaattttagatcaatcaactgatgaacaattacactttataatctcataaacagtgtttctcatctcatattataacctgaagaaattattcttttacacttttttccttccatctccttttacgccactccgttctgcacaataaatggtctatgaaaatggttccacacacgagtcccttttcagttgtcagggattggaacaatcccgatttaaaatgattaagtttttgcaccacagaagaagtgtatgataagggtgatttataacctttttgcttaatgtttgtgcgcaggtcatggttcttgtcactatgatttcattccctgatgacaaccgtgaatgaagacttaaaataactgcagcaaaaactagagctcgtgcctttgtgtgtttgtgtcccannnttcccaatcannnnnnatttttttggggcctt

SEQ ID NO: 6677 - DNA, 367 bp, Glycine max
ttctgtctggttgctgctactgtactgtatgtcactccattccaagttgtggccctctttactggaatttatgttttgagacatccaaggtttcgttacatgcttccttcggtgccgctgaatttcttcaggaggctgcctgcaagaactgattgcatgctttgattccaggatagtgcagtaggttattgttcattattctgtcacaggattttctgtttttacttttgaacttcatgttagtcttgttaatttgtaattttgtaggtttgagtcacagcttaattactttttatgcttaatcagatttagtagtgtttctcaatggggagttagtttaaattggcagtggaggtaatttctgtat

SEQ ID NO: 6678 - DNA, 357 bp, Glycine max
gcacgaattcatggagatttagatcttgaagatcatgcggaggaggtgttaacatgtcttgatccttcaaaagccgttgctgataaacttcccccgcctccaagaaagaagcagtctgatatgaacatgctagaggagaagaatagggtgactgagtatcggtattctataccctataaagaagaggctcatgagaaattgggaggtttgagtgggcagatgagggaagcaggttatgtgccggatacaagatatgtcctccatgacattgatgaggaggaaaaagagaaggccttgcaatatcatagcgaacgtttggcaattgcttatggtctcatcagtacaccaccaaggaca

SEQ ID NO: 6679 - DNA, 689 bp, Glycine max
gtatgccattgttgcatcccgtcaagaattagatgaggaaaatgcaggggttgatgttgcttcaagtgggactttggatggtgaaacaaataatgataacttggcaaagacaagaaatgtgcgtgatgcagtgactcctctagctcatatggcctatgctgatcagttggagcagaaaacaagctccctcatgcagattctcaaaaaacttgttagtcatgattgttcctattttatcattgtagttttgtctattctatatgtttcttacttttttaaagaaacggaaaattaaactatgaaattttattgacagactagaaatgctcgtaaagcttgtccaaatggcgtttctcttcctgaatggattctcaagtctagggaaataggtagtgtgttattttaaatcttaaaagttctttcaaatcttcaattgttcaagaatttaatctatagttctgggtcatagtttagtgcaccccctatatgctctatttgtgatctgggtttatttgaaagtgtgtagtaagagttttaatggctcatgtagttgtttcgtcgtttctttttacacttctgcaggtggtcttccgtgcaaactagagggtattattgcatcccctattgtaaatggataccgtaacaagtgtgagttttctgttggatattctctggaaggcaaagtgaca

SEQ ID NO: 6680 - DNA, 410 bp, Glycine max
cactggaagcaaatgctcactggttgctaaaagaggagcttatgtttgtatgtagaattttcaagatgcagcatcagtgcatgctaagtagggagcttggatttctctctggtacctaagatatgagaatgataggattaatgttaatattaactcaaggaatgacttcttctaatcatatgtatgcagttccttcagttaaagaatttatgcaatgacaactgtttcttttagaacatcatatagatgccaaaaaaaaagtgaaattggtacaaaatttagcttctagactattttttgggaggtgatgttgctgtacagaatatgggagactgtattgtgattctgcatttattgatgaaaagccaaggatttgtggaacccatatatctcttgattgcatggtcaga

SEQ ID NO: 6681 - DNA, 721 bp, Glycine max
tgctcagttttaaagataacttagttattaccactgtaagcctctactttagtttctcatctttgttctgttgtttgtcttttctatacactgacagattttatctcattcttagttagaacttagttataatcccattggaccagatggagccaaggccttggctgaagttctcaagtttcatgggaacataaaaacccttaagcttggttggtgccaggtaaccttttcaccatgaattacctgtaaattgtttgtaataacttttatttgtaacattggataactttatagataggagcaaaaggggcagagtgcattgcagatgctttaaaatacaataccaccatatcgattttggacttgcgagcaaacggtctaagagatgaagtttgttatccgtaccttgagtcattttaccctttaatcattttttcaaatcttcatcagtcaatcttaggatgttattgttttatgaatcaactattgcagggtgcacagagcctggctcgcagcttgaaagtggttaatgaagctttaacctctctagatttaggatttaatgaaataagggtatgaatgtgttcttttgtgtttttggttcataacccatggaaattatatcatctctaatgccatagttgtctgattcacaggatgatggagcttttgctatgctcaagcactcaagtctaatgatgatgtagctgtcacatcacta

SEQ ID NO: 6682 - DNA, 1085 bp, Glycine max
  misc_feature (1077)..(1079): n is a, c, g, or t
atgtcagcatggagttaaagggtcattaagttctgaaagaggcaatttatctgattggggaagcaccctggataattctgtaacacctttgtctctgaagtcccctgttcgggagcatttggttacaagtcagatgactccatcttcaggtaaatataaactctattattcttttgtggaatgtactataacattagcacaaggcagttgatgtttatagagtaccccaatgtttgaaagttgattacgctgatgaacaaattcttttggcaattatctttgaatttattgtgctcactttctcaagcttcacttttgtctttctaacagagggaatgggaaaatttttggttaagctctctggctgaacccaactttatttttccatgctgtacctttcactgtacttattaataatgttgcatagtggtgtctagaaattgctcaggcactttcagggcttaatagttcctttatagatcattgctctttctagattcattttcttttaaaaaaaagataaaaagaactgccttttcaatcttactcatttctagattattttttaactatttattttgtatgcgaggatatctttcaaactggtattctctgtatcatgtttgcttttcatccgctgtttgtttcctgtctataaggttttctatttttgtggcatatattgcttcttgacagccatatgattatgctctctggttcctaggtttcctgtttttttgttttgagagttaatttttctttcttcttcctctttgtgcttgttgcagatctatccatgtcaagtaattgctctgcagtggtgagttttgaactgctaaatttgatacaaaagaattgctctatatctgaattacaagcctcactcttaatctatatttctctttaggtgaagaatctgattgaatcaccagagattgcagaatcttcaataccaaatcgttcagtaccttcagttttctcaatccctacgacagatccaatgactaatcataattatcacaatcttcctaactcaacaccatccagatgggctcattgttctcccggacacccacnnnaacaca

SEQ ID NO: 6683 - DNA, 383 bp, Glycine max
cttagagacgatgcagagtttcgaacctctaatcttcttaagaaggccaagtagcttccttttaagctcactcaacgctttaatgatcatgcttatacccacagctaagcctgaatatattatcatcgatggtgcacttttgagtgttcatttcactttctatcattggtataaatttagttggagttttgcctttacatttgggtgaaagatgaagttgacattcttgacgctctcttcaaggccgaaagatcatattggggttttcccatttctctttagcttacttaaaatgtgtacaaaatcttacttcaattggtggagtgattcaatcttgaaggattcttgggtcgcgtatgcatttggactatgaacagaatgga

SEQ ID NO: 6684 - DNA, 397 bp, Glycine max
agagtccaatcacattcaatgtatgaatgctttattttctcttcaaggattaattgtacaattcatttgtttgatgtgcttccgacctcagccaaattggcttaacaaagagacacaaagaggaaacaaaaggggaaaaactaaaaaataagtcccaagtcctagatctcaatctacaagaatagaaaaagctaaaaaaaatgtctcaagaaaatttacaacttacaagggcatagagacaaaactaacaaaagttgaggcaacgaagcgaagagaagaaatgttttgaagtaaaaagagaaaaatgtataacaatcatgtaaatagaaaattgaggaagtaaagagaaaaaaaaataagatatgtgaaaatatgttatactctgttggtcaagatt

SEQ ID NO: 6685 - DNA, 468 bp, Glycine max
tcagttttatatttcagaagctgaactgcaaatgcatcaagctaagacgccattgtggggaaagactggggtatgttatctcaaaactcgaaaatgcatttttttaatgctttttttaacgatgcttgatagcttgacatttaaatatatgattttgttgccaaccagatatattttcattcagtgggtaaagaggctactttgatgatggatgaagaagctgctctcgaaggggaatttgagatcgaaaagattccaactcgtgtgatacaagctaggtcaaaagacttggttccaatttttgactatattcagacctcaaaatttcaacaaataaggtctgctttgatgactaactaattaacttactaattatctattaggtaggtcaaaagatttaggcttttgatattttgctattaatttttttgtcataacgacattacctcactttcgaaggctagagaa

SEQ ID NO: 6686 - DNA, 365 bp, Glycine max
ttgaagattgtgagagtttagttgcagttgatgactcaattggttttctgaaaaaacttaaaaaattgagtgcttatggttgcaggaagcttacaagttttccgcctctcaacttgacctctcttgaaacacttcaactatctgcgtgttccagtcttgagtattttccagaaatattaggagagatggaaaacataagggaacttcgtttgactggcctttacataaaagaattgccattttcatttcaaaatcttactggactccgtctgttagccttgagtggctgtggaattgttcagttaccatgtagcttagccatgatgcccgaactgtcttcattctacactgattattgcaacagg

SEQ ID NO: 6687 - DNA, 601 bp, Glycine max
cgggttccgcacgaatcctctccgacgtcactctccgcctccgtcaaaacctttcggtaatttctccctccctcaactcaattcaccttcgcctagggctttctttctcgaacattccagagagcttcacaatttttatttttttttgcaggttcacggtgtgcgcgtgcagaacataaacatcggaggcggtgtgggaggcgagatcccggacaacaagcgtctggtgtacgctcttcagaacctccacggaataggccgttccaaggcgcaacacatcgtcgccgagctcggcgtcgagaacaaattcgtcaaggaccttagcaagagagaactctattccattcgtgaattgctctccaagtatctcatcggaaatgatttggtacctaatttgattttaacttatgaaataggttttagtttggttttacctttcttattttctactcgtatgcgtgattggggggaagtttactattcaaataggcttgtttgtttcgttatgtgtatgtaatgtgtatttgtgtgtttttctcagaaaaagtgtgttgagagagatgtgggaaggttggtgggcattcagtgctaccgagggatt

SEQ ID NO: 6688 - DNA, 929 bp, Glycine max
caactgtccgaaggcttgtattcacttcctcagcgggaactgtggatgttacggaacacccaaaccctgtcatcgatgagaactgttggagcgatgttgacttctgcacaagggtcaaaatgactggttgggttagtttttttttcttcttctttctattattaaaaaatggatgaaatatgtgtttgttcatcaatgcacatagactaaatcctatggatatggaccagattgattgatttgaaattaccatggctgaaatcaagtttatccgaaaatacataatcaaaaaaattttacccaaaaaaaagaattgtgtcatatatccttgtagtttttctttattcaatagtggatgaatatgattctatataatgtttccatttttttgcagatgtattttgtttcaaagaccctggcggagcaagaagcgtggaaatatgccaaagagcacaacatagactttatatcagtcattccaccccttgtcgttggcccctttcttatgccaacaatgccacctagcctaatcactgctctttcactaatcacaggtgccctttatacgtggattttgttgtcattttaataaaccttaacatagtgaagtctaatttattgtgtatagtttattctattattcatctttcaacgaattaatgatacttaatgctgctgcatatgcaattattttaagatttagatagatgacagttgttgtcaattttttttctgtccacacaaacaaatgaatacataatgcttatgagtcaggagtttaagtgggttgattaaatgcgtgaaatcctaataatacttatcaagttaatatcattattcttgaaacaactcattcaagatatttaatgttggaatggtacttaattttaattgacaggaaatgagtcccattaccatatcataaagca

SEQ ID NO: 6689 - DNA, 364 bp, Glycine max
aagaatcttgtgctgatgcttgtgatgagatgaacccattggcaatagtgcctgtgcagaccaatgatgctgcttctaaaccgggttggcccctgcttcgtaagacaattgtatctgacaggaaatgttctcaaagatcgctcttgtgccagatctcggtggtacaatgggcaatgcagttaccctctagagatctttcatatgctgcacatcaagaccataaaacaaacaattgtggcccaaataaggatcagtttctggcccttgatagcaagagtggtgctcttgttccggtggatgctgaaatagggactgctccttcgactgaacacaattcaagaagcattcctaacgaattggatgg

SEQ ID NO: 6690 - DNA, 371 bp, Glycine max
ctccaaatcaagaaagatcttggaaacccaaccactctctcctcatggcttctaaccactgattgctgcaacagaacatggctaggtgtttcatgcgacaccgacacccaaacataccgcgtcaacgacctcgacctctccgatcttaacctccccaaaccctactctattcctccctccatagccaaccttccctacttgaattttctttccattagcaggaccccaaccctaatcggtcaaatcccctcagccatcgctaaactcacccaactccgttatctttatatcacccacaccaatgtctccggccctataccagatttcttgtctcaaatcaaaaccttagtcaccctcgatttctcctacaa

SEQ ID NO: 6691 - DNA, 1044 bp, Glycine max
acagcttttcaaggaatctggcaatttcagcaagaactttcaaacaggtaagatgtaaccatcctttgttcatcactttgtttactatttttattcaaccgcaatctcattgagtacaaattcatatgcacctgtcactttctattgacttggctaacatgttatgttgttttcatgaccataattgcggcacagcaaagtcttctgataaacaaaatgagacggtatgtttacgatccagcctaaacacatatgttgccattttgagtatagggggtgttttacttgggacatcatcatcatcatcattactattattattaagaatcttatttttaataagcttaaggcataaattagctatatataattttattctttcaaatattgttgtgtaatctttctatcatgtctgtaacaataatcttcatttacagaataaggcccccaacagactgtcatccatgttcagtggaactctagacaaatgctcagtttgttcaaaaacagtctatcctctggaaaaggtttgtaatatcagcatactctattgtaagacttgcaattaaaaacgacacgaaggaattataagatttttttccattactatcttggacacattttacagtgtgtttgtaaatagaaaaaaacttatatgtggttctttagacgattttggtgctgttcgtcaataagatttgcagtttcacctcaatgattctcataataaatgtttactttaaaggttctctgagatgaaattctaattctgattggagaacagcctgaacacctaaggaattgcatctaagttttgtttttgttagctgatttcttatcatatagattagatatagaattttgattgaaatgaactaattacaaaacttttgcttgttaaccagatgacactggaaggggaatgctatcacaagaattgctttaggtgtgctcatgcaggttgccacctcacacattcctcctatgctgccctggatggtgtcctctactgtaggcaccatttccaacagcttttcatggaga

SEQ ID NO: 6692 - DNA, 993 bp, Glycine max
  misc_feature (634)..(636): n is a, c, g, or t
  misc_feature (658)..(660): n is a, c, g, or t
  misc_feature (675)..(678): n is a, c, g, or t
  misc_feature (682)..(689): n is a, c, g, or t
  misc_feature (695)..(697): n is a, c, g, or t
  misc_feature (699)..(702): n is a, c, g, or t
  misc_feature (705)..(708): n is a, c, g, or t
  misc_feature (710)..(713): n is a, c, g, or t
  misc_feature (715)..(715): n is a, c, g, or t
  misc_feature (717)..(724): n is a, c, g, or t
  misc_feature (728)..(734): n is a, c, g, or t
  misc_feature (736)..(744): n is a, c, g, or t
  misc_feature (746)..(764): n is a, c, g, or t
  misc_feature (773)..(777): n is a, c, g, or t
  misc_feature (784)..(786): n is a, c, g, or t
  misc_feature (796)..(816): n is a, c, g, or t
  misc_feature (818)..(823): n is a, c, g, or t
  misc_feature (825)..(851): n is a, c, g, or t
  misc_feature (855)..(861): n is a, c, g, or t
  misc_feature (866)..(870): n is a, c, g, or t
  misc_feature (872)..(926): n is a, c, g, or t
  misc_feature (932)..(937): n is a, c, g, or t
  misc_feature (940)..(945): n is a, c, g, or t
  misc_feature (948)..(948): n is a, c, g, or t
  misc_feature (952)..(952): n is a, c, g, or t
  misc_feature (958)..(958): n is a, c, g, or t
  misc_feature (961)..(962): n is a, c, g, or t
  misc_feature (964)..(965): n is a, c, g, or t
  misc_feature (967)..(973): n is a, c, g, or t
  misc_feature (976)..(983): n is a, c, g, or t
  misc_feature (986)..(989): n is a, c, g, or t
attttcttggattggttgttactttgatcactaaggagacaatggcagaacaacatgtagttggtggaagccaaggttgggatgaatcaacagacttcaattcttgggtttcaggccaaacatttaaggttggcgatcaacttggtatgtttcttgcccataattttaaaggatttaatttaaatgcactaactataaaattgcattccattataaattaccattatgataagattcttgacttttaaacactttaaaagtcatattcacaatgatttctagtttttacactcaattcataaaatttaaactctaatttagcaacttagatgaactggaatatttttcccccttcaaaattctatttactttgattaacaagattatgtgtttatccttttttcttgtggcagttttcaagtactcttctttgcatagtgtggttgaactaggtagtgagagtgagtacaagaattgtgatcttggcaatgcagtgaactcaatgagcagtggcaatgatgttgtgaaactgaacaagcctggcacacgttactttgcatgtggtacaatgggccattgcgatcaaggcatgaaggtgaagatcacaacagtgtctggctctgagacctcttcnnnctgcatcatcatcttcttcttnnnctaattcatctttcnnnnctannnnnnnnctactnnntnnnncannnncnnnntntnnnnnnnnctcnnnnnnntnnnnnnnnntnnnnnnnnnnnnnnnnnnnctccctatnnnnncccctcnnntctctccccnnnnnnnnnnnnnnnnnnnnncnnnnnntnnnnnnnnnnnnnnnnnnnnnnnnnnncttnnnnnnncctcnnnnntnnnnnnnnnnnnnnnnnnnnnnnnnnnnnnnnnnnnnnnnnnnnnnnnnnnnnnnccactnnnnnntcnnnnnntanccanccctcntcnncnntnnnnnnnccnnnnnnnnaannnntccc

SEQ ID NO: 6693 - DNA, 255 bp, Glycine max
taaatgtacaacatgagttgaaggaatataaatgtgagaaaaaacagaaagagggaagttaattaatactgtgagtaacggatttttatttttaaatgatcaaacctcgcttttttgtttctggattcaattcaaatggtgtttgtttaatttctcttggtatatcacttgaaaggcacaggccccataaattttcatgtaatgtttgtcatataagggattgctgtttgttaataatgtaaatgtaaatatgag

SEQ ID NO: 6694 - DNA, 375 bp, Glycine max
gtcttgtagctgaatctaaggatgtttttgatcagaaggcaagcaataagtactggattgatgttcagctacgatggggtgattatgactctcatgatattgagcgttacactcgggccaaatttatggactacacaacagataacatgtctatatacccatctcctactggtatatctctatcattttacaattctccatgatatggaatttatatgtagagttgactacagcatggctttccatgcaggggtgatgattggtcttgatttggcatataatttgcattctgcgtttgggaactggttcccagggtcaaaaccactacttcagcaggccatgaataagatcatgaaggtaagtctgttacacaat

SEQ ID NO: 6695 - DNA, 838 bp, Glycine max
caacttcacttcagaaatcagaccctcgacaggaaggaaaccctgaaacataagccaacaacagctcagaaaaatggagacaagtgcagtatgtagtatgttattggtctatggccatgatacttctaaacaaaactctctgtttctaatgtttttaacatcagccaaatattgaatgcattatcttgaaataatgacaggaaatatcacacccagcatggaagagttctctggaaaattacagacttttataatgatttaaaaaggtttccatcagagaacctacaggatcagcaattttttatgcatgcactaatcagttcagggttacaagttcaatattcactgagtattttcagcaataggtttatacctgatctggaaagagagatccactccggtaagttttgtcaatagcatgatggcgaacagtcacttttgcaaaatcttcatcaataaatattctctcatttcctggagttcctccaaatgcaactccaaccggctttggatgcggttggtatactttaccagtaggatgcaagtggctataaacaaaattcttttccttacctgtcaatagtaacatacatgattgatttcagggtttcacaaaatccaatctcagccccacaagaagagagagaacaggaaaaggaacattgtcacctctactacctaccagttggtggaaacacatgaaacactgggtcaatagaatataaacatccagagtttccatagaagatatctttattttcaagaccttgatctgttaaggcacctataacccatttcctatcaatggaatttccctcgtgagcatctcctgaacttg

SEQ ID NO: 6696 - DNA, 937 bp, Glycine max
catagctatactgttagatctatggaggaaaaatcaaaacttgagctctggattgcactcttctcacgcctttcagtcttccagtgccttctgttctgcctctgctgccactgccgctgcagcgtctttagctgcgggaaccggttttgcctcaagggcattgtttgggtatgctctgcctccatttttctatacatgcattgttgttagtgttttaggttgttgaaggattttaatctaggctaggatatacaatttgacaaaatatgattggtttggtttggaatattttggtatggctgtggattactatacattctacttttaaagtttatctggatggtgaaaatttgggttctgtttttggataaatgggttgttgatagttttattgtgtgctgcttattaggatttaggacataatttggttcgttggtataaattggaatccattcaacacttacgtttatttgtgaaatagttaaaaattctttaatgtggtaaaacagtttgttatttatttatttgttttgtgtgtgtgtgtgtgtaaggggatttagtatcatatttgaaggagttaccaacttaccattgaccacccaattgtagcaatttggaggaatgacagaaggaaaacctatgaacatttgtgatgtttgtagacgtgttctgagttgtagtatattgtcctactttggtttaaccatgtgcaatgagcatatatttacttttttttgaaaggcagcatatatttacttttaactctcacactactttaatttcaggtcatcagttgcatattgtgatgctggtgcagtattaccagaagactacatttctaatatacaaagttcttttgaaaggaattataaatatgatgctgtaagatatagtaccaagcagtataatgtggaacttaagcctctcttctctgctt

SEQ ID NO: 6697 - DNA, 395 bp, Glycine max
agctttgttgcttttcctgttagggttcagtgcaaccactgcagatgctactcgcttcgacccacgttccttcattactcaggtgctccccaacaattactatgtaaaaatcaaatccacagccactgcatgttgtgatctttgtctttgcacaaaatcataccctccccagtgcaattgtgtagatgagagcgagacaggctgccactcatgttgcaaaaattgcatttgcaataagaaatttcctcggacgtgttattgttcagatataaccaacttctgctatgacaaatgtaactcaactgaagccaattaaagctcactagctaggaatatgaatgagcatgtttccataaataagttgtgaggcaaagcccctttaggctttgtctact

SEQ ID NO: 6698 - DNA, 895 bp, Glycine max
tttctagaggaactgccatgcacctagttcaatgtcgatagtttctgaggtaaactctatattgggtagcttttcactcttaactattaccttaggggaaaagaattgtggacatagttctctgcaagaaagcaaaagctccacatgattttggcattgtggacttagataaaagtgatgatgcaagacattttccaaaatgcttatactttaagtattacgattacaaatttattgttatcactgaataaacatttctgtaggcactagaaaattgatgagaacttgtatgttaagaaaagtgtaaggtcttggctaatgttgatatgtagcatggaagaaacagggctgtagtgttttgcggctttttagctgcaggcttttaatgttttgatgaaaaatattatgtggtgagcatggagatgctccatactaatacatgtctgtatcaggcgtaacagttgtgggcatggttgacaaaacctaacttttctagtgccaaaattagtgtggccattctaagtgatcttacctgatttaggttgttgaccctcttcatatatacttttttatattttgcaggcttgccaagggaaaaggagctgctccatcaaaatctcagacagtgcattcggggtagacccgtgtccgggtgtggtgaaaacattgtcagtggaagcaagatgcacatcaccattgagtgatgacttctttcaagaggctgttagcagcttctaaaatgaggttcggtatgaaccttgtgaacacaagccaaccaactggacaatgttactaaccagaaatggccattaattgtgttcactcgattgtgtatatataaatgtcatgatttagtgcataagacttggtcttttgacatgaacagcaaataagt

SEQ ID NO: 6699 - DNA, 741 bp, Glycine max
  misc_feature (717)..(717): n is a, c, g, or t
tctattgatcatgcactgatacttcactaatacgtatcttcgaagtatccaagcttatgaaaataattatggaaaattcaatatgactacatgagatatatagacatgtataatgtagaaaaatgaaagcattgttcattgatgaaccaaaattgatttttatttattttttatattttatggatgacttcaagaaggaatgaagttggtagtattattcttatttgtaaatttaataggaattaatttatgatgacgaagatatgtctgatatgaaaactaactatgtttataatttatatttgttgcattgcaaatatatattgattatgttttatgaatctttatacatatctagatatgtatctgatacatgtattgtatctgtgcatgataggtaccaatggaacagacagtgagttctacaacccaaagaagaaggcagagaaagagtacctcacttttctcgcaggatttcgccaacttgcaccaaaggatgtgattttgaacaacttggcactatctgatgtggacctgcaggacctgattgctaatgctgacagcgtgacctctgatgaggtgaaggatgataaggggcagctgtactatgtgtatgagattgatggagttggtactcatagcttgatctcagttacttgtgctaagaacaagctctatgcacattttgtcaatgcccccactcctgagtggaatagngacaaggacatgttgaggcatgtt

SEQ ID NO: 6700 - DNA, 408 bp, Glycine max
ttccttgacttctgcaaagaaagagaatcctaagatacatccatccaatgaggagaccaagaaattgcaaaaaccagtcatcaggaattccaccattgaacgccttgcaactgcccgagtaagtcagccgaaggtttcaccaagtccagcaaaatcaggtccaaccaagaaaccatccttgaaggcaaatggtgtacctttgcagaagactactggcacagaaaagaagaagcaggccccaaaagaagtcaaatcttcaagtcataaagaaaacgaaaagaaaacaaatggggaggttctagtaggtgccactaatggccaggataagaatgaaaaagaagtctcagtagcattgccaatgaagtctgtccctgcacaatctgtcgaaccgaacaacagtaatctaaa

SEQ ID NO: 6701 - DNA, 390 bp, Glycine max
tcaatttattaagccatgcctagcttctctgaaaataggggatcaatgaaattctgtcaagtcatgccattctatttctgaaatcacttgtgctgtctgaatggagaagcatgcttggcagtctcagatatgaattttggatttaaacctttaattgcaatcatgattttgttcctcattcaacgcctctacagcttcatgtgcatcagccctcacttatattcaggtgttgtattcctttgttcctgacagggaaaatgatttcctgatttggctgatgtacttctggtgaggaataacatgccgatgtctttcataatcatttatgcctctaatactagttatgttacaggttttgcttttgtctattatgaggatgagcgtgatgca

SEQ ID NO: 6702 - DNA, 699 bp, Glycine max
tttgggttatccgagaaattgatgtctgcaaatgggagccttgggatatgcccggtatttatttttttattctcttcatccttttgcaatcataatctctagtccgaggtagcgttatcacttaaatatattagtttctcacgtcgtgataaattataagttgttgttagagtctgtcttagagttcatttagtgattgttgttggagtttctctcgtttatgtttttgtttaaagtaatttattttgttgggttgtgtatttgtaggtttgtcggtggtacagaccaaggatccggaatggttctttttctgtccacaggaccggaagtatccaaatgggcatcgattgaacagagcgacaaataatgggtattggaaggcaacggggaaggatcgtagaatcaagtctgggaaggatttaattggaatgaagaagactttggtgttctacactggtcgtgcacccaaagggaataggaccaattgggttatgcacgagtatcgtcccactttgaaggagcttgatggtactaatcctggacaggtacatagtgctactctactgcaatttacaattaatctaaggaattatatgaagtgatgatggttgatgattttcaatttgttttgtaacagaatccatatgtcctttgtcgtttgtttaagaaacatgatgagagccttgaagtttcacactg

SEQ ID NO: 6703 - DNA, 828 bp, Glycine max
tcttttctctagctagtgtaatatcattaatcaatggctggcactatctttggataccctttcagacacttcatctggggtcacccaccaattttcaaagaatggtccggctcaacagccctcttagattggctcgaatcacccactgcccacatcttaaaaattaacgttccaggtaacatgttaatatttgtataaaaaagaactgaagagttatttatgtgcttttgatgttattttttaatctgagagaagatgtagctcatttgattgaacaaagagtattagttgttgttgtaaatcatctggtaccggtcttcaattatgaattttttttttcaaagttttaattactttgatttgataatctatgttaatatttaatgtaaatttttgttacacatgttatagaagtgaaactccaattctaataaggagaataatagtaaaattttgcctagaattacatctaaaatgtgtcctttatttatcacactctttcaccctttcttcacttttgatgacccgttagaatgttgagtggtgattctgtgtatgatggtgaaaatgaaatctttttgtgggtttgacttgattagtggagtggttgaatgattataattgagttttggatgatgggtatttgtgtggataggattcagcaaggaagacataaaggtgcagattgaggatgggaatattcttcacatcaaaggggaagtttggagagaggagcctcaagcaaaggagaaggatactgtttggcatgtggctgagagaggcactgggaagggagggttctcaagggaaattgaatgccagagaatg

SEQ ID NO: 6704 - DNA, 417 bp, Glycine max
taccgccctcaccgtcccgaattctccgtcacaaacctccgcattgcaaagatgaacctcacaacctccgcggactcaccttcacacctcactacgctcttcaacctcactctcatcgccaagaaccctaacaaccacctcgtcttcttctacgacccgttctccgtgacggtgctctcgaactctgtccccgttgggaacggttccgttacggcgtttacctccgacaagaacaaccaaacgagcctccgcgcggtgctgtcggggtcgcaagatctggacacggactcgttgactagcctgagatcggggctgaagatgaagagagggttccccgttgagattcagatggacaccaaggtgaagatgaagatggattggctcaagagcaagaaagtcggaattagagtcacctgc

SEQ ID NO: 6705 - DNA, 655 bp, Glycine max
ggagcacccccagaaaggggttgattagagggctctcgataatggactttattttgagaattgttgcagccattgccacactcggaagtgcattgggtatgggaacaactaggcaaacacttccattttccacccagtttgtaaaattcagagctgtatttagtgatcttcccacatttgtgtaagtggtcattctttaggttaaattaattttttaactctctaatttatttttagattcaatttggttatctagtttttctcaggtacaatttgatcaactaattttttaaatcgatcttgtaaattaaatgaacaaattaaacctaaaaagatctagaagataaaacaaaaataaataaaagattaaattgatctaaataataaattagaggaaaaaatctaatttaaccacctttttattagagattttggtatatatgccttaaaataatgtttttttactaagaagaaaaagtgtacaatgagagtgtgaaatatgtaattgcaggttttttgtgacctccaattctattgtatgtggctacctagttctttcacttgttctgtcattcttccacatagtaaggagtgctgcagtgaaaagcaaggttctccaggtctttcttgacacggtaaacacactgattcttct

SEQ ID NO: 6706 - DNA, 735 bp, Glycine max
agatcttgaaggcaagcacaagaaaggagtaaggaattcttctaacaaccttttttcagaaaacatacaaatttaattaattccattgtagttctgcctcttctagcagtctggcataataaaaaataaaggttgttttagtgtgttgcattctttatggctttgccctttggtggtgctctttttgtttcattcataaatcaagcagtgtatcttaagtttccttgaataagatttctgaagttgactattgtcattgaaaattaccttttccattcttcaccatcaatatgcagttgaagcaacccagaattgaagcgccatcaaccagcatggcagctcatgtggttgacgaggatgttgatattgaacgttatgatggaaatgatatcaatgaaactgcaaatacggaaaatgataatggagcggcatataaggtaaagggtgcaccattaatgcttcccccagctttgctacctcgtagcaattacctgcaggttagttcttgtgtgcatattttacttcctttaagcacttgtaacaaacatttgtaagagcactttaacttcatgtgcagtatgaaggcaacgacgagaatgttgatgtggatggttgatgaagaggcaacaggggcacgtatggtttagttaattaatattggcaatttctaactttcttttgataaattctatggccttcatatgcatacatgccatatttgtggtggtgcttaac

SEQ ID NO: 6707 - DNA, 357 bp, Glycine max
tcttcttcttggaaaaggacttgcatcccggaacaagttgaacttgcacttcaccaccagttccaatattcaagccacattcttgccacgccaagttgcggattctatacccttttcatccagcaaggtggaggttgtattcaacaagttttccgtaaaacccgggtcagaggaggcccagatcatgaagaatactctcagtgagtgtgaagagggtggcatcaaaggagaggaaaagtactgtgccacttcgcttgaatccatgattgatttcagcacttccaagcttggaaaaaatgttgaggttgtgtccacggaagtagtggaggacaaggaaacgggattgcagaaatacac

SEQ ID NO: 6708 - DNA, 313 bp, Glycine max
agtatcattaacacacgacatgcaaccgcaagagataaaagattttgatctataatctttctctgtcttgctcatacacagatttattttgctcgaaacattctttcactaactaatagggggagtaaatgaggcattgctccttacatgcaacgtattatttcagctggtacgagatactagtccctaaaacatgtgcattatccttaatggataaagctcttatttcagcaatatttattcattctcaccactcatatggcatatagccagtatgtattcaacttctccagcaagatgctttgatgtaatc

SEQ ID NO: 6709 - DNA, 321 bp, Glycine max
tccccttcagttgggggatttttgacacacagtggttggaattcaacgttggaaagtatgtgtggaggtgttccaatgatttgttggcctttctttgcagagcaacagaccaattgtcggttttgttgcaaggattgggggattgggttggagattgaagatgttgagagggaaaaaatagagagccttgtgagggagttgatggatggggaaaagggtaaagagatgaagaaaaaagctttgcaatggaaggaattggcagaaagtgctgcttttcgctctgttggatcttcatttgctaatttggacaacatggttcgt

SEQ ID NO: 6710 - DNA, 1131 bp, Glycine max
  misc_feature (246)..(252): n is a, c, g, or t
  misc_feature (277)..(278): n is a, c, g, or t
  misc_feature (284)..(285): n is a, c, g, or t
  misc_feature (290)..(292): n is a, c, g, or t
  misc_feature (314)..(319): n is a, c, g, or t
  misc_feature (321)..(321): n is a, c, g, or t
  misc_feature (323)..(323): n is a, c, g, or t
  misc_feature (336)..(336): n is a, c, g, or t
  misc_feature (338)..(340): n is a, c, g, or t
  misc_feature (342)..(342): n is a, c, g, or t
  misc_feature (349)..(351): n is a, c, g, or t
  misc_feature (355)..(359): n is a, c, g, or t
  misc_feature (363)..(366): n is a, c, g, or t
  misc_feature (388)..(396): n is a, c, g, or t
  misc_feature (404)..(409): n is a, c, g, or t
  misc_feature (411)..(411): n is a, c, g, or t
  misc_feature (418)..(420): n is a, c, g, or t
  misc_feature (428)..(437): n is a, c, g, or t
  misc_feature (447)..(449): n is a, c, g, or t
  misc_feature (459)..(460): n is a, c, g, or t
  misc_feature (462)..(467): n is a, c, g, or t
  misc_feature (471)..(472): n is a, c, g, or t
  misc_feature (477)..(477): n is a, c, g, or t
  misc_feature (479)..(481): n is a, c, g, or t
  misc_feature (486)..(486): n is a, c, g, or t
  misc_feature (489)..(492): n is a, c, g, or t
  misc_feature (494)..(503): n is a, c, g, or t
  misc_feature (511)..(512): n is a, c, g, or t
  misc_feature (514)..(518): n is a, c, g, or t
  misc_feature (523)..(524): n is a, c, g, or t
  misc_feature (530)..(531): n is a, c, g, or t
  misc_feature (533)..(535): n is a, c, g, or t
  misc_feature (540)..(543): n is a, c, g, or t
  misc_feature (560)..(562): n is a, c, g, or t
  misc_feature (575)..(586): n is a, c, g, or t
  misc_feature (591)..(591): n is a, c, g, or t
  misc_feature (598)..(601): n is a, c, g, or t
  misc_feature (603)..(603): n is a, c, g, or t
  misc_feature (605)..(611): n is a, c, g, or t
  misc_feature (613)..(615): n is a, c, g, or t
  misc_feature (617)..(629): n is a, c, g, or t
  misc_feature (631)..(638): n is a, c, g, or t
  misc_feature (640)..(640): n is a, c, g, or t
  misc_feature (645)..(652): n is a, c, g, or t
  misc_feature (654)..(657): n is a, c, g, or t
  misc_feature (659)..(659): n is a, c, g, or t
  misc_feature (678)..(679): n is a, c, g, or t
  misc_feature (686)..(690): n is a, c, g, or t
  misc_feature (694)..(706): n is a, c, g, or t
  misc_feature (709)..(712): n is a, c, g, or t
  misc_feature (715)..(716): n is a, c, g, or t
  misc_feature (726)..(738): n is a, c, g, or t
  misc_feature (741)..(743): n is a, c, g, or t
  misc_feature (745)..(745): n is a, c, g, or t
  misc_feature (748)..(748): n is a, c, g, or t
  misc_feature (750)..(752): n is a, c, g, or t
  misc_feature (754)..(756): n is a, c, g, or t
  misc_feature (760)..(761): n is a, c, g, or t
  misc_feature (765)..(765): n is a, c, g, or t
  misc_feature (773)..(778): n is a, c, g, or t
  misc_feature (780)..(788): n is a, c, g, or t
  misc_feature (790)..(793): n is a, c, g, or t
  misc_feature (797)..(799): n is a, c, g, or t
  misc_feature (807)..(811): n is a, c, g, or t
  misc_feature (818)..(820): n is a, c, g, or t
  misc_feature (827)..(830): n is a, c, g, or t
  misc_feature (832)..(843): n is a, c, g, or t
  misc_feature (846)..(879): n is a, c, g, or t
  misc_feature (882)..(882): n is a, c, g, or t
  misc_feature (884)..(887): n is a, c, g, or t
  misc_feature (890)..(899): n is a, c, g, or t
  misc_feature (905)..(909): n is a, c, g, or t
  misc_feature (913)..(924): n is a, c, g, or t
  misc_feature (926)..(935): n is a, c, g, or t
  misc_feature (937)..(950): n is a, c, g, or t
  misc_feature (952)..(952): n is a, c, g, or t
  misc_feature (965)..(973): n is a, c, g, or t
  misc_feature (984)..(986): n is a, c, g, or t
  misc_feature (988)..(991): n is a, c, g, or t
  misc_feature (995)..(997): n is a, c, g, or t
  misc_feature (999)..(999): n is a, c, g, or t
  misc_feature (1003)..(1011): n is a, c, g, or t
  misc_feature (1018)..(1022): n is a, c, g, or t
  misc_feature (1028)..(1028): n is a, c, g, or t
  misc_feature (1030)..(1031): n is a, c, g, or t
  misc_feature (1033)..(1033): n is a, c, g, or t
  misc_feature (1035)..(1037): n is a, c, g, or t
  misc_feature (1042)..(1051): n is a, c, g, or t
  misc_feature (1060)..(1064): n is a, c, g, or t
  misc_feature (1069)..(1077): n is a, c, g, or t
  misc_feature (1079)..(1086): n is a, c, g, or t
  misc_feature (1095)..(1103): n is a, c, g, or t
  misc_feature (1105)..(1112): n is a, c, g, or t
  misc_feature (1114)..(1128): n is a, c, g, or t
cgctcttctttccttcttcctaccacccatctctccctcccccaaaacgcagcgttttcccttcgcacctctctccgcacttccaccttcgcactcgcgccacacgaagctcccgttctgggcaaacccgataacaacaacaactcttcaccctatcttcccaaaatcgataagaccggccgcttctgcagccccagagccgccagagaactcgcactgtaagttcttttattttatcggttagtnnnnnnnttttgttgttaccttagtggggaanntcaagnncgaannnactaatattactattactatannnnnnangnctggaagttcaancnnncnatctttnnnctcnnnnncctnnnnaccttaaaaaaaaccctttccnnnnnnnnnattcaacnnnnnngnttttttnnntggaaaannnnnnnnnnggaggttttnnnttggaaaatnnannnnnnattnncagtntnnnaaacncannnnannnnnnnnnnttggggannannnnnacccnnaaaagnntnnnaaaannnncccccaccacttttttnnncccccttttcctnnnnnnnnnnnnaaaanaaaattnnnntntnnnnnnncnnncnnnnnnnnnnnnnannnnnnnntntaaannnnnnnntnnnncnctcctcttttccctttttnnatctctnnnnnaccnnnnnnnnnnnnnttnnnnagnngaactctttnnnnnnnnnnnnntgnnncnagngnnntnnnaaanntccnctggactnnnnnntnnnnnnnnncnnnncacnnnatccccannnnncttcttnnnttttttnnnntnnnnnnnnnnnnttnnnnnnnnnnnnnnnnnnnnnnnnnnnnnnnnnnaantnnnnaannnnnnnnnncttcannnnntttnnnnnnnnnnnnannnnnnnnnntnnnnnnnnnnnnnncnattattttttttnnnnnnnnnttttttccccnnnannnngctnnnancttnnnnnnnnnttttttnnnnnctttcntnntntnnnttccnnnnnnnnnntaaaaaaannnnnttatnnnnnnnnncnnnnnnnnaacacaaannnnnnnnnannnnnnnncnnnnnnnnnnnnnnncaa

SEQ ID NO: 6711 - DNA, 351 bp, Glycine max
atttcctctaaaattcgagtcctcttggctaatccttgtattactaaggattttagaagacagcagttctacggccactggaattttcttttctgggacttttggctcagtctcagctgtattgttcttttggaaacatttataaaaaaaagagagagagagagaaaaaagggagggggctgtattcagcgggttttcatcatctgccatggctcattacttccatgatcttgaatatgcttgtacgtcaccatgggcagttttaaagaggcagctatatttatatttctgttccttaaagtagtagtagttaaggtcagataaaatgtcttagaaagctgcattgtaggg

SEQ ID NO: 6712 - DNA, 294 bp, Glycine max
  misc_feature (64)..(64): n is a, c, g, or t
atgcatttatgctctttcttttgtggtggagatagcaaattcaagttacaatgcatgtcattantgactgcatttatcattatatcccaggaagttcctgatggaaagaaagaaagccaaggagggccttggcaatttattggactgttgcctttatttgacccacctagacatgatagcgctgagacaatacgaagggcattaaatcttggagtaaatgttaaaatgataacaggtatttgtcctctgcatgatattatatattaaacagaagaaagtaatacatccatgttt

SEQ ID NO: 6713 - DNA, 383 bp, Glycine max
tttaatatcaatgaacttctatgaaatgatttcaccggttcagccaattgtttggatcgtgagaaatcattaaaaaatagggatctacttatcaaaagatttccctcaacaatagaacttactctggcattattgaacgcgatatgatcttgattaattttttgctcccggttctccgtacgatgatgcttgtgagtgaaatcagcatctatgtcattttagaaatattaaatgtgcttattttcatatatatagggagcgtaaataatgagatgtggtggaaataatgttcgaatgttgactgtgactataattatttagatgattaagatttactcttttcctatgtataatataggggagaatcaaatgaccctagtgta

SEQ ID NO: 6714 - DNA, 1138 bp, Glycine max
  misc_feature (973)..(975): n is a, c, g, or t
  misc_feature (991)..(992): n is a, c, g, or t
  misc_feature (1008)..(1010): n is a, c, g, or t
  misc_feature (1129)..(1132): n is a, c, g, or t
cgagagccagccttcgtataaatgtttgtcaacttgtttaattttcccctatcatttgctctggaattttggcttgtctttgagtgcatcaaggtcagcatagtactgtgtgatccaccttttgatgatcttgacctctttctttcgttgttcgaccaaccatcctggatcgctttgatttgcccgcagaagatccaggcaatgagaacctaaaagtttcgtgttcatcagccatgctaatagcaatatgttattatttgaatgtcttgatagaaaatggtgaaaaataataggttcgccttaaatatgatataagaatgactaaaccattttgattataactttattttatattcataaattgttaatgaaaatgcttcacatttagatgaattttccttttccaaacttcaaagtatttgttcgcattaaaagttctttccaaactacgacagggttttaattaattatcacattgaaatttctactagtttaaaatagttaagtacgattttatttttttttgtacaagaataatccatcaattccttttcatatataaaagttcttgaatgtcaatcgcatcattagctagtttaccaagaatgtttcatttgcaattaaaccaaccacacttgtctattgaaaattattattgtgctaacactactaaaattttcagcattacattaggatttccctacagaaaaaatccttagaaaattccttcgtgataatcaatacttgtgatttttaaaatccgattgttcattaaataaactctgtcttctaatgtttttcattttatttttaattatttctgtttttttaattaaattatgctcgaaactgtgcatagccgtatcacattatatatagacaatagtgcctcgagattctaaaataaatcgacaattaaaatatataaagaaactaccaaggagctggcataccattaactgtatgaacggcnnncaatcgctgtcgtgannatgttatcacagaacnnntgaaatatagacgattcatacaaagcttattttaaaatattgtcttaaaacaattactcaaaaaattctataatattaagatacgagtattagcttttgtattttacgttgcttccccnnnngagtgt

SEQ ID NO: 6715 - DNA, 589 bp, Glycine max
aactgaccaaatactaaccaaggcaactcatctgaacccccaaaatggaaagaacaggggagaggaacgataaagcctgaaagaaaactgacaagacgtacagaagaaggtatgtagaagatattttccagatcgtcaatttactttcgttttttaaaaaaattttggttggggttgctcataaatgtatgatatggtttgtaatttgaatagtcactgtcgttatttctgcaagcgtagttttaatgtatcaaaagttttcctttctagcatctatgccatcagttgtgtggctgggctttgtatatcttaaaaaaaggaacatcctctcttacctctcattggtttgctcaagtctcatggaaagattgtaatggtggatgcaccagagaggcctctagaactaccagtctttcctttacttgctggtaagcatgtgaaaaatatttccctttataggatgcagagcacatgaaagcatatgtgatgattcatatataagaatagtttagtgcaaaacttaagtagattgatgccaattaacttaggtactatttaacataattggcaaggagaaagatagttgctg

SEQ ID NO: 6716 - DNA, 1130 bp, Glycine max
gaagctcacaatgacaaaatctgggcacgctttgctgttgaggtagtaatactccagacagggacatatcttatcataacttaatacatagggaatgaattactcaagttataagtctcagtatctgacttatgttgccttcaacacctaagcattttcttggcacagagagaaattgtgactatagcctataaagtcctgtacctgaagttgtctctgcattgggtagatatagtgatgtgtgtcctgcaggcaaattagtgtgtaggaattttttttcactggtataggaatctaggataactgaagtcataggtctccacattctcggtatacatattcagtgtttgtttggttcagtttacttcgaggaaatgatcatttatttttggcagcttcttaagagagctattgaaagtaagattatttcttttggagaaataagatattccaaaagcaagcatttaagattctgttttcagtacttaaaacaagttttattttattttttataaatgctgaccaagaatgtatcaaatattagagacaaatcattgtgacaaaccaaacatcgttgccccaaagtatcaatactatgtagtgactgagttcatgaaacgaagccgagaaggtctccatattaaaaaagaactactactgcaggttgccttgccgatgtttatgctatttgagacttggcttaaaaaaaagccttacttaaaggataataatatttggctcttcatcttcatcctgttaaccgttttaaaattaaattacagcatgagacatttcatgctttcttttctgttttttgattttgatgttatctgcattttaaaagcaaaagtttgatgcatgatgttaaggaatccaatgtagttattaatttaatatgcaggcaaacagggatataacaaggatggaaatatttatgtcacttgtttgtcttttggagcaaacggtgaagggcaacacatcttcatccaatgcaattgataacatggtgtatcactctttcccacaggctacgcagacaacagaaaggtctagtagtttgcagtgaacccacctgttacatgttttcttattaggatgtgttgagagcaagtccggtatgcgcttgcgat

SEQ ID NO: 6717 - DNA, 342 bp, Glycine max
accgagtatgccaatgaagataatacgaaactggaagcaaaagttgatgaatcagggttgagcttggtatccatgaaagcaccaaaaggggtgtctgaaactgataaaaattcatgtgtgattgatataaagtgcagcagccgcaaaaaaatttacaagagttctgaaggtgaaagaatttgtaggatttgccatctgacttctgggcagtcatcggatgcaacaactgttggcacttctgatagtgctacaagcgcagatttgattcagcttggttgtgcgtgtaaaggcaagccaggcattgcacacgttcattgtgctctggcgtggttcaagcttaag

SEQ ID NO: 6718 - DNA, 682 bp, Glycine max
  misc_feature (582)..(598): n is a, c, g, or t
  misc_feature (600)..(602): n is a, c, g, or t
  misc_feature (604)..(604): n is a, c, g, or t
  misc_feature (610)..(632): n is a, c, g, or t
  misc_feature (635)..(646): n is a, c, g, or t
  misc_feature (656)..(656): n is a, c, g, or t
  misc_feature (674)..(679): n is a, c, g, or t
ggcgctggtggcttcatcgcctcttggatggtcaaactcctcttggagaaaggctacactgtccgaggaaccctcagaaacccaggcatgcctatctatttaagttatatgacgtgtagcggggacatgcatgcatgaattttattattttggtttggttttcagatgatcccaagaacgggcacttaaaagagtttgaaggagcttcccagagactaactctgcataaggttgacctccttcatcttgactccgttagatctgttattaacggctgtcatggtgtctttcacactgcttctcccgtcaccgataaccccgtgagtctctctttattttctatgaaaaaagcatatatagtagaatatagtttgcaaatttgatttagttaaatggatttgttttaatgacgcaggaagaaatggtggagcctgcggtgaatggagctaagaatgtgatcatagcagctgcagaggctaaagttagacgcgtggtgttcacctcatccattggtgccgtttacatggaccccaaaaggagcatcgatttggtggctgacgagtcctgttggagtgctttaannnnnnnnnnnnnnnnntnnncncccctnnnnnnnnnnnnnnnnnnnnnnnttnnnnnnnnnnnnttttcccttncctccccttcccctatcnnnnnnccc

SEQ ID NO: 6719 - DNA, 392 bp, Glycine max
tgcccgaagaattcgagtccgtgtcggccacgctcatccgggaaatcctgccggtggtgaagttccgggagctggtggaccccccggagacgtgcgcggtgtgtctgagcgagttcgaggaaaacgatgagatcagacagctggcgaattgtcgccacatattccaccgaggatgtttggaccgttggatggggtacgatcagagaacatgccctctctgcagaatgccctttatacccgacgaaatgcaaggtgcttttattgagagactctgggctgcctctggtatcgctgaatatccgcatgttgctcctttctagtatcattcatatttccttattttacttttttggggaagggatatcaaaagccataaccagaagaggttctta

SEQ ID NO: 6720 - DNA, 408 bp, Glycine max
ggctttggaagagggcagggtggaggaatgcattgatgagaggctccaagggaagttcccagcagaagaagctattcctgtgatgaagttaggcttaatatgtacttctcaggtgccatctaacaggcctgacatgggagaggtagttaacatattggagctgataagatgtccctctgaaggacaagaagaattggcatgaattaacttgcgattttctttattaggaggatagacaatgggttgtccggggaagaagaatccggttttatttattataagagagagaggaattattttgttgcaaaatgtttactttttcattgtattttttcccttgttaattagtctctagttgtttgttttaagatttctcgtgttatgctactacacctaggatgccggatt

SEQ ID NO: 6721 - DNA, 400 bp, Glycine max
cctatttcaagcagtactggatgaaaattgtgtgaatcaaatgaactacttgaaatgtgtagtcaaagaaactttgagattacatccaccccttcctcttttgattgctcgagagacatcatcaagtgtaaaactaagagggtacgatattcccgcaaaaacaatggtatttatcaatgcatgggcgatccagagggatcctgaattatgggatgatcctgaagaatttattcccgaaagatttgaaactagccaagttgatcttaatggacaagattttcaattaattccgttcggtattgggagaaggggatgccctgcaatgtcatttggacttgcttcaactgagtatgttcttgctaatcttttgtattggttcaattggaatatgtccgagtct

SEQ ID NO: 6722 - DNA, 349 bp, Glycine max
aagaacaaacaaaatgagcatcggaacaacactttcaacaacaccacaccactctttccactccaacacccgaaccagtttactcaacaccgtttccccaatccaattcctctccttccgcaatcacactcacaatctcagagtcctctgtttctcttcgaatccgtcgcagcagctgccgccggttgtggtggttggctccgcgaacgccgacatctacgtggagatcgaccgtctcccacgcgaaggcgagactctcgcggcgaagtccggccagaccctcgccggcggcaagggcgccaaccaggccacgtgctccgccatgctctcctacccgacctacttcgta

SEQ ID NO: 6723 - DNA, 430 bp, Glycine max
ctctctccctctctttctttgtgtacgtgcatgtttgtctacaaagtgcaaactacattcttggtttctctaattgatatacttgtgcttcatgcagcctctttttgtaatagttccatgagtaccggaagggaccttacttcaaagttgatatgaaatctccctagcttgttggatagcagcatggtatttgatgtcagattttctgttcagaaatttcttgagtgataatgtttgtctcattttaagaaatccttgtcttctttagcccccacccctcctcttaatttatcgagatattttggacataaaagtccccagcatatcagaatgaatattggacatttcagttctaagcagatttgacatttgtagtagtatttatgttttctgtttatgttttctgattgccccctctttcttgtatgaa

SEQ ID NO: 6724 - DNA, 400 bp, Glycine max
gacagctgctgctcgcgctgtgtcaccttcctaataaccataggcctcacagcgctcttcctatggctgagtctccgcgttgacgaaccaaaatgctacctcgactacatttacgttcctgccctcaacaaaaccctaaattccaattccactcacaacaaaaacaccacaatactcttcgctctcaagctcaccaacgggaacaaggacaaaggcatccaatacgacgacgttctcctctccttcagagtcttcgagagcgtcaacctcacgcgcccactcggcaacgccaccgtgcaaaggttctaccagggccaccagaagaaggccaccaagcacggaaacttcagcggcggcggcggaaacctcaccgcggcggtggctgggagaatgtggtacc

SEQ ID NO: 6725 - DNA, 771 bp, Glycine max
  misc_feature (763)..(763): n is a, c, g, or t
aggtgaggtaagtcttatctttatgcaatcaatcaatcaattaagccagctcgttttgtttttcgatccagaaaaatgaaacacatcttctacttgttagatcttgtttgtttttattctctctacagctctagcggcagatattattattgttatcaattaggcttaggcttagaagttagaacaacttacattaactaactttttcccctttgcaatttgtaggtttctttcttctgttgaaatggtctttagtaattatagttctgccaatgaatctcattgtttaattctgattatacctttcccgaaatgcaattagcgtcaaatggtgacaaggaagaatgttcagaaagcgaacccatcttgaatcatcaccatcttcatttgccaccacccggagaatcctccttttcctgtgaaattattcctatttctgctgctgcttccggcgatgatgatttacaaaacggcgatgatgatttacaaaacgttcgggttgatgagacttgtcatctcgtaaatgcagatcagccacaatgccgaatatgcctcgatattggaggtttattcacttattcatatccattcccttagatgatttcacaacccaagatattcagagacttacagccaacttgcatctcatatgtattttaaactctttactaacctttttcaggagaagatttaattgctccatgccattgcaaaggtacgcaaaagtacgtccacagatcatgtctcgataattggagatccncccaagga

SEQ ID NO: 6726 - DNA, 655 bp, Glycine max
  misc_feature (401)..(401): n is a, c, g, or t
  misc_feature (405)..(406): n is a, c, g, or t
  misc_feature (562)..(563): n is a, c, g, or t
  misc_feature (576)..(576): n is a, c, g, or t
gcgccgcttcaacgtctacgtcccggacctcctcttcttcggagactcccacacgacccgccccgaccgctctgaagccttccaggcccagtgcgtcgcggccctcctccaggcccacggactccagagaaccagcgttgtgggtataagctacggcggcttcgtggcgtacagtctcgcggcgcagttcccggagcgcgtggagaaggtggtgctatgctgcgccggggtgtgcttggaagataaagacttggacgaagggatgttccaggtgaagactgtggatgaggctgcggatattttgctgccgcagacgccggaaaagttgaggcagctcgtgcagctcgcgtttgccaagcctgtcaaaaccatgcccacttgctttctcaatgattacaaancatnngaatttcctaagctttgccaaaaggtctcttgaaaacatccacacattagataagaatgatcatcctatctgggatatgctaggtatgctgtcaaataattggtcctaagctggggagtaaaatatattgacctgtagcttgaatttatttgcagnngctttctataaancagaagtttgatagaagcctacaagaactgcacatatgtgatattaagggacctaaacatggcaacttttgggctttct

SEQ ID NO: 6727 - DNA, 384 bp, Glycine max
tgtaatcctgtgaatgttcccaaccttagaacatcttggattgccagaacaccaaccacctggtgtgaatagttgttcattttccctatgtagtagttttttatcaatcacatccaagactggatcattgtgcttgaatttccgagcaaacgcggcgttgcttgcaatcatcttggttgtgtcattgatgttaaggacatgagggtgctgttttggagggttgtcccatgaaatataatgcaagtcactgtttacaacagttttggctagttctggctcattgcatgcaactgtttgaaagtagccctcaggggaggagatgaaattagtgtagtacataagaagggtccttgggagattgtcccaaccccacacaacatattc

SEQ ID NO: 6728 - DNA, 462 bp, Glycine max
attgtcatggaaaatgttaaaaatcctatcatcattgaccaagagtatgattgcgaaccagcaaactgccaaaagaaggtttacttcatttctttctctctttttaatccagcaaaaattgtactatactgaagttatcacacacaataaccctgctaataagaccattcatttatttccatgcagccttcacttgtaaagataaaagatgttgttttttcaaacataaggggaaccacaatttcaccaattgcagtggatttaaggtgtagcaagcagttcccatgccaagatgttaaacttaagaacataaacctgaaccttggacccaagccgtcgggttccagatgtaccaatattaaaccagtctatgggggtgttcaaagaccagcagcttgcctataagtacttgaaatttcaagcattttgcagctctggcaataaggagggaagggcaagtaa

SEQ ID NO: 6729 - DNA, 415 bp, Glycine max
gtctgttgttccaggatctgattgatcaagaagggctgaaacagaaccatcaccaaggcgtactctcaggaacttagaagttttcttgcgttgcttgttcccaccacccccatcgtctttactttgattagataaactgtcgtttgatgtttcagtcttcccaccaagcttcatcgtaggttgactaccagaattcatatcaatccgctgctcgatttttaatttgcctccgtcactgcggtaatcaccccttgatagcacctccgctttctcttctgaagatttataatttgcctgtagctgatgtacagtgcttaaaaagttatttgctaatttctctctggagttactccccctactatctacagacttacctttacctttcttgtttacgttactgtctttggaatgggtg

SEQ ID NO: 6730 - DNA, 395 bp, Glycine max
tcttttctgcaaacgaaaatggcgcagaagaagaaagctagggtttccgacgacgaggaaatggaagtgcaacatgatcaaaccagcctttaccaggtaccctaaaaaattcatgctttttctttcgctttcctttgataatggattatttcactattcaaattcaattcgcgtgttgttactgtgatatattatgactttgtttgacggtggttgagtggttgtaggttcttggcgtggagagaacggcgtctcagcaggaaataaagaaggcgtactacaagttggcgttgcggcttcaccccgataagaaccctggtgatgatgaggtcattcttctagccgaatatgccatcatttttttttattgacaaatgttaattgctagttttttt

SEQ ID NO: 6731 - DNA, 315 bp, Glycine max
attgagtaatagagaatatgataaaatattattagttttatgttatctcagagacttagacagttagacataatgcatatggtttaatctggttatataatagtatgaatgataatactagtattagtaatatgtataattgaggatactttcctatcctaatatgattatgagattcagttatagtgtaagagaatattcttctctttatattttcttttactgtattcttctcttgtcagttataactgtcactgtcagacagttacaactgactcctcctatcttagctggtcctgatagtatatatagggt

SEQ ID NO: 6732 - DNA, 363 bp, Glycine max
atgggcctcaccccaaacccctctatcccttctcacaattgcactcctttccctaatccctctcttcatcttcttcttcttcaaccgctccaaaggcaaacaacccaaagaaccaccaaccattcccggcgcatggcccatcctcggccacctccccctcctagcccgctccccaaccacccaccacctcctcggcgccatcgccgacgaccacggccccctcttcaccatcaagctaggcacagtaaaagccctagtcgtcagcaactgggaaaccgctaaagaatgcttcaccacaaacgatgtcgccgtttcttatcgcccctatgtggtcgccaccgaacatatgacctacaacgtaaa

SEQ ID NO: 6733 - DNA, 452 bp, Glycine max
taaaaccacaggtgtttatgttgtttttgtttatttaaattttagcaagttacttttgcctgtacacaagttttacttatttttttccttacaggttctgagaaaatggaaaatgaagacgatgattttatcaagaccaaaatggaaagtaggtcagatgtgggttcttcaactccacaagatcctcatggtagtgatgatgttagttcaagtcctgctaatgagacaaataatgaatgcagcgatgcttctcaagaactaaataaccaagttttggttgatgggattatctgttccaaatctcattctgaggaaatgatgtctgatccagtttcagataaatgtatttctccttctagaactagtcttagtgaactagaaatgaagaataaagtagcggctgctcctcctgttgatagattagattcttctaccaaatgtcaatccatttc

SEQ ID NO: 6734 - DNA, 703 bp, Glycine max
aatccctctaatttccatcatcgcgcttcctttctgtctttttcccccacaccccttattattatcatcactgcccccgtgcgtgccttgctataaaaccccccaaacagattcattcacatttaaatgctattggacgacacgctgtttctgcgctcaaatgctcggatctctcgccggtacaaaacaccttctctctctctctctctctctctctctctcttcttcgtcaacgcgttcttcgcttttagtcttttcgtcttggcggcaatttgaattccgttactgttctctcgatcttctttcttcgtcaactccttcttctcttttactcttcgtgttggcggcaatttgaattccgttactgctctctcgaaatttttctttatatccctcccctttcccctaccctatcccctaatcccccccctttacccccccctttcccttcttttccccctcccccccccccccctctcttttttacattctttttatccttccctcctcccctcaatctcccccctctttccccactcccctacccaccccatctttcctccacttttccttttatctacccccctccccccccctccttcttctctccttcttcccccccctacccctctttccccctttctcctatccctcagcttcccccccttttttccccccttcatacacaccccccgcctttcat

SEQ ID NO: 6735 - DNA, 1425 bp, Glycine max
  misc_feature (700)..(704): n is a, c, g, or t
  misc_feature (709)..(710): n is a, c, g, or t
  misc_feature (712)..(717): n is a, c, g, or t
  misc_feature (736)..(737): n is a, c, g, or t
  misc_feature (749)..(751): n is a, c, g, or t
  misc_feature (758)..(761): n is a, c, g, or t
  misc_feature (763)..(780): n is a, c, g, or t
  misc_feature (783)..(789): n is a, c, g, or t
  misc_feature (792)..(792): n is a, c, g, or t
  misc_feature (796)..(796): n is a, c, g, or t
  misc_feature (801)..(803): n is a, c, g, or t
  misc_feature (811)..(813): n is a, c, g, or t
  misc_feature (815)..(831): n is a, c, g, or t
  misc_feature (837)..(838): n is a, c, g, or t
  misc_feature (842)..(847): n is a, c, g, or t
  misc_feature (849)..(849): n is a, c, g, or t
  misc_feature (852)..(868): n is a, c, g, or t
  misc_feature (878)..(880): n is a, c, g, or t
  misc_feature (882)..(889): n is a, c, g, or t
  misc_feature (891)..(899): n is a, c, g, or t
  misc_feature (901)..(906): n is a, c, g, or t
  misc_feature (908)..(911): n is a, c, g, or t
  misc_feature (917)..(917): n is a, c, g, or t
  misc_feature (919)..(924): n is a, c, g, or t
  misc_feature (926)..(926): n is a, c, g, or t
  misc_feature (929)..(930): n is a, c, g, or t
  misc_feature (932)..(934): n is a, c, g, or t
  misc_feature (936)..(936): n is a, c, g, or t
  misc_feature (943)..(955): n is a, c, g, or t
  misc_feature (957)..(967): n is a, c, g, or t
  misc_feature (980)..(982): n is a, c, g, or t
  misc_feature (984)..(1002): n is a, c, g, or t
  misc_feature (1005)..(1008): n is a, c, g, or t
  misc_feature (1010)..(1012): n is a, c, g, or t
  misc_feature (1015)..(1021): n is a, c, g, or t
  misc_feature (1025)..(1030): n is a, c, g, or t
  misc_feature (1032)..(1033): n is a, c, g, or t
  misc_feature (1035)..(1048): n is a, c, g, or t
  misc_feature (1050)..(1052): n is a, c, g, or t
  misc_feature (1058)..(1074): n is a, c, g, or t
  misc_feature (1077)..(1077): n is a, c, g, or t
  misc_feature (1081)..(1089): n is a, c, g, or t
  misc_feature (1092)..(1099): n is a, c, g, or t
  misc_feature (1101)..(1102): n is a, c, g, or t
  misc_feature (1105)..(1110): n is a, c, g, or t
  misc_feature (1112)..(1114): n is a, c, g, or t
  misc_feature (1116)..(1116): n is a, c, g, or t
  misc_feature (1118)..(1124): n is a, c, g, or t
  misc_feature (1128)..(1155): n is a, c, g, or t
  misc_feature (1159)..(1172): n is a, c, g, or t
  misc_feature (1174)..(1178): n is a, c, g, or t
  misc_feature (1180)..(1183): n is a, c, g, or t
  misc_feature (1188)..(1198): n is a, c, g, or t
  misc_feature (1200)..(1204): n is a, c, g, or t
  misc_feature (1207)..(1216): n is a, c, g, or t
  misc_feature (1218)..(1226): n is a, c, g, or t
  misc_feature (1232)..(1232): n is a, c, g, or t
  misc_feature (1234)..(1237): n is a, c, g, or t
  misc_feature (1239)..(1255): n is a, c, g, or t
  misc_feature (1259)..(1272): n is a, c, g, or t
  misc_feature (1275)..(1292): n is a, c, g, or t
  misc_feature (1307)..(1314): n is a, c, g, or t
  misc_feature (1316)..(1317): n is a, c, g, or t
  misc_feature (1319)..(1321): n is a, c, g, or t
  misc_feature (1325)..(1331): n is a, c, g, or t
  misc_feature (1333)..(1333): n is a, c, g, or t
  misc_feature (1335)..(1350): n is a, c, g, or t
  misc_feature (1357)..(1361): n is a, c, g, or t
  misc_feature (1363)..(1369): n is a, c, g, or t
  misc_feature (1371)..(1373): n is a, c, g, or t
  misc_feature (1380)..(1386): n is a, c, g, or t
  misc_feature (1389)..(1400): n is a, c, g, or t
  misc_feature (1407)..(1416): n is a, c, g, or t
  misc_feature (1419)..(1421): n is a, c, g, or t
ggagagtgtctgcttgttttgttccgcaaaaactttccaaatgaaatctcatccaataacttctaacctcaatatttatatttataattgtctctctgtctctgatattttaactgggtcttcaagctcatgttaacatcataacctttcctatctttattgcaatatgcccgtaatttactaactacactcaccactttatctttgcttgatttatgcagggatggcgttgaacctgagcttgctgcagttgcaacaggttcgcacattgatgctataccttactctggaaaatatgatggagttattggtgttttaggtgctattgaagccatcagagtcccgaaaaggtttttgatttttcttattattgctgatgtaggacttaattgaatcttcagaatacaattttttttatttgctgtctatcttctgatcatttgctagcaagcttggatgtttcagcaccttaaattactaaaatattttcactgtcctggtgtcccgcattagtttttgcacaagtaatttcatataaggaatcggggatgtaaatatagcatcttagccaattgaaaatgaagacatttgtctctctcagtgcaataatttcaaacattgtggccttagagacagtgaatcaagacaaagctaacctatattttctaatcccaataagttattaaaatctatataactnnnnntccannannnnnntaagcttgacaatttgatnnttccactaaaannnacatcannnnannnnnnnnnnnnnnnnnntcnnnnnnntcnccanctatnnnccctcctnnnannnnnnnnnnnnnnnnncttacnnactnnnnnngncannnnnnnnnnnnnnnnnatactatccnnnannnnnnnnannnnnnnnnannnnnntnnnnttcctncnnnnnntntcnntnnncntcccccnnnnnnnnnnnnntnnnnnnnnnnncaccacaacaacnnnannnnnnnnnnnnnnnnnnncannnnannncannnnnnntccnnnnnntnncnnnnnnnnnnnnnncnnncctccnnnnnnnnnnnnnnnnnccnatcnnnnnnnnnccnnnnnnnncnnctnnnnnnannncncnnnnnnnacannnnnnnnnnnnnnnnnnnnnnnnnnnnctcnnnnnnnnnnnnnntnnnnntnnnnctttnnnnnnnnnnncnnnnnacnnnnnnnnnntnnnnnnnnnttctanannnncnnnnnnnnnnnnnnnnncttnnnnnnnnnnnnnntcnnnnnnnnnnnnnnnnnnccttccaatttattnnnnnnnntnnannnaacnnnnnnntnannnnnnnnnnnnnnnntctatannnnnannnnnnncnnnatacttnnnnnnntcnnnnnnnnnnnnttcctannnnnnnnnnaannnctta

SEQ ID NO: 6736 - DNA, 1502 bp, Glycine max
tctgccacttgaaattctgaacgagcatctttttacatgtttgtggctttagttttatattatagggatatggatttggcatgtctaaagtaaggtaaaagtaaaagtaatggtatatccacccatgatttgaattgaataccctcataaacttagtccactttaaatcgagtggatgcaccttagtcagtttacacactttcttacttttgagtagtcaaatccatatcatacattgcatttgtcactttagtgttgactgttgagatgcttcaattgattattatcttattatcattattggcagttaaattttttagtttttgatagaaaaaataacttcacttgttaaagttaatgctactgagtgttgatatgttttcattttatatcactgttctatctgtatcattcccaccattctttataattaaactaaatcagtacgttcctaatttggaggcagtggatgctatgcaaatatatcccaaagagtatacaatctggagagaagatccagccaattttctcatgaatggtagatatccggtacgagatctctggaaagctgcaaaagattgttggaaggagatgttgttgtcacctgtaagatttctttgtagttgctactttgtttcccaattaatgttttcttccaacaagatttatcttattattcagggagaaagctttctggttgtgactcacaaatccatattgagggcattaacttgcactgctttaggcctgggcccagagaggtaagaattgctggttatgcaattaaatatttaaactgatattgggcctacttaatgaaaaaatgtactttggttttaattgagtctaaacctgcaccatcagtgtaaaagttttacatttgcaaccgattagaaataatcatttgtacaataattattataaaagtcaaggtaataattgttgacagtgtaaacaacttttacattgtgagtgcatgaattatttattcattttaatattactggctattcccctagttaaaagaaatgccaagcgtttagctttgatagatacttccatatcttttttaggatggataacttgatagtattgacaattttgttatggtattgctgttgattgtaatgcatgttgcaagtcaaaagatgaacttatcaggtgttgtttccactcctgcatctaatgtgtggatttcaacagccctctttccattttgttaattattgtctcagttaatagtctggaatgggctacagaagttaatgattgattgaatggttgaaacttatcacttctttttgactactttaaatttaaattagcgtgcttgaaattaatgtcaataagacctcttgctgccatatctagcagttgacattttgacattggtcataatattcaggtttcgttctattgatattaacaatggtgggatatgtgtgttcaacttcaatgtcagaggagaagcaatgcttgaggctttaaatatgacggctcat

SEQ ID NO: 6737 - DNA, 364 bp, Glycine max
atggaacattttccatgatgatggatccattgctattggatcttgcttcacttctcagtggttgcaacttagtggttgccactcctctctcgaactgcaatgccaagcttccttctactgggggtctcatttcaaccctaaactttgctgggatcactagtgttggcactcaaaccatggctaacatcattccatcagggtttcatttcttgccatccatttaagcattacaagatggaaaagatatatttatagcatgcatgacaaaattattatgaaataaagtcatgcaatgtcttgtcttattattgtactactttaaattgccacgcctgctatatctaaattaattggcgtttggata

SEQ ID NO: 6738 - DNA, 348 bp, Glycine max
gttcctctctattcgggaagcaatcgaagcctcaaacccctcttgaagccatccacaatgcgacacgtcgttccaattccaatcccaaaacagccaacgaccttccttctgtctcctcctcttccagggattggctcaattccctccgccctcccaaaacccctactcctcctcctccgctgccgccgccagatcacgacgacggcccaatggtgggaccgccgccgcctccgcccacagctgccgacgaaaaagaagacgacgacgacgccgagatgattggcccgcccccgcctccgccgatcgcgtcggagtccgaagacgattcggatcaagatgaggtaggaa

SEQ ID NO: 6739 - DNA, 379 bp, Glycine max
catacgtcagtactttgaaaaagtgggtacaagcatcttggaagaagagccacctgagtctttgaaaacccgttatggtggttgattgatgtcatcagagagtcgatactcgatacagttctcaattcgccatttctgaatttggctgttccaattatttcttattatagcatctgccatctggattgaagattgaagagtcactgtggcgaacgttgaatggcggtgacaagtagtagttgttagaaaaccaacaaagcagatttctattttctaggatgaagatatattaataaattaatagggccagcaaatgtttagaataatatttatatattgtgaataaattgctggtaacagtgcccgttcaacaaataaa

SEQ ID NO: 6740 - DNA, 665 bp, Glycine max
  misc_feature (491)..(493): n is a, c, g, or t
  misc_feature (561)..(574): n is a, c, g, or t
  misc_feature (578)..(585): n is a, c, g, or t
  misc_feature (596)..(597): n is a, c, g, or t
  misc_feature (600)..(605): n is a, c, g, or t
  misc_feature (607)..(623): n is a, c, g, or t
  misc_feature (626)..(628): n is a, c, g, or t
  misc_feature (633)..(643): n is a, c, g, or t
  misc_feature (645)..(647): n is a, c, g, or t
  misc_feature (649)..(655): n is a, c, g, or t
  misc_feature (658)..(659): n is a, c, g, or t
acatcacaatcccttccataacctcaggtcttacaacaactatgtcacaaacaacaacaacaacaacaatagctacaaccatgtataacaacaatcaagttacttcttcttcagatgaaaccaacaacatcaaagagaacaagcactatagaggggttagaagaaggccatggggcaagtatgctgcagaaatccgtgaccctaatagaaaaggctcaagggtgtggcttggaacctttgacacagccatagaagctgccaaggcttatgacaaagctgctttcaagatgagagggagcaaagccatattgaatttccctttggagattggagagtcagaggaatcagtctcaagctgcatcaaggttggtgtgaagagggaaagagaggaagctaaggcacgaccaataacaactccttaatacagacagcattgtccaaccaaacccaatggaggaaaaaaactacttaccaccccatctagaagaagnnntagattgaagcacagattcaagatcatcgttcctcgtgcacacaaaaatggggccctcgaaattgagnnnnnnnnnnnnnncccnnnnnnnnaccctaacctnncgnnnnnngnnnnnnnnnnnnnnnnngannncaccnnnnnnnnnnngnnncnnnnnnncanncccccc

SEQ ID NO: 6741 - DNA, 670 bp, Glycine max
atcgagagagacccgtggcgctgaggaggaagcgggcgcggcgcgtgagcttcgcggacaacgaaatcacctccgtccacgtcttccgccgcgacgacgacgacgattccacttcctctccctccgaacccccttcttcctccgatccctccatcctagggtttttccgcgacctcgcctccgacagcgacgatgacgaacaaccgaaactcgaagacgaagccgaagccgccgcaaactccttcctccgccctgtcggatccccctcccctggcggcagcatcaccgccgactgtgagctctatttctttcatttctcttctcgagttttgctttctctttccgtagcagttaattattaatgagtaaatgacactaaccacctctgaagttaagcgagactacacaaattttccatagagagaggccgcggtgtaatgtttttcaaacaattaaaggttggttataggtatataaggtggaggtttgtgtaatttcataaaacttcaggggtagttagtgtgatttactctttattaattcaatttcgttgctctcctgatgtacttactgctcagatgatgacgatgatgattttggcggtccggtgtcggcacatttcgtccgaccggatcggctatcggactccggtgttttggaagacatcacg

SEQ ID NO: 6742 - DNA, 472 bp, Glycine max
aactgcgatacactgatgttgggtagttgagcttgacgccagactttccaccaccaaagtcagtgaggatattgcaaacattatctgaagacgacaccaacctcaccgagcatccttttgtatccaattctttgccatagacgtactttttcacagtcaagtcgtactgccccaactcatctgttgtatcactcgtgtaatacacaaccctacttctcttgtccatgcatgttagggacactttaactcctggtagtacaagctatattagttacaagctgaggtaaatgtgaattgaacatgatatgtaggaaaagattacaatggcaatgctacaatacctttcatagggttgccaccatttacccattcgttccagcccttggtgcagtcctggcactgcacttttccacccacgtaaatgactcccgattcatccaaagctgaggaacaacacactatcattgaggca

SEQ ID NO: 6743 - DNA, 805 bp, Glycine max
  misc_feature (786)..(790): n is a, c, g, or t
ctttatatgttgaaggtcttccatctgacagtacgagacgggaagtggctcgtatcctttttgttctcagatactgtataggaattgtataatcatactttcaactgtcttgtcacttcatatattttaaattacctatttttgttctcagatactgtataggaattgtattgtcatactttcaactgtcttgtccttaatgtcatttttagatatttttcgcccttttgttggatatagagaagtaagacttgtgagcaaagaatccaaacatgtaagtgtactgtttgtagcagttgtctgtttgtcctcttttaacttgttttatcgttgttctgcttcttggttgaaagttccttactctttatgctgaaatgcatgcttaatgcagcgtggtggagatcctctaatcctttgttttgtggattttgcaaatccggcctgtgcagcaactgctctgagtgcattgcaaggtatcatttcttgttacctgctgaaatcaaaggaaattaatttcatgtttttgttgttctagtcatctaataggaaattaggaatcctcacagcacaagggttacttgatggaggttctgaaaattgaagaattcccatgggtttttggccttttgaaccaagttgtggttattaagttgtcatgatttttttggatgttttgttataattttgaatcatactgggggaaaaacattgcactaaaagtgtagaagtatgatatgcttatccaactcatgaaattactcaatattctattgaactaaaatgatnnnnncttggaaagtggtaa

SEQ ID NO: 6744 - DNA, 355 bp, Glycine max
agttcccatcttggtcttctttcacggtggtggcttctttttcgaatccgctttctcccaactctaccaccaccacttcaacaccttcgtttcccaaacaaattgcatagtagtctccgtggagtacaggctcgccccggagcaccctctccccgcatgttacctcgattgttgggaagctctcaaatgggtcgcatcccattccagcgaaaatagccccatcaacgcagaacagtggttaattagccacggcaatttccaaagagttttcattggaggtgacagtgcaggtggcaacatcgttcacaacattgccatgcgtgctggcactgagcctttaccttgtggtgttaaa

SEQ ID NO: 6745 - DNA, 644 bp, Glycine max
aaattcattgaagtccagaaagctctaagtgctactgaagctatggtaaaataactacccagtatttggggttcatatcaccacttattttaatgcatatttagttgtttaccaatttcacgtttccaaatttcacaggatgttgatcactgtgaaccaaacagcaagttcaaaaaaactggtttccatttaaatggtgatggattaaggcagtttgtattcagtatttcaaatctacagcttttcgatattggtacttggtcaacttacaactatcttatgctttcttgttaatcaggaagcaactatgacgtgtctacatgtggggttctccactccattggatcagatttaacaagaatgaaagtgacatctgagacaaactatagtgactccgggagtggacagaaaactataaaggcaaaagagcccgggaacacccccataagcagggttgagactagttacattgatcaaatttccagtttctatatagtcgattgttttgcatatatgatgtgatttattttgaaattgtacagccagttatctcaagagagagttttgcgcaaggcaaagagaatggcagaacaaatggaattgaaaatcaaggggacgaagctgatacaattatatgcagcaag

SEQ ID NO: 6746 - DNA, 329 bp, Glycine max
tttaagactagggatgaagtcctggaaggtgttcttaatgatccatgttagggatatatacaagttttatgttgattactgagtgtctaacacaacccttttcctttgcctggaccttggactggtgctgagaccatggatagagttaatgccctaaaatagtatagtaaggaaaaggatcctccttcatttccttggtcatgggagatgttgtggagcttcaatgggagtttattttcattgtgttggaagtgggataagaggagttctcttgcatattttcaataaactgctatctgatgtgtctcctatggtcttatgggttcagg

SEQ ID NO: 6747 - DNA, 398 bp, Glycine max
tatattaggcataaattaaagtataattaatttgtttctgacaaagatcaattaaatgtttgagatttttatgaatgggacgtatcaataatttaaggattggtatttcactgattttaagtatgaagagaaggtcactatcatagtatgctatttgtgttatatgcaaatatgacagtttggattaatcattatggtgcctttactagtgcaatttgtagtgtagtcagtactattttttacagaatgttttcaatccttatctatgatctatctctttgtgaaactaaaattagtagcagaaaaaagatcatatttgactattaagttactcttcaatattttgaggacaaacatgtaattcaagctaaatatcaaaggagtccaaatagcacacg

SEQ ID NO: 6748 - DNA, 842 bp, Glycine max
  misc_feature (820)..(821): n is a, c, g, or t
  misc_feature (826)..(830): n is a, c, g, or t
  misc_feature (836)..(836): n is a, c, g, or t
  misc_feature (838)..(839): n is a, c, g, or t
gtttaaagtaccaattcaagtaaggattgtgtactcttttaatgttatttcgtcaaaaaaatcagcagtcactttctccttagtttttctgctttagatggtctaactttcattttgatgtttattttctttttctcctcctctcacaattatgaataattgctttaattttgttaaaaatcattaaactaaccatgataacatatgcttggtctctttattctaggcgtgcataggatcaaaagtgatcgctagtgaagcgatatccgcaataaggaaggatgtactagccaaatgctacggtgagacaaatggcaaaccttaggggtaggggggtcttgcataaatttgtttaaaaatatttaaaccattattgccatcgggatgcttcaacagtctttgggctgctattctgtcttaaatcttttaacttgttcggtttccccacatattttaagatttcttgtccctgtggctctccatattaaaaatgaaatttctttttcattcagatatttagaaaatagatactatgaacgattttttatattatatagcatccatctttctttcactttatttttccttgccctgttcttattgcctgtattgctttttttctatttttctcttggatcttctaggtggggatatttcgagaaaaaagaaattgcttaagaaacaggtatgatcagtataaattcactatcattttttttaagtttatcaaaatggatgtctagctatgtatatccatagaaaatacagagaagtaagtatatatgtagatgtgtgttctcaagttcagcttcaatgttannttgcnnnnncaaagnannttt

SEQ ID NO: 6749 - DNA, 390 bp, Glycine max
agatattctacagttcaagccttttaaagaaagaaaacaattattaagaagaagaaaaaacaaaagaaaaattcttatgaggacggtgattcatacgtgctatacagtttagttacattcttacttttgtcactagaagaaatgccatagaattcttctaggtatgccaaagcttctgagttgctgttacaaaccttccacaatgatgcaacctctcctttagagacagttccccaaccctcacaatcatttaaaaattcaagcagctttgaataaaatgaatcatagttcatcaacaggaagggaacaggaaactttgatccaatccgttctagctgaatcaatgccaatatctcaaacacctcatctaaagtaccaatcccaccaagt

SEQ ID NO: 6750 - DNA, 557 bp, Glycine max
ttctagcttatcaaaaacattggattctaccaagcaagaatccatggattggaaaagaaaatatgaacaagttttatcaaggcataaatctgaggaagaccaagctagttctgaaatagcagccctcaagtcacatagtagtgctgctgaagcaaggttggctgcagcaagggagcaatcccagtctgctcaggaggaggctgaagagtggaagcggaagtatgacattgctgttagagaagcaaaagctgctctagagaaggcagcaattgtgcaggagtacacaaacaagcaatcacaattgagggaagatgctttaagagaggaattttctagcactttggctgaaaaggtaggctctctgatattcctgctctgcacttttgcaaattgctggttacctagaattgctgttgcataaagttcaatgagcttattaatgttgtatatgatgaatgggatggagaatggagttcttattcgtttctccttgttggtttatacaggaagataaaataaaggagaaaactgccaaaattgagcatgctgagcagtgt

SEQ ID NO: 6751 - DNA, 365 bp, Glycine max
gcgttctcaagatcttcctcgaaaacgtcattcgcgacgctgttacttacaccgagcacgctcgccgcaaaaccgtcactgccatggacgttgtttatgccctcaaaagacagggcaggaccctttacggtttcggtggttagttaggacattatggtaggctcttactcttattagtatcgaatcatatgttgctagatggatcttcacattgtaatggctgttgttgtttaatttctgttcccagcttatttttcttttagccgcgcttattaactgatcacttcttttgagtgataatgtgactagagatttttatttatttatttatttctgggtattgcgaacttgagggtggaaacatt

SEQ ID NO: 6752 - DNA, 383 bp, Glycine max
ttttccgatttccagagaaaattctttgtgggcatctcttcaaaaatgtcaagcttccccaacacggtggcggaaggccgcaggtccggcaaggcaccggaaaaatccaccttttctcagacttgcagcctcttgagccagttcttgaaggagaaacgtgcttctgctgattccacccttggaattggtggaaaaatggaacctaaaggtataaccttttatttatttatttatttatttatttatattatttccccttgtggaatattattattattagccttgttcaccaagtttttattatgtgatgtgttcaccatccaatttttgttgtgggtaggctttgtgtcacaattgatggtttggtgagggaaattattttt

SEQ ID NO: 6753 - DNA, 347 bp, Glycine max
tatatgtacacacatttatccaaataaacaaagactcaaagatcattgataaatagatctgaacacttaattaattcaaagacgagacgcagccaaaacttgctcattattgtaccccccaacaatactattttgactcacttggcaagacttcttgttgacagtggtagtattattcttggtctgcacgaaaaccttagccatgaccctcaactcaaacttctgaatcttcccagttgaagtctttggcagctcctccatgaacttcaccaccttaggcaccataaagtgtggcaaattcttcctgcaataggcaattatctcagcctcagtgacatcatcaattt

SEQ ID NO: 6754 - DNA, 902 bp, Glycine max
agatcaaagcataatgggttttctcaatgggattcgtattattctcgacatgatcacgatacaatccttcaggtcaattatcagcattttctacaagtatatatttgagagaattatatatatcgacatgtgttatatataaaattgttaaacaacttttgttaaaaagatattgtcgttccttagacaagaatgtaagttgtcgtgactctcacaggaaaaaaaaatctgcgcagtaactcttagcatacttagttttatttagttaagtttgggagaagttagttagctacacaaagttagttagtgtccagcttatagcctcattgtatataagcttgtaattactctcctgtaactaacaaatcataatacaattgatcattaatcactttctctcaatttctgctttcttcttcctcaagttattgcttcttcactcttgatcaccttcagttgaacttcatgagtaacaaaactactcgcaaaagggtgcgcacgcccttgtttttcaaatttataccatatgaagttcacatttttgtcaataattttgaactcaattcgggtcatgagttgtgtgttgtcctataagtttgatgcatggtttgctcttgtggcttgattttcttaccagatactacttcatgaaaggaacccgcacaattcgaaggatgtagatgggtttgttttgccaactctggtgtatatggctcgtgagaagagacctcaatatcatcacaactacaaagctggagctataaattcattggtagtgtatataattaaaacccgcctctattttttattaaagaatttaggatgaagaatagtacctcaattcatgttagaaaaatctttcaacttaaaaagtatttataaggaacttaattacattactc

SEQ ID NO: 6755 - DNA, 788 bp, Glycine max
  misc_feature (71)..(71): n is a, c, g, or t
  misc_feature (718)..(720): n is a, c, g, or t
  misc_feature (729)..(729): n is a, c, g, or t
  misc_feature (731)..(731): n is a, c, g, or t
  misc_feature (738)..(739): n is a, c, g, or t
  misc_feature (741)..(742): n is a, c, g, or t
  misc_feature (744)..(752): n is a, c, g, or t
  misc_feature (760)..(766): n is a, c, g, or t
  misc_feature (768)..(773): n is a, c, g, or t
  misc_feature (775)..(775): n is a, c, g, or t
  misc_feature (778)..(778): n is a, c, g, or t
gatcttttatacactgatcagcctgtggtgtatctttctatgttctatttcttcaccaatccgagatcaancttttgcagataattatgttgtgctgctttgtcttgtatactgtgtcactggcatagcatatgcattgtccatattttttgaacctggtgcagcccagctggtaagtattagaagctgaccataaaacatttagcagccccacaattcaaatttactcatcattatgtttctatttctcctctattttgttttattgcagtggtcagtacttctgccagttgttttgactctcattgcaacacaaccaaaagatagtaaagttttgaagaatatagctaatttatgctactctaagtgggctttacaagccttagttgttgcaaatgctgaaaggtaaactgttcaggatgattaatatattaaattactaaatagcttgaagaaaaaactactttgatatgtttggctttattggaatttgatgctgttattaatgcataattgcatatagtaagaaaaaggtttttgcttgcaaaaggtattagggctagataaattactcctttccctgtagttcatggcagtcttcaaattggaactaagcatttagaatcctaagtttacacaacctttaatcactaaattatcagactatttatttatgatccttttgcagttatggatctggctattagttttttttttnnnttttttttngnaacaaanntnngnnnnnnnnnaaataaannnnnnntnnnnnntntcncaaccccaaa

SEQ ID NO: 6756 - DNA, 401 bp, Glycine max
aagggcatgcaccaaacttgataggggacttgttagggcaagatccaagggcagaaatggaagccacggtgaggttgttgcatgcaaagagatcaatggggagaacaaagtaggtttggccgggcatgagtttatcatctatggagagaacaggaattggttgtccaatgaagaaagagtctgcatgacaaaccatcatttcagggaactcaaacatgatctcaccagctatgtgtttccctttaagggatctcgatgttccttcccaaaatatgagcttcacggattttgatgatgatgatgaattggtgttgagttgaaagcatggagtcttcaatgcgtttcccatttgaataggagagaataatagagagagaagtggtgctagttagctgcatgca

SEQ ID NO: 6757 - DNA, 383 bp, Glycine max
aaataaagatgatatggaaggccctcaataacattaatcatttttcattcacttcagaatacagcacattgctgtctccttcggcaaatttggggttacaatcccctccaccgattcatccccttaatggtgtgttagaattagatgcggctttatgtagaacagatgctgagtgttcttttcgattttcctttaaatgtcttttttgagaatgacaaaatgtcaaactctcttcatcaaactttttcttcacctgcatacgccttcattacagcaatattctctccacgagtacgacaaaatttgtccttcagcaacaaagttcttcattttcttaaaacctgacaaattttagatattttcgcacactaaacatccaaaga

SEQ ID NO: 6758 - DNA, 779 bp, Glycine max
ctccttgtacttggtatactttggtggaaaggctgcttcggaaagaaaagttctttagagagaggtacttacaaagaaattacttttgttgtcatgattatcagtcaaacattttgctaaacgcactgtattattcatatgaaaaaaaaggagaaattatgcatgttgaataagtttgagtatgtgccttaattactatatcttgttattggacctttgaggctagtaattatctagctaagtagaaagttgcatgctcatatgcagaatgcattcgtaaaaatttctcattataagagatctcgatctgatatatttcttctacttcaatcaacagagctacaaggtttagacctgcgaacgggtttgtttactttaagacaaatcaaagcagcgacaaacaactttgatgttgccaataagattggagaaggaggttttggtcctgtgtacaaggtattttccattatataataaattctctttattatcatacatttatataattttacatatttatttttaaaataattttttcaacattacaataactatattgcatcgatcctttaaaatgtagggatgtttctcagatggaacactaatagctgtcaaacaactttcttctaaatcaaggcaagggaatcgtgagtttttaaatgagataggcatgatttctgctctgcagcatcctcatcttgttaaactctatggatgttgtgtggagggagatcaactattgttggtatatgaatatatggaaaacaatagtcttgctc

SEQ ID NO: 6759 - DNA, 379 bp, Glycine max
tttctggggttcttcgagctttgatgttgagcactgaaggctctgacccacaatcatgcactctaaacagtgatggaatgcctcttgccgttgattcctctgaaatgtcagatgaatcttcatcaaccaacctacaagcaccaattttcctctctttgttactatttctacattatttcactctattatggcacctaactgaaaacgagtgcaaagagattgatccccattccccaacatggcatttgtaaatttgaatctgtgctttggtgcttaggagtgtatttttattttctttcttgggtgttaatttgtttgaaagaaaattcataatggttttgttttggtggtcctggattgccatgtgctaatagaaaaa

SEQ ID NO: 6760 - DNA, 607 bp, Glycine max
accaaagtgatgtatcagaaatccagatgagatcagctataattagattgtgaaaattaaataaaagtgcagtgtgtatgtagagcattattgtatagtctcaatggatcatcaaagaatgtctaaattgggaagaaccaattcatgctcctgataagtcaagcatgtcagaaattttactagtataatagtcaggttgaatattatttgaaggatcttgtagagctgattgagttgtgcaacctgttcgcaaaataaaagtaatctcaatacgttatgaatgacttctgtagttacatctatgatacagaaaaagacaagtcccattacctgaaagaactagaagtgttttgcaaccagcattttgtccaaacaatatatcagtatctagtctatcacccaccatgcacatcttggagcaacttacattgaatctgccaaagagaatcagttacacgcagagaaaattttaaaatataacacaaaccactgcaaacaagaccaagaaatttaaacatttaactttcttacttcttaagtaaaaactccatcataaaggttgacggtttccccaccacaacaggctccttctgggttgatccacata

SEQ ID NO: 6761 - DNA, 794 bp, Glycine max
gtactcgctgcatctccgttctgcactgaatcactgatcagagatcgcttacgaactcgaaaaggttaatgaacgagcacgtcattgcgcttctactactcttccactttaccttccttcgcagataaaccgtgttgcatattcgcgctgcttcctctctagggtttcttcaacctcatggcttcccctactcatttcgacgatgtaagtgccaatatccctcgccatttcctctccttcgctctcgcaattttccttaacctccgtttcgcttctgcctaacgcaggacttcgatttcggtgacggatttggcggaaggcattcaggttttgatttattttgtcgccaaacgctgtttgagtttgacttcttgttgtgttgagtttgcttgtttcgtttgctcggaagtttaggtaataagaggtcatctcctgattacgacgatgaggattatgacaacgatccttttgcaccgaagaaggtaatgtatttaggtgcagattattgtgtaatgtgttttgttttccttcaattttttagattgaggttgtttaagaagtgtttagattgaggaaagttagatagatagcttgaatgatgttattgtgttgcagtctaaaacaaaggctgaagaagcttctggtgtaacaacaggaatgatcttgtcacttcgtgagaggtatttcacaatatagatgatgtgagatatattgtactttgccgagattgcagtaaattatttgagtctaaaatatttgcttcaactttgtatttttgcagtctccagaactgt

SEQ ID NO: 6762 - DNA, 331 bp, Glycine max
gacatcgatgatcttcataggtgacaaggtccgatgatcttattgtggttcaatcaattttggttttaaagtttaaaccttttggccattaatttcagagataagcatcttagaacactatcattctcattttctcttttttttccctcttcttttgttgctccatatgttaattaatttaatttgtccatgcactacttttagctggggcatctctcgaagcctctacttgaaaaggcataactccattacactatgttattctaggttttcatatggaactcgccaagtaaatggccaagaaagggataaactttggtgccaagacaaa

SEQ ID NO: 6763 - DNA, 416 bp, Glycine max
cagctcctgctccaaaatcatcaaaacctttaagtttgaagtcaactgtaactgacgatgatgatccttgggcttccattgctgctcctgcacccactactaaggccaagcccttatcagctggtagaggaaggggtgctaaacttgctgctccaaagttaggtgctcagcggataaaccggacaacatcatccgggatgtaaacggaattgccactttccagagaacgaaaggaacaaggaaatattgaatctgtacgttgccttttaattctggtggctggtgatcatgttaaattacatttgtcctttctattagcataatttggtttgtaaattcttttaagtgccatttttatttcaagggaaatcttaagggcagcaatagttgaattattccagggcaacaaggctata

SEQ ID NO: 6764 - DNA, 362 bp, Glycine max
atagtacctgtgccacccccaacatcaacaagtgactccaatccattgaacactcctttgcacctctcaatcaccacattggcaaccaattgagtgtcacttgccatagcatcattaaaaaggtcattaagccttggctcgcggtcagcataatcccaaattttcatcccatgtgctgtttgaaatggcgagggatcatcatttttgaaccatgttggcaattgaagccatggctgtgtcaaagttggatcaagcattgcatgcaagaaaggtaccatacttaaggggttgtccttaagtagtagagtagatgcatcggtcaacacgtaacccatttctagctcattctcgttgaccttgag

SEQ ID NO: 6765 - DNA, 636 bp, Glycine max
  misc_feature (543)..(544): n is a, c, g, or t
  misc_feature (618)..(619): n is a, c, g, or t
ctcacaccctttagaggtgcttgtaaccccatcatgaacaaggtaatttattttttgtttctgctttctggtacttttttgttttcttttctattctatgaaggttgggaaacattatactatagaaatatgtatatgggcattattttctgaactcaaaatttgtgataaatgttgatagggaacattgttaattaagcgccccaaagaaaaaaaaaaaaaaggggggaaaccaaaaaaaatttaaaaaaggggttttttttgaaaagaaaaaaaaaaaaaaaaagggggggcggaaacaaaacttttttaaattttttaaaatttttttttgaattgaaaaaaaattaaaaaccccgtttacttttttacccaattgattttttttaaaaaaaaaaaaaacctttaaaaaagggttgaattttaaagttttttttgggaaaaacggggaggcccccaaattttttttttaatttttggggtcggatttgggttcaatcgggatttcgggattttttttttttttgggggggttttagggannttgttttttttttcccttttttttttaaaaatttgaaattccaaaaaaaagatttggggaaacctttttttttnnctttttgggaaaaaaaa

SEQ ID NO: 6766 - DNA, 360 bp, Glycine max
tcacctactcggaaaataggatagactaataaattctcagagcaaggaaaatttgcatcaccaatcaaaaagtctacaattctttttgtatcttcttctcttccatagactttttgatcagtgatggacaagatggtttggtgccactcagggactccggtgattctctcttgaaatatggaagtcaaaccaagctggtccttttctttagcgatttgatctaatctctcacttatacttttcattctcgttttgcaattttgtaacggaaacaaagatgcatggcttgaaaagaggataaggaagagcttagtaccatttcagatagacaacacttgacttcatattccaaccacaatt

SEQ ID NO: 6767 - DNA, 273 bp, Glycine max
tgtttgtctgtttccaatggagcaagggagcacagacactcgtgtggatgcaaacccaagtctttccagtcacgaagaaatacaatctttggatttcgatactgagtgtgagaccaaaatgaccaactctgctggaaacggggcaggaggttcttcctatgttgaagaaggcgtgagaaaaaagcgcggcagaaaaagtaaaaaggagatgggaaagatgttagatgctaccgccatggaaggtggggtttccgagcagagacccagtagaaa

SEQ ID NO: 6768 - DNA, 401 bp, Glycine max
atgtgtgccatcccacctgctatttggtgttagataacaactcatggtctcacactagcttttccttatgtttatttttattatattacttttacttcaaggtgcaaccaagtgaagccaccctcctatgaaatgccttcaaacgaaaaagctaagcagtcagtttggcagtaccaatcataataggctcaaatagttgcaacattttccttaacaaaaatgtggtacccttaaagcatctaagtttagtttatattacattaatttcacaatccctccacttcattctgtgcctccaacttgtcattcaattccaccctgaagattgtgcttcaggtggttcaaagaagatgggctcactagaaagatcaaagaagaaagtccttctatggaagaaggcc

SEQ ID NO: 6769 - DNA, 625 bp, Glycine max
ttgagctgagtgtgcatggtagaacattcgtggtggtattttaattactcaactgctgagcttgagttgcataacgtgtggctgagcttttctaaactgtgatgaggaagaagaaaaaaggattttggaggtgaaaaattattgagatcgaataagaaaaacaattaaaaaaatacttggtgttgaatatatgggtggattaatggaaaaagagaagtggggggtggtctcatgtatagcattttctgaccaagcccagcttcatgttgtgacatcttctgcagtggaatctgagttcatttaagtgaagcatgttaattttgcttcatttaatgatgtggcatgtgtatagatttttcctaacatgagtagctttgtgacacacggtgccactatctcctgcaggtttcaatgaaatcgcattcattgaagtgagaacgaacaatgtgttttacttgatgtttgatgtagtggtgatgctgaagaagggcatatggtggtgcttgcagtggatcttttatcttctgttcattgcgtcaaggaaaatgttgccattgttggttagtgtgctattctgcttacaataaatcatctcaaagagaagctacattgtcaagcacagtgg

SEQ ID NO: 6770 - DNA, 350 bp, Glycine max
gtcgaggacccattaacaattgggcctgatgtgaagtccaaagaaataggcaaggcccaagggttttacctatccgcaacccaaaggcccggtttggagttagagatagtcatggggatggctttgaccttcttagaaggcgaattcaacggtagcagtttaagtgtattggggagaaacaaaatcttcaatgaggtaagggagttgccaattattggtggcacgggtgagtttcgcttcgcacgtggctatatccttgctaggactgtcaaggtcgattaccataaaggggatgctaccgtcgaatacaatgcatatgtctaccattattcttccaccagctcttcttc

SEQ ID NO: 6771 - DNA, 338 bp, Glycine max
ctgctcttaattggatcctttattaatttttatgaatattacttgtgctaatgctacaaatcatttaattgattatttggatgacctatttgtttgcattttatgttatgcaggagagatcaaccgggggcacttcaaggttgtgatccaaataattaccgagcattgtaatggtatcattctgctgcataggatcattggctggatttcattgttcaggatcaggaggataaaaactataatctagttcttataccaatggccttcatggaaccacatttgttcccattctttttccttcaaaattggatattattggtacttggaatggttcttgc

SEQ ID NO: 6772 - DNA, 1004 bp, Glycine max
  misc_feature (65)..(65): n is a, c, g, or t
aaaaacagtgatcagcagatccatttgcagagatttgtaaattaagaattcataatatactttgnaaaaaaatccactaatataaacacaaattttataccttggaaggatatgactccccccatgttaggccaataacatcacctcccagataatcatgccatacttggaatgtggttgagaactcttgctgcaagtgataagtgatagtatctaattagcaaagaggatactgtgcaaagggaaaacaacattatattcaacatcaaatcattttcactgtacgtgcctttaaatctctgataaagcactttgatggatcaaaatctaccagcaacttatttctaagttcctctggcctgcccttcaaatctttaggcaacaaaaagggttggaaacacttgctggcctgtccttcagcaacatgtgttcctgccaacaatgcaaatgagaatatgatttgattaattaagcataactcattaaagggaagcaaataaagtaaaatattaaaagatcaaaccatcaataattactgttctttaacattaattaatttaattccttagtcaaatgaggtctgaaccaatgccatcctgcatatgtatatttcatagtcatgggtctagaacattttgtatgatggcatcgcacttgaccacacacagaaaaaccagttatgactatgaaataatgcatctggcttgctacaaatataactaccaactgattatataccccttacccttgaatcatttaagggtggtttaattaagtaaactaccagctactaattataccgtgattaacttctgatggaaagagaagcctttggggatacgggagtttgtccttgtggagaaaaattactgcatcataattgtttaaaggagttctaaaaaggcactgcagcaagaatagaaaaattcattatgtctctcaaaagatatctcttctacagttaaaagttgaaatgagtaaatatctgaaaaatgtgctccact

SEQ ID NO: 6773 - DNA, 441 bp, Glycine max
tgaaggtgtatggtgcaacttgtaagaaccccaatcttactttgcaacactggcagatggtatgtataggattcatgatgttcctggctctttttgacctgttagtagcgggcatggtcatgcaaattctattctcttttcttgctatccttcaacattcccaaaggttttgccgccaagtttcttatatgatccagctggctgctcattttaaatgcaagacatttgcatgagtttctagctcctctattccattggccccatcaagggggaaatcagtacttcaattcctaatccagtaagttagcttcccattgtaaatgaatttcatatggtgcgaacaataggaaacaaaatgcatgattttgcaatttactcccctatgcaaattgtgtttatggattgtatgttcatatatgaatttgaggagcagagagtgga

SEQ ID NO: 6774 - DNA, 411 bp, Glycine max
tgggcatgaaatctacaagattggtacatagcatgtgtttatgtcaattttgcactcctacgaggccccatcgtcatttatcaatggaagcctaatcttaacgtgcataaataaatattgggaattttgagattatgtttggcactttgaataatctcgtgttctgctgccgcaagttcccttacatgtctgctatgaaatctatctattgtctattgacttgagaaattatatttgttttaatatatttcttctatttatattattggatgtataatcttaatgtgcagatgaatgttgggtcggaattttgcatttcagtataagcactacatgtccttgctgcttctagtacccttgcatattgcatctaagcaaagttattcataggcgacttcatttgattacaag

SEQ ID NO: 6775 - DNA, 369 bp, Glycine max
gctatatgaatctagagtcacattgctggctagaggcgttggaaatgcagatcacggtcattgcagaaaacatcgtgtataggaacaatttttttttattaaatgtattgcacattcaaataagaggatcctcttggttaaattaagaaggaaatacatatttttttggttcattttccgctgtggaaacaaaaatataggaaacttggatccagacaacgttacacaattctggttctgacaacaatggctccgacaacatggacattgcattaggtttagataatttttttgttaacaggctagtaattggcacattttcttccaagaaaaatctagtcagttgcagcttgtcatcgccaacatata

SEQ ID NO: 6776 - DNA, 355 bp, Glycine max
atgtccatcttccttaacgttttcctcatgacaaccctcaaaatcctctctttccaacgatttgccatatgggcatgtctcattacaatcttctacgtgctctatggcgtccacaacacttatgaggctgaggagactgagaatgaagtggattcaagtgtaaacaacttgcataccaaggtagaaattattcaagtgcactaattgaagcaatcaaattcaattgggccaaaaataagaaaataatattatgtagctaagtacatttaatttaatttaatttgtgggaaagagacagatggggatattctaaaggaatgttgcaatatattggtgatgaacacttcaagcaaca

SEQ ID NO: 6777 - DNA, 210 bp, Glycine max
tgcctttcttggtggctctatctatcttggaaggtatacgtttctttcatgtctcaatcataagaaaaattggaggtgtgtccacttatggacttatgattttattaatgagagcattttgttttcgtgtgaatgaatgcaatttaaaaaatactttagtctaaggactacaattatgaaagggggaccttttgtttgcgtgtgtgtgaa

SEQ ID NO: 6778 - DNA, 483 bp, Glycine max
gcgagagggaaggctctggtggccactgacatcagcatcgcgattccagagggcacatatgctcgcgttggtaaaaaaattttctcttcgatttagggttttctgttttaaattgcggtcgcaacatgaaggtatttttagttattttgtattttttttttaaatttagtttttgatttttgtagcgccgcgttcggggttggcgtggaagcactcgatcgacgtgggtgcgggggtgatagatgcggattacaggggtccggttggggttatacttttcaaccattcggacacggattttgaggtgaaggttggggacagggttgcgcaacttatcattgagaagattgtgacaccgaatgttgttacagaggtcgaggatttggatgagactgttagaggtgaaggtgggtttggatccaccggtgtttgattttgttctgttctcttggtaattttgtagagcagttggggggggtaatc

SEQ ID NO: 6779 - DNA, 474 bp, Glycine max
gcatattacgtgaggaagttgaagaagcgatgagtattcaggagctcattaagaaaccactcacttcagttcctcaacgttacattcaactacacaataatgaaccttcacttctcgcaggtgaaacctttagtcacgcactcccaaccatcaacctgaaaaaattgatccatggagaagatatagaacttgagttagaaaaattgacctcagcttgtagggattggggtttctttcaggttatatttaacactccacgttaattatttgccactagttagctatatatagataatagatatctttgatttcttgtttatttatttttctgaatctatatctactttaatgtatgcagttggtggagcatggaataagctcagtagtgatgaaaacacttgaagatgaagttgagggattcttcatgctccccatggaagaaaagatgaaatacaaggtaaggccaggtgatgt

SEQ ID NO: 6780 - DNA, 1432 bp, Glycine max
  misc_feature (383)..(383): n is a, c, g, or t
  misc_feature (394)..(397): n is a, c, g, or t
  misc_feature (399)..(405): n is a, c, g, or t
  misc_feature (407)..(409): n is a, c, g, or t
  misc_feature (411)..(413): n is a, c, g, or t
  misc_feature (418)..(418): n is a, c, g, or t
  misc_feature (479)..(494): n is a, c, g, or t
  misc_feature (497)..(498): n is a, c, g, or t
  misc_feature (501)..(511): n is a, c, g, or t
  misc_feature (515)..(524): n is a, c, g, or t
  misc_feature (527)..(530): n is a, c, g, or t
  misc_feature (535)..(539): n is a, c, g, or t
  misc_feature (542)..(547): n is a, c, g, or t
  misc_feature (554)..(575): n is a, c, g, or t
  misc_feature (577)..(578): n is a, c, g, or t
  misc_feature (588)..(601): n is a, c, g, or t
  misc_feature (606)..(606): n is a, c, g, or t
  misc_feature (609)..(615): n is a, c, g, or t
  misc_feature (617)..(617): n is a, c, g, or t
  misc_feature (622)..(646): n is a, c, g, or t
  misc_feature (648)..(648): n is a, c, g, or t
  misc_feature (650)..(660): n is a, c, g, or t
  misc_feature (664)..(666): n is a, c, g, or t
  misc_feature (669)..(675): n is a, c, g, or t
  misc_feature (679)..(684): n is a, c, g, or t
  misc_feature (688)..(688): n is a, c, g, or t
  misc_feature (693)..(703): n is a, c, g, or t
  misc_feature (707)..(709): n is a, c, g, or t
  misc_feature (712)..(728): n is a, c, g, or t
  misc_feature (733)..(736): n is a, c, g, or t
  misc_feature (743)..(751): n is a, c, g, or t
  misc_feature (753)..(755): n is a, c, g, or t
  misc_feature (757)..(763): n is a, c, g, or t
  misc_feature (767)..(774): n is a, c, g, or t
  misc_feature (779)..(782): n is a, c, g, or t
  misc_feature (784)..(792): n is a, c, g, or t
  misc_feature (794)..(807): n is a, c, g, or t
  misc_feature (809)..(815): n is a, c, g, or t
  misc_feature (818)..(819): n is a, c, g, or t
  misc_feature (825)..(840): n is a, c, g, or t
  misc_feature (843)..(850): n is a, c, g, or t
  misc_feature (852)..(857): n is a, c, g, or t
  misc_feature (859)..(861): n is a, c, g, or t
  misc_feature (867)..(876): n is a, c, g, or t
  misc_feature (878)..(878): n is a, c, g, or t
  misc_feature (886)..(887): n is a, c, g, or t
  misc_feature (890)..(892): n is a, c, g, or t
  misc_feature (898)..(912): n is a, c, g, or t
  misc_feature (919)..(938): n is a, c, g, or t
  misc_feature (946)..(958): n is a, c, g, or t
  misc_feature (965)..(977): n is a, c, g, or t
  misc_feature (979)..(984): n is a, c, g, or t
  misc_feature (990)..(990): n is a, c, g, or t
  misc_feature (992)..(1002): n is a, c, g, or t
  misc_feature (1004)..(1016): n is a, c, g, or t
  misc_feature (1021)..(1029): n is a, c, g, or t
  misc_feature (1033)..(1039): n is a, c, g, or t
  misc_feature (1044)..(1055): n is a, c, g, or t
  misc_feature (1057)..(1060): n is a, c, g, or t
  misc_feature (1064)..(1066): n is a, c, g, or t
  misc_feature (1069)..(1072): n is a, c, g, or t
  misc_feature (1080)..(1084): n is a, c, g, or t
  misc_feature (1088)..(1096): n is a, c, g, or t
  misc_feature (1099)..(1112): n is a, c, g, or t
  misc_feature (1115)..(1120): n is a, c, g, or t
  misc_feature (1124)..(1128): n is a, c, g, or t
  misc_feature (1131)..(1132): n is a, c, g, or t
  misc_feature (1134)..(1135): n is a, c, g, or t
  misc_feature (1138)..(1139): n is a, c, g, or t
  misc_feature (1141)..(1146): n is a, c, g, or t
  misc_feature (1149)..(1160): n is a, c, g, or t
  misc_feature (1162)..(1163): n is a, c, g, or t
  misc_feature (1169)..(1179): n is a, c, g, or t
  misc_feature (1184)..(1189): n is a, c, g, or t
  misc_feature (1197)..(1198): n is a, c, g, or t
  misc_feature (1200)..(1200): n is a, c, g, or t
  misc_feature (1204)..(1208): n is a, c, g, or t
  misc_feature (1211)..(1216): n is a, c, g, or t
  misc_feature (1220)..(1224): n is a, c, g, or t
  misc_feature (1227)..(1233): n is a, c, g, or t
  misc_feature (1237)..(1251): n is a, c, g, or t
  misc_feature (1255)..(1261): n is a, c, g, or t
  misc_feature (1265)..(1268): n is a, c, g, or t
  misc_feature (1270)..(1272): n is a, c, g, or t
  misc_feature (1276)..(1285): n is a, c, g, or t
  misc_feature (1288)..(1309): n is a, c, g, or t
  misc_feature (1311)..(1319): n is a, c, g, or t
  misc_feature (1325)..(1327): n is a, c, g, or t
  misc_feature (1330)..(1338): n is a, c, g, or t
  misc_feature (1346)..(1359): n is a, c, g, or t
  misc_feature (1363)..(1368): n is a, c, g, or t
  misc_feature (1372)..(1400): n is a, c, g, or t
  misc_feature (1402)..(1403): n is a, c, g, or t
  misc_feature (1405)..(1428): n is a, c, g, or t
gtctggcacttctggttcctctggaagtgttatgcatagagtggagcctggtggtgcagaatacaattatgcttcagcctccatgggagcaaaattattaggttctaacaaagaagccaaaggcgcctctaatatcttaagcagagacaaagataagtatcttcgcaatccatgttccgccgaagacaaattcgtcatcatagaactttctgaagaaaccttggtagatacaatagaaatagctaattttgagcaccattcttccaacttaaaagcttttgaacttctcggaagtctgagctttccaacagatgtttgggttttccttgggaatttcactgcctcaaatgtgaggcatgctcagaggtttgttcttcagcagnctaaataaaannnnannnnnnngnnnannnaacgntgtttaaaatactcatcttcgaatttttttcattctgatttcaaagggatacccaactggnnnnnnnnnnnnnnnnctnngcnnnnnnnnnnnctcnnnnnnnnnntannnnctttnnnnntannnnnntcacttnnnnnnnnnnnnnnnnnnnnnntnnagcacttttnnnnnnnnnnnnnncactnaannnnnnntngcctnnnnnnnnnnnnnnnnnnnnnnnnntntnnnnnnnnnnntccnnnttnnnnnnncctnnnnnnctantcccnnnnnnnnnnnatannnacnnnnnnnnnnnnnnnnntcatnnnncctcctnnnnnnnnntnnnannnnnnngcannnnnnnnatttnnnntnnnnnnnnntnnnnnnnnnnnnnncnnnnnnntcnncactannnnnnnnnnnnnnnngcnnnnnnnntnnnnnntnnnccctannnnnnnnnncnctcctccnnctnnntacccnnnnnnnnnnnnnnntcctacnnnnnnnnnnnnnnnnnnnnctctattnnnnnnnnnnnnncttccannnnnnnnnnnnntnnnnnncccacncnnnnnnnnnnntnnnnnnnnnnnnntttannnnnnnnntccnnnnnnnttccnnnnnnnnnnnntnnnncccnnnttnnnncttttttnnnnncccnnnnnnnnntcnnnnnnnnnnnnnnctnnnnnncttnnnnnccnncnnctnntnnnnnnttnnnnnnnnnnnncnncccccnnnnnnnnnnntcttnnnnnntttttatnncngttnnnnnatnnnnnncttnnnnnttnnnnnnntttnnnnnnnnnnnnnnnttcnnnnnnncatnnnntnnntttnnnnnnnnnnatnnnnnnnnnnnnnnnnnnnnnnannnnnnnnntacatnnntannnnnnnnntacgccannnnnnnnnnnnnnacannnnnntctnnnnnnnnnnnnnnnnnnnnnnnnnnnnntnntnnnnnnnnnnnnnnnnnnnnnnnnatat

SEQ ID NO: 6781 - DNA, 499 bp, Glycine max
  misc_feature (488)..(489): n is a, c, g, or t
tggccatgctcaatatcatcgccattgtctccctcttactcttaatgattccatcccaagccaaaattcccggcgtctattccggtgggccatggcaaagcgctcacgccactttctacggtggcagcgacgcctcaggaactatgggtacgtacgtaaataaaatatatgcattattataaagttttacacaatgtcatgataataatgtaacatatatactatgtataacaccccaataattttggtgttttctttgtaggaggggcgtgtgggtacgggaacctatattcccaaggctacggcgtgaacactgcggcactaagcactgctctattcaacaatggtttcagctgtggagcgtgcttcgaaatcaaatgcaccgatgacccgaaatggtgtcatccaggtaacccttccatctttgtcaccgccacaaacttctgccctccaaactacgctctccccagcgacaatggcggttggtnngatcctccca

SEQ ID NO: 6782 - DNA, 760 bp, Glycine max
  misc_feature (380)..(380): n is a, c, g, or t
  misc_feature (488)..(488): n is a, c, g, or t
  misc_feature (506)..(506): n is a, c, g, or t
  misc_feature (534)..(534): n is a, c, g, or t
  misc_feature (547)..(547): n is a, c, g, or t
  misc_feature (586)..(586): n is a, c, g, or t
  misc_feature (591)..(591): n is a, c, g, or t
ttctgcagatttagatgacactttgtatcctctcaaatctggtctggcaaaatcatgtctccaaaatattaaacgtaagccactgtgccatatgcctatgtcacagcattctcagaaacgactttgtaatttgtactaacatgagtgatatcattgatcatagactacatggttgagaagcttggcatacaccctagcaaaattgatgacctgtccaacctcctttacaagaattatggaactactatggctggtctaagggtatgtttcctaatcatttcctgtgaaattggttcccattattaaattcttaaaacactaacagcctataattgttttttgtttcattttctattcaggcaattggatatgactttgantatgatgaatatcataggtaccttgcttttttcttttaccccatcactttcaaactgttaaaaagtgtttttttatttttaattattgtgtttattatgaaatggtgncattggttttttaattantgcttgcagctttgttcatgggagattnccttatgagaacntaaaaccagacccagttctgaggaacctgttgctgagcntaccntataggaaacttgtaagttgttttatgaccaatatgaagcagtagaattggtcacatgagatggtgcatagtatctaatgtggcctctattgcttctcttgtttttgtcaatagatcttcacaaacgcagacaaagtccacgcggctaaggcgcttagcaggctggata

SEQ ID NO: 6783 - DNA, 353 bp, Glycine max
ttatacccaaatcaaaacagtggttcaccaatggaaggatttccctagacaagcactattccctgctacatgtccatctgagagagattcacctaggcaattgtcacaagccatgcctgtagaatctgaaagtgattcaccaacctatgaagtacaagtggccatcactgatgcggatataccgaacacaaccatgtcatctgcatctacatcaactgataaggatcacagaagccaggatgtttccctattgctgccttcagcatctgagagggatatgtcagatcgggatatttcactggtattatcacctgcattgcaaagcaatttacctagccaaggagtatctgttg

SEQ ID NO: 6784 - DNA, 365 bp, Glycine max
agtggtaaactcaagttcttttttgtccgaacaataatgacgacggcggtataaaattcatcgaacaggcaagcgtaattggactggccaagtttgagaaaggaagtatttttatggaggcaagaaagtacttttatgaagacaatcttaacaattttttgcatgccccacggataactagggatggaatggctgagtggaccacaggtaatcaaatgagaaattttcactccttactcctgtaggcggggtgcacgcgttagcagcgcaggaattggttacacttacaccaaatgttgcgttgaagaatcatttggagcatttgttctttctaattttgctacatatgatcggaagcagttcag

SEQ ID NO: 6785 - DNA, 396 bp, Glycine max
accttgattaaagggtatgctaagataaatgatcttgagatggtaatgaaaaagtatgaagaaatgctcatgcggggaatcaaggccaatcagacaattttaactactatcatggatgcatatggaaaaagtggagacttcgacagtgctgttcattggtttaaggaaatggagtctaatggaattcctcctgatcagaaagctaaaaatgttcttctatctttagcaaaaacagatgaagaaagggaagaggctaatgagctcgtagtgcatttcagtgaaaatagcagtttacctaaagttaatggcattgttaaacttgttgacgaagatgaagaagaagataattatgaatattttgatgcccagctcgcaagggcttatgaacattctaca

SEQ ID NO: 6786 - DNA, 404 bp, Glycine max
atgaggacatgaagagtggagcaacctcggaaaggaactatggtctctttcaacctgatgaaactatggcttacaatgtagggttggctgcttttgcagactcatccacttcatccacttcaatttctcttacctcctctgccactaaaataaaggtaaaaataaaaaccagtcttttatttcccaccccaactctacaaaagttatttagcttatagcaaaacttatgacagaaccaacatgatgtggtaaataaccttgtcttttttaagcatatggtcatgggttagatccatgtctcgtgcatatgaaaaaatatctgctggaagatgttaacctcttaaatgaatctcaatatcttgagagattagtcattggcttttggtcgagataccttggttcac

SEQ ID NO: 6787 - DNA, 369 bp, Glycine max
agctttttgctaggtccttgaagtgtcttttccttggttactctcgtcttcaaaaaggttattgttgttttttcctcaacttcaacggtatattgcctttgcttatgctaccttctttgagactactatgggttgtcgttggatttatacaatgaagatcagaccaaatggtagtattgatcgctataaggctcacttggtggccaaaggatacactcagatttttggccctgactacagggacaccttttccccagtggccaaaattgctcatgtccatctctttcttgctatggctgccattcaacattggtctcttcaccaactaggcataaaaaatgccttcttgcatggtgagttgcaagaatt

SEQ ID NO: 6788 - DNA, 579 bp, Glycine max
gttaatttgtaacggtttaattgtactccatggactgaagttgaagctataattttggtttgaaattcttaaatttgtgtgaatataaatgaccagcaactgatcttcctacataacttcaatttggaaacaatctgtgctaagctctttctagagtaagaataagatttataagcatggggataccttttgaattgtttaatagacgtaccatgcaacattggacacattactcctctggctgtccactttgcagtcattacttcaaatgagattagatattaccacgtgttgtagagtttcatttgatttacatgaagttggcgggttaagtggcaggtgaagaagctagctactgaaggatttatttcaccatataaatgcaaaaagtggttgtctggagtcaatggtatgccctcaattcatgaggttctaagttttaacacattaccttttgtatgagtaaactgttttcaaatcctatatccaccctacttagatatataggataatttaaaaaccattattcatgttataatttctcacttcagtaggtgaatctccgtggcttcttgtgat

SEQ ID NO: 6789 - DNA, 398 bp, Glycine max
tctttcctctcaagagacattgttcactcctctcgagccacacgttctcgacccacccactctcgttttgccttagctcaccaaaacgaaaatcgtcgccgacgacaatggctttactcttctcgcacgcaacagcaacatcatgaatgtgagtgttgagctggttggggccattggtgtggctggtttcagaggaaacggaagtggaaccgacggtggcggtggcagtggctctacacttgcgcttctttttctggtgaggaaatgaaggtttgggttgcggtggttcctctggcgcgcccctgtgtctcatcttatattgagaaatgcaaaagatctctgcaattaaatgccttgagagagatctgtctctctttctctacctggtcatgtctgtg

SEQ ID NO: 6790 - DNA, 525 bp, Glycine max
cgtgatcgcagttacagccgagatcgcagctacaggtaagatgattttatagttcggaattcttatgcatgcgatgtagtgatgcagcaaggtttcacattttttgtttgtaaagtcttatcctgtatgctgagttttgggtgccttcggccttgctagtcgatcacgatcccctgtcagaagagaagaaagccccgttcgtgaagataggtcacaaagccctcaacacaaaaatagtcctcagccctccaagacaaggaagcatagtccatcacctgaccgtagcccacagagaagaggtgacacatctcctgacaatgataggttgagcagaagccctgcaagggaccgcgaagataggggctatgacagccctaaagttaatggtcgtagtggcagccctagccgtagccccagggatgatgacaggagccccattgatgatgaagacaaccaccgccactcaccaagaggcagcgagtcaccttaagaagtatttcttagagaaatgaactctggacgtgg

SEQ ID NO: 6791 - DNA, 219 bp, Glycine max
ttaaatgctgcatccgataccagtcactaatacaaaacctatacaagttttgaacttatactatatacaaagtactccaaaagaagaaagagttaatacagcttgcactattagtgcttacaaaaatgtgtgtgaaaatgcttcgccgagatgaggaagacatcaattacagaaaaaacaaatgacatcaacaagtgagaaacctacagaagacagaag

SEQ ID NO: 6792 - DNA, 1159 bp, Glycine max
  misc_feature (1144)..(1145): n is a, c, g, or t
  misc_feature (1150)..(1151): n is a, c, g, or t
  misc_feature (1156)..(1156): n is a, c, g, or t
ctctaggtatgattgtcatctatggatgtgttacttcgactttctaaatggcttattttttaattctttatttatttacaaatttggggctgtgttccagtattatgcctataaaacaggttttggaagcaagacctgatatgtgtctggtggctgaatatccatcagcagaaggaaggttagatagttttcacttttagagtattttggattttggtgcacttaatttcttgcaggcggagggattttttctttcattctaaaggtcaccaattgtttgtgtttctggattgtcttgcagttacatcgagacattcgatgctgatatgaacagcgagataagtttgccatcacaattgagcagccacacgtcagatggatcaatttttatgagtacatctgaaagcagctacaatagtgatcaaggaagtggcaatgaggatggtcaagatgccaactatgtgatatatgaggaaagctcagatgagattgactttttgtccctctagggaatcctccttgtgaggcatcagtttagaaggacaataatctagtgaacttggtactctctcattgtctctgtggatgcgggtgcacttgtgtgtgttgggggaggggggttacaagttgatttctaatgtataaaagcactggtgccttgaggtcattagtgaagaaaacaaaactaggaagtaattattgaaaaagaaagaatttattatataataaatacaaaaatcatttaatacttgtttaaggaattagaaatatttaatagggtgtaataaatactccttcaccattgtcctcaatatacttgcttgaccctttaataaaagcattttactaggatagattagctttgcttttaggttttgactttggacaactatgcactatgaacaagtttgaaagcttacgtagaatatgatgttttagagattgtcatggttggcacgtgacaagttttgctgtctagtatcccatattggaaattggagatacctaacacgtttgtgtccacaaaaagggatgttacaataaagtttgatgctttgaaattaattcctgctgtgtttttttccttctaaactcaatgtttgttcgcctcttggcgtttcttaatattgtgtttgaatttatnncctanngagcngta

SEQ ID NO: 6793 - DNA, 926 bp, Glycine max
tttttgtctgcatgagcagcaactgctgcataggatatgcctttgcacagttttaactgagtaaaaaacattaaattttcaagttattgcaacaaatattgatcaaacagagcttgaagtgggggaaggggaaccttatccagcagaatctccagaagagtcgcatcaggaattgccagtgaagcagttatctttgaacatgcccagtgcattatcaccacctcctacgcaaaagcagtcacataaaatatcaaattcacgcgtatacttaaagatgactgctaatttactgatgatactaatgaggagagaaagaataaaacaatggcaacagaatccaagacttgataagtgattcccgaatttctgattatataacgggaagttttaatcttgtatttaatcatcaggtgccaaacagctatcaaaacataatgcaaaattatacaataatccatacaatatacaaaaacttacttgattcattccaagatattctgatattttcagtgcaagcagatgttggtgagcattaatcaggcgaccaatcagaacagatggtgtaagcaactgatggcaataagctaattcagtataacatcaatatagccaatttcagcactgagatacacaagtaagccttaaaaaccttgtattgctgaatactaagaggaacgccaatctcagggctgcgcactgcattcaagacccgcagaattttacacatctcttggatacgatcacgttgaaaattgctgccaaagtcaactggatatcattaccgagagcaaatatcagaaaatatgcttgtcccttttaagacaatcactatcgaaaatggtgtacttgagacaacaaaacacttttataggaatatcaccagtatatccaacagaaaatccaaatcaaactcacctacaaaaggc

SEQ ID NO: 6794 - DNA, 195 bp, Glycine max
gctgcgcggttcgtgcaccctcggccattcgattgggatggagaaagaagaagagtagggctcgttgaagaggggttttggtgagggtgatgttgaaagcgagaagcttttgggtgaaaatgaaatcggaagaaggagatgttctcaagatctacgccgccgccgccaccaccacattctctctctttctttggg

SEQ ID NO: 6795 - DNA, 826 bp, Glycine max
gactaggttctcttgaggttgggaaaaaggttggtattggttctcattatttgcgtttctctttctcttctcattgtaattattatggtttctcttcccctgtttactgggactaaatatgagattactctctgttaaacacagtacatactatagacattgaattcaaagtcgagaaatgtggtgtgtggacaattcatcacaattgatccttgctacattttattgcacataaagcacaattgaaacatgaaaaactttgtatatgttgacagttacgatgttttattttgtgaactccagcgaacaatgaaaataaataggaaaattttcaacatcatatggacctatggtgaaaaattcatcaaaacgtaagggaagaaaaaaaaacttgcgtaaaatctattgcattcaattaaatgtgaccaattctttgctggcttccctggtcaattcttatgcaatatccttctttctttaatatgtttcatgaccaaatcttctgttgatgataacgtagcattttttgctatttctttgctcgcaacagaagctgacgatgtttgtacttgtcatttaataggctgacattgttgtagtggatccttcgtcttggtctatggttcctgttcatgactggtacgaactcattacttaattggtatttttggttcattatacagacctttttaatgacttgtttttgaataaaatgagtgtgatctagttgtgtgagtatgaaattatatgacgattatgctttacaatgctttatataaaacaattttgaggctttgtagcggaagttcctttctattgcaatcct

SEQ ID NO: 6796 - DNA, 1043 bp, Glycine max
ttgagcgctcacctgcgtactattatgtcagtatacttttcatgttttgaattttgtgcttttactttattttatttttttgcttttgcctaacttttcttttctgagaaaggtttaatttaattgttgcgggacatgcatcgatttcactgctttgattaggtttgaaaatgtctccagtaagtagtattcagtactttctcttcaacaaacccaaacaggagagcttgtgtagtagtatatagatgtgtgatttttagacttggcagggaagacgtttgtaactcgatttgccatctacttaagggatggttcaagtgtatgctcaatgaagtgtgtttgtccatgtgagaaaagaaacaaataattggtcctccagtgataactgaatgccatgagtttcatctttttaggaactaatatgatcatgtcactttgaggaccaatttaatggcataacaatgaaagactagtatgatgcattcataaagggaggattaacctattaacgcctaattttttaaaggaccaaaatggttattttgctgttggtaaaataaaaaaatctgaacatgtaaggtggacctgttttatgttttgtttgtgggattttgaagtctgcttctggtaattatgagtgtataattgctatccattgtctattttctatggttgtggtatcaattgttataacattgcttcatttgctgcattatcttctcagcagtatccaagagcatcagaagagcatgttcctctatcatctcaccagggtgctgcttctgctttctctgggcggctcttggttgatactaatctagatacttcatctcctgatacttatagacctccccctgctcctatccctttcaatgttaccttgggtaccactcaaactccacctgcggctcaagaaattcgtagtgacaagaataatacttccttgcattctacaaattctaatgcaattcaagaaccagttgctggagacaatcatgggacctcggctaagtggaagagctgaaggaatcagactgcaaagt

SEQ ID NO: 6797 - DNA, 1121 bp, Glycine max
  misc_feature (1115)..(1115): n is a, c, g, or t
attgtgccgtttatttcttgacgcccatgaggattataagggatgccattgcgggtttggggagccctgctcccattgtggtttcggaaggggcgaataccatggatgtgggaaggtctgtgttggttcagactgagccccggacgaggttggatgctggcacgtgggggaccatgggggttggtcttggttactgcattgctgctgcggttgctgagcccgggcggctcgtggttgcagttgaaggagattctggatttgggtttagtgctatggaagttgaggtacattcttgacttatgccttgtgcataataacttcttagctgtatttgtgcaatgtgtgtgtgacattttcgtttatattcctgttgctgtcctatgcaaactgaatctagtcctggaattgacatgacatatttgccttctgttggaatatattttaggatgatgttcatgaaggtgtaaatagatttgccttcttgtccttgacattttaaaaagtggttcagcaagcattagacaaaacaatagtatcccagtgcccattatctatgtatgtggatgagagactaaaaacccaagtggatgagagagtatctcaattctcatgatgcattgggcttgcttaacagtagaatatgagatacgtacatttttttggcttatgagaacttctaaacaagtttttattgtacttgtttgttgtgattatgaagttttgctgtttccggtcttatcttttcccaaagacttgaaatttttttatatctcttgttctagcctgaactgggaaaataagtttcttcgagtttgaaagtgtagtgcttgtggattttagtttatctaactggatttcttgtttaacactttgagaaattcaattttgttaaacgatttatttttgagtttataaaatacttttgttactatatgtgtatgtaaattctctccattaatatgaccatatggttccatatgtttttgctttcatttgttgttactgctgcaattaattttctgatttcaagcattccgtgtgacacattatatatctgttatctatcttttatctagacgttggtacggtaccagctgcctgtggtcgtgatgttncaacaa

SEQ ID NO: 6798 - DNA, 378 bp, Glycine max
cgccgcggcgaggacggcagcgacgaagatcacattctcatcaggaccatgccgggaagaatcaactacatcaggaagaaggaaggaaaagaagaagaagaagaaggacacatgcagaagtgctgcagcgaaatgagcgagctgaaaagccccatatgccagtgcaaagcgctacagaagataatggataaccagagcgagcaactggaggggaaggagaagaagcagatggagagagagctcatgaacttggctattaggtgcaggttgggacccatgatagggtgcgacttgtcctccgatgactgaaaaaaaagtactactaacacatatatgtgttagtttatgctagctagaagaacgtataagctatctccg

SEQ ID NO: 6799 - DNA, 377 bp, Glycine max
ctctgggcccattgcagaaggcgagtgagaaatcggatccggagcgggaagtgggcctggacctgggccggcccagatccaagttcacagcggggtgcttcacggagaagaaggcgaaagagctgagaaagaagaccgtggaaacgtcgacgtttcatgacatcatgtaccactccgctattgcatccagactcgcgtccgatgtttccaaagggtacgagaaataaatgtttggttttaattaatgttttttctacccttagactcagactcactcatcgttgtatttcgctttaatttctttcaactatgaactattggcctgttcatgatttgggactcattgtaattaatctatgtgcgtgatttgtctcctt

SEQ ID NO: 6800 - DNA, 380 bp, Glycine max
tagatttgtcgtaataattcttaaattccatagtcaaaatgatggaacaaagcattgaaccacaatgtatacactcacacacacatttgactaaataaaattcaactcaactgctacgaggagtgactctgagaagagagtttgaggcattcactctggcacctcctgaggcaaatgtcgttccagttaggcacttgatgttggttgacacagacagtgcgggcacatgcatcagcacaggcatcaagatcggaggcgccacaaacggtgacgcaggtatcaggaatggggtctttggagaaggaaccaaccttcttgagcatcctctttgaagtgcaaaccctctcacacacgaagatttcatcggaactcctttccac

SEQ ID NO: 6801 - DNA, 839 bp, Glycine max
  misc_feature (359)..(366): n is a, c, g, or t
  misc_feature (368)..(385): n is a, c, g, or t
  misc_feature (389)..(391): n is a, c, g, or t
  misc_feature (395)..(395): n is a, c, g, or t
  misc_feature (401)..(403): n is a, c, g, or t
  misc_feature (407)..(409): n is a, c, g, or t
  misc_feature (413)..(415): n is a, c, g, or t
  misc_feature (418)..(421): n is a, c, g, or t
  misc_feature (423)..(425): n is a, c, g, or t
  misc_feature (428)..(428): n is a, c, g, or t
  misc_feature (431)..(433): n is a, c, g, or t
  misc_feature (442)..(447): n is a, c, g, or t
  misc_feature (450)..(461): n is a, c, g, or t
  misc_feature (463)..(467): n is a, c, g, or t
  misc_feature (475)..(480): n is a, c, g, or t
  misc_feature (488)..(490): n is a, c, g, or t
  misc_feature (492)..(494): n is a, c, g, or t
  misc_feature (498)..(506): n is a, c, g, or t
  misc_feature (510)..(526): n is a, c, g, or t
  misc_feature (528)..(536): n is a, c, g, or t
  misc_feature (540)..(545): n is a, c, g, or t
  misc_feature (547)..(549): n is a, c, g, or t
  misc_feature (555)..(556): n is a, c, g, or t
  misc_feature (558)..(578): n is a, c, g, or t
  misc_feature (581)..(582): n is a, c, g, or t
  misc_feature (586)..(591): n is a, c, g, or t
  misc_feature (593)..(605): n is a, c, g, or t
  misc_feature (609)..(609): n is a, c, g, or t
  misc_feature (611)..(616): n is a, c, g, or t
  misc_feature (625)..(635): n is a, c, g, or t
  misc_feature (637)..(641): n is a, c, g, or t
  misc_feature (644)..(650): n is a, c, g, or t
  misc_feature (658)..(660): n is a, c, g, or t
  misc_feature (664)..(672): n is a, c, g, or t
  misc_feature (679)..(684): n is a, c, g, or t
  misc_feature (686)..(691): n is a, c, g, or t
  misc_feature (697)..(724): n is a, c, g, or t
  misc_feature (726)..(743): n is a, c, g, or t
  misc_feature (748)..(762): n is a, c, g, or t
  misc_feature (768)..(773): n is a, c, g, or t
  misc_feature (778)..(780): n is a, c, g, or t
  misc_feature (782)..(782): n is a, c, g, or t
  misc_feature (787)..(789): n is a, c, g, or t
  misc_feature (791)..(795): n is a, c, g, or t
  misc_feature (799)..(827): n is a, c, g, or t
  misc_feature (829)..(830): n is a, c, g, or t
accggaggcggacatgccggcggaggtggagggggaggcgaccatgaatcggaggacagggatcggaacagagaggaggcgctgctggttctcgccgaggcagggcggccgctggagaaattgccggcggatttagcggcggcgattggggcggggcgagtgccgggctcgattgtgaagaggttgttcgagctggaaaaatcggcagtgttccggtggctgctgaatttcggagggtttagggagaggttactggccgatgatttgttcctcgctaaggttgccatggagtgccgtgttggcatctttacaaagactaaacggccaaggattcggggaacccatatatctcttgattnnnnnnnnannnnnnnnnnnnnnnnnngccnnnctcncatttnnntccnnnactnnnctnnnncnnnganacnnncctaacccnnnnnnccnnnnnnnnnnnntnnnnncccccccnnnnnntacccctnnncnnncagnnnnnnnnntccnnnnnnnnnnnnnnnnncnnnnnnnnncccnnnnnntnnncccccnncnnnnnnnnnnnnnnnnnnnnnttnncctnnnnnntnnnnnnnnnnnnntccncnnnnnnctcccctcnnnnnnnnnnncnnnnnccnnnnnnncctccccnnntttnnnnnnnnnggtccgnnnnnntnnnnnntttccnnnnnnnnnnnnnnnnnnnnnnnnnnnncnnnnnnnnnnnnnnnnnnccccnnnnnnnnnnnnnnncccccnnnnnnccgcnnntnctccnnncnnnnncccnnnnnnnnnnnnnnnnnnnnnnnnnnnnnanncccctcccc

SEQ ID NO: 6802 - DNA, 438 bp, Glycine max
ggtgaaaaataagcacattcccatgagtcgaattgatgatgcggtgagaagaattctgtgggttaagttcatgatgggtatttttgagaatccttttgctgattacagtttggccaaatatttgggaatccaggttggctattttgtttcctcaagtgtttcctttagcttccccaagttcacaaattgatatagggatcaccttgtaactcttcaatgtttaccattttttcttaacaggaacacagaaatttggctagggaagcagtaaggaaatcaatggtccttctgaaaaatggtgaatctgctgacaagcctttactgcctcttcctaaaaaggcgccaaaaatacttgtggctggaagccatgctgataatctaggatatcagtgtggtggctggaccatagaatggcaaggagtcagtgggaacaatctt

SEQ ID NO: 6803 - DNA, 397 bp, Glycine max
caagctttcaaggcatgccctggaagtagaacttgactcacctcacatgtttgtgtagtaggtttggtgtggtgaaagacacatcaggctctacttgttatgctattactttgtgtcttttatcctttaagcattgaggatgcacacctgttatattagctttatgtaatattagttggaggaacaacatttcagggataaagtacgtggtctcgtagcttagtttggttagatattgtgttcacttgggtgattcaagaggttctggcagaaccgggttgtgttctaggagcatgcaggatcattatgatgagatggcggtgactttgtcatccgttagttgtaatttgttggttgtccatgtgccgaaactttctccttgttacccagttgtttg

SEQ ID NO: 6804 - DNA, 455 bp, Glycine max
aaatggagtgtctctagagtttggtgtgactgcttttcccgatgagatttccattgatagcttgtcaataaagcagtgtgaggaatctgaagaccagttggcatacgaggggcctgagttcatgtaagcatttcttagtgtatgcctatatggtattatctaatttttttcataaaatgtttcctatactttctgaatatttctgctccattttcttttatagtgatttggatgaaaatctgcaaaaggcttttcacaagtatcttgagatcaggggaatcaagcctagcacaaccaatttcttgcaggaatacatgtttgctaaagacaacaaggaatatttgatgtggctgaagaacctgaagaacttcgtcgagaaatgatttgttctctgaggatcgtgaaatgttgacagaggccttttctttggtatacactgtatcatgagagagtca

SEQ ID NO: 6805 - DNA, 402 bp, Glycine max
gaaaccgtgtagcttctgttccatcggagatgctttgccctgtcacttgcactccatttccatctgtagcaattcctctgtgtacatgcaacaatggtccttgtccatcatttgaaccccgggaagcagaagcacaaggtggatcgcctctccactcgcatgcttcgatgatggatcaggataaaatggatggtccgaggctggagaaaacaacatgctcaggcatgttttggggtagaagaagttgcagtcgggagcatcaatgcaattcagaaataaatgcttgacctaagaggttggtacatggccattcttattttgtggatacttcatacaatcttagatcaaaaaaggagtctatagtttatcttattaaccagcctcatatggtgaaagtccaat

SEQ ID NO: 6806 - DNA, 170 bp, Glycine max
gcacacctgctaatggtcttagtccaggtgggctatacctttttgtatttcatcactgaagcctccttcaatcatggtatgagccctcatgtgtatgtaacctatcgccatattgtggctgcggttgtgatgttcccttttgcatactttttggagaggtacacatgcat

SEQ ID NO: 6807 - DNA, 496 bp, Glycine max
  misc_feature (427)..(430): n is a, c, g, or t
  misc_feature (433)..(433): n is a, c, g, or t
  misc_feature (436)..(437): n is a, c, g, or t
  misc_feature (439)..(440): n is a, c, g, or t
  misc_feature (461)..(461): n is a, c, g, or t
attgctggaagtatcttgagtttcacacaagttaggtgatgtgttgtttgtatatcacctgagaaatggtctaccaaatcatattgttcaaggattatgtcgaatgcaatccagaaactgttgtatagcctattgtttattggttatatcttcaaaatgttgccgtaactaccagacagactacattaaattgctcaggattggaggaaactgtactcttaagtttatccttgaagctcatgatttactatattgacccatgcacaaggcatgtttctggtggattttcactatgaacaaatcacgatatggagtttttggaaataatgaatgatcgtgaaaccaaaggtggcaattctactaatgtgtacccttctcagttctcatcacaaattactacaataaaacaagtacaagtccaaatatnnnnccnctnntnncatgttagctgttccttttanatgatacttctccttgccttccgtgcgctagataa

SEQ ID NO: 6808 - DNA, 986 bp, Glycine max
tgatcgagctcgagcatttttgagcttgcaatcgctcaaccagctttggacatgcctgagctgttgtggaaggtacacaaatttatttcttgtgcaagaaaatgactgcacacacttgcatttaaatttttggcttattcttgatgtagcacagaatttacttaaattttggggttgtatggaaagggaagttatagaaatatgttgggtagctttttatttaaatataaatctcagtagctcactttagggagagccattatactaaaaacattggaaaagtaggcgataagaaaaaatattcaagccttgactttacaaaattacgaatgattaaggcattcaatgaatataagtttgggttttaacattttcattgcttttgggttcagttcagttaaaatttgagcccgaaaaacattgaatatcatctttcactatgtgtatgcacattatttttctgtttttataattgtatgatctgttgaaccctcatctttcactatgcatagacaacaaatggacttaaactcccctttatcattccttttaacttttattgttgtcttctactgcataacttgataacatttacatattggtcataatgtaactataaatttgtgaatttaaaacaggcatacattaactttgagactgctgagggtgaatttgagagagcaagagcactttatgaaaggcttcttgatcgaacaaagcacttgaaggtatggttaagttatgcagaatttgaggcaacagctatggatatggacagtttagacttaccagaagatgaacaaaagaagcaatgcattcagtgtgctagaagtatgtgaatccagtgctgtgctcttgtgctgttaattttttattgtttgttttcagtttgaatataagtggactaattttctgattctatttatatcttgttttgtgcctgcatcaggggtgttgagcaagctcttaactacttcagatcatca

SEQ ID NO: 6809 - DNA, 617 bp, Glycine max
cttctgtgaggagaacgaagatatccataatggtcaaatggtttataacgaagaggatgttcctcatccactaattcttcctctggttccatcaccttaccagcatatgaaagtagccccaaacagtatctgtctacctttgaattcatgaatacttggtgtacacaaccccgtatcctgtcattactccatacctgcaaattgagatttttaatggaagaactatcattcaatgatattcatagtatgacatttttttgtcaatcatgtatatgtttggttagcggggataataatcaattgctaatgcattagtcaaacattttacacaaaattaatagagtttaatatgcatgtactcttaagttttactttgttagtcaattaaaaattatctttcatgacttctaagataactattataaaagtcaataaatatatcgtatacgacggtttaagattagattacattataaaaaaaaattattttgtgagggcatgtattacttattcatattaatgaaaaagtttatgcatcccaacaggtagtatacaaacaaaaaagtactatgatttcataataatttgtatcattcagagtctttttttaaaaaaaa

SEQ ID NO: 6810 - DNA, 490 bp, Glycine max
gtgagagcaattggcaagataggtgcagccctcagaaattgagtgggtctgggagaagaagcatcacctgcaaattcgagagtgtgagactcagtagagcatgcagtgtggcactgactaccttgctcacaaccgctgcggtgatagcttctgtggcagcagctgatgaacccgagactctatccaacataccccagactttgtccggtgagtgcacgttgcccaaagattgcaagaaagctagaatacagaaaccaaagtcaaggaaagcggaatcatgcacaatcaagtgtgtcaccacttgcatcagaggtggagatggctctcctggggaaggcccttttaacgtgataaggtacataataaacttcctagtttcatatttgatattaaacgttcgcgatttagatatgataattatctaaatggatttttcagacctctggttgttttcaagcaagggtttcgaactcgtcaatactgtttggtg

SEQ ID NO: 6811 - DNA, 862 bp, Glycine max
  misc_feature (769)..(769): n is a, c, g, or t
  misc_feature (771)..(771): n is a, c, g, or t
  misc_feature (774)..(774): n is a, c, g, or t
  misc_feature (776)..(778): n is a, c, g, or t
  misc_feature (781)..(785): n is a, c, g, or t
  misc_feature (788)..(790): n is a, c, g, or t
  misc_feature (794)..(794): n is a, c, g, or t
  misc_feature (797)..(808): n is a, c, g, or t
  misc_feature (810)..(810): n is a, c, g, or t
  misc_feature (813)..(813): n is a, c, g, or t
  misc_feature (836)..(836): n is a, c, g, or t
  misc_feature (844)..(851): n is a, c, g, or t
tatatcccaagatacatagaaaacatagatcacaattcacacacatgcggtgacaggtgggtaatttgatgcatatatatttaagtgttactgatgtttacttctctttagccataactgtttattatttttgctttggtgggtgagactatgtgtgcgtgtacctccttgtctgtgtctctttctctctgtcccaaatctgcttctcataggtttcgggtcattgtaatcgaaaaaaaattcttctttcctttgcagtagtagtggtagtgcagcagagaagatcatgaaccacgtgcacactctaatttccatcacaccaggtactacttactactactacctactatatcattaattttttctttatataaataataatcaaatctctatctacatttctccttaacccttttctctctctctctctctctctctctcaccaaatctcttctctttataaaaaaagcctttaagtatttcacttcacccctttcatttcctccccctcctcctcctctctttcattttccaagtttttgactatgacataaaaagagtatggacatagccgaaaccaatttcatctataccttagttaatttggaacgaataaattaacataccttaaaatatcgagtgtgtttagcttttttcttccataattcattgtttctttcctccttcactttctcaggatctttgtgtgaaaaagactaaaaaattagtttcaattatcgagaattgtttgatgggttgatccaaaaancnctntnnnaannnnnttnnnaacnctnnnnnnnnnnnntnccncaaaaagtcttgaatgttaattntacctatnnnnnnnngagttattttt

SEQ ID NO: 6812 - DNA, 324 bp, Glycine max
ttctttcgcacttttgtgaggacagaacatagacgcgtaagttttttatctttgaacaacttttttctttcttgaaatttttacactcttgaagagtagtacaaaagtttgaataacaaggcctaatttcaagctttggtcataatagaaaaaattatattttttaattgccacaggtgcctcagttgtctgcaacaagtaaggcaagagtactgccatgttaagaataagtttgagacactgatcagggtaacgtgataaaaactatagttgaagaacgttctgtttcattctggagttgaaatttatatatgtttttttttt

SEQ ID NO: 6813 - DNA, 379 bp, Glycine max
tggtggtcagtgatgcagaacttcagcaggttatccatagtagcaatctcataagcaggcagcttcgatctttgtacactgctgctccttcccaagtaaacttataagcaggtggtgaaatgtaatttaaaataaaataaaaaaaacaagatttgtattcctacatgttttcactgaaatttgatatttgtagtatgttgtaattcatactattttattttaccaccgaagcatcttatttatcaactactagtaatgagtaggttataaaagttgtcaaaattgatgaattgaaaataatgcgctattttgaccgatgtgtaaatccgatcctacacactagagttaaagatggaaatggatcaggtcgtctataaaa

SEQ ID NO: 6814 - DNA, 645 bp, Glycine max
gaatagcttgaggttgacaaactataggcaatgccttctccaccgaggctgatataatgttaaagtaacattgcaaaggaaaagaaaaacatcagtataagtgtgtcttttctttggctcaattctttagaaaaataaggaattatttctatgaaaaatagtcaaaccaaatgtgtgttaagtcgagcaaataagtgaatgaaatcaatgaattaagggggaaaaaaggactaatttgttgtaaccaaacatgactagcctttgtttttcaacaagtatgtttcaagtggcacgaggagctcctcatctgatatatagaaagaatacggcaatttctcctcctaaaatgagagcatagacaattactcaatgttatttaataataataaaaataaaaataataaatgtaaaataaaatttgggaataggagaaaggggtttagttacattgtttagaagcttattaacaatctggatgaggtgttgaggaccagcattctgaggtaggtacataggagcacccaaaggagttccatcagggtctgtcaaaagacacattacgttgttgattatctccctcttctccaacatagtctctgtctcgtcctccattttacaattagggtcggaatctctctctccaac

SEQ ID NO: 6815 - DNA, 418 bp, Glycine max
gtccttaggagtttcgcaaagtccttgtaccataaggccattaattgcggcgttatcttttcatcagttttttgaagggtttgcgcttggaggttgcatttcccaagcgcagtttaaagcctcgtcagcaactataatggcttgtttttttgcactgactacacccttgggtgttgggattggaatggctatctcttcggggtataacccttacagccccggtgcactcatcgccgaaggtatcttggattccttgtcgtcggggattttggtttatatggctttggtagatttgatcgctgcggattttcttagcaagaggatgagttgtaactttaggctgcagatactgtcttactgcatgcttttccttggggctggattgatgtcttcgctcgcaatttgggcatgataaaaa

SEQ ID NO: 6816 - DNA, 378 bp, Glycine max
ctatgatggcctttgattgagcattgattaaggaagtttcggatagtacaatgggccaactatactactattctagatctatcatatagtttttcttttcttttcttgtaaataaaataatgaggatggtgccttgtaaattaagctacagcttaggggctcttttagtattattagtactattattttatcgatatggttttggaggataaaaaagttcatctggaaggttggcccaagttctggagcaattgttggaagaaaggttttcaaaatgaatgagtggggtagcgtgaaaatgggtatagaaaattgattttgttgttaggcatgctctgatgctcactcaaatgttggcacaggtaggcagaatttaag

SEQ ID NO: 6817 - DNA, 366 bp, Glycine max
attcttgcatttataactgatacgagacttcaatggaacttttattgattttgatatggcctctggtcctatttataagaaacaagttgtgatataaaatatattacaacttgtttgttataaatagaacagaagttagtactgttttgtgcatttataaatgcaatagttgtttagatattatttgttaagattaatcttttatttattttttccttcgtgtaatttccacaagagtccatattgtattcaagagtgttcaaaaaagtgttggtagcatttctcttgaatctagaaaatgttactgcaatagtttgtaggatattgatttttgaagatcaggtttgaaataggggtatcaaagtg

SEQ ID NO: 6818 - DNA, 390 bp, Glycine max
  misc_feature (160)..(160): n is a, c, g, or t
ttctaacttctgatggctgtgcgatcattctcctacgatgtgttcctcagcttccgaggggaagatactcgttatggtttcactggcaatctctacaatgtcctccgggaaaggggaattcacaccttcattgatgacgacgagctccagaaaggggacnaaatcaccacagcacttgaggaggcaattgagaagtccaagattttcatcatcgtgctctctgaaaactacgcatcttcctccttttgcttaaacgaactcactcacatccttaactttactgaggggaagaatgatgtgttggttttgccagttttttataaagtggatccttcatatgtccgacaccacacaggtagttttggagaagcactggctaatcatgaaaaa

SEQ ID NO: 6819 - DNA, 864 bp, Glycine max
tcgatcgcctccttgatcccggttcttccttcctcgagctttcacaggttttaattcttttttccaaacctacttaaatttttaatcttttgtttattgcttgagaaatacaaagaatgtcattttttaatagagttctcaataaacacttttggaggagggaaataaataagaaggaaaaatgaattaacttctcacgtaagctaaattagtttatgcataaattagaaatcacctttttgtgaagctaaacgaagagagtttctacgaattaacttatacataacttatgagagaagttaattcacttttccttctcattttcttagtacttacagagaagtttatccaaacatatcttaattagtatattaaattatgattttttcggttaatttattttttaaatttataatgatatcacttcagagtttagattactgttgaactctggtatcaggaggtttacaaaagctcacgatcacttatgtttgcaaaatttaatcggaaatgcagttagtcttggagataggtgggatcgggaattatgagaaatgggtatgtgggtttgactaggaaagcttctaacttttagtaataaagcttgcaggacattacttgtatgaagaacctttgccttctggaggggttgttactgggataggtcctgtgcatgggagactgtgtatgtttgtggcgaatgatcccactgttaagggaggtacttattatcccattactgttaagaagcacctcagggcacaggagattgctgctcagtgcaaattgccctgcatatatcttgtcgacagtggaggagcttttcttcccaagcaagccgaagtgtttccggacagagagaac

SEQ ID NO: 6820 - DNA, 409 bp, Glycine max
ttcttctactactgtagatacaattgtggttctagaacttgtactaatggatgaactcacctctgtggttggggacttattcctttgtgaatttgaatcaatcctgctgaagtactgaatttcttgcattatgagtgatgcaactgtgcctcgggttcctatttccactgggggaaattcagccttatcttttgtgtcatttgagtcaagggtagtggatttgagcatgcttttgttggttggtgttggggagaaagcaaaatcttttgatttaagggtggcttgtgggtttgttctagaggggaaactgcagggactctgaggcatttcttttgttacaaaagatgtggtttcacaagaattcttcaccttatgttctatatttgaaactgaaatgcatggcataggt

SEQ ID NO: 6821 - DNA, 1190 bp, Glycine max
tgaatgaagtagggtaccgtttggtttcaatgcagcggttcatcctcttctcacagatgatgattaccctcaaacacgtggtgctttcaccagttacaatcgtttgggttacaccttacaacaagactgagaaatgggctggtggactttatgttgatcagagccgtggagatgatactttggctgtttggactaagcagtaagatacttaactttggcaccaaattaatgtgtttcactttatgctaaatcaattgaaagactaactaacctattaaaattaaaagagtttaatggttatacaccctagtctaatcattattcgctgacaatataatttttaaaataattatcatacaaattaacaaatttaatatacatggtgggtacaaattggttggatgatgacgtaaatttttttatattgattgtataattattatttttttcaaattaaaaaaaaacatgagagaaagtggtatttttagaagaataaagattctttaattggatataactataattagttatagttcttttgttctgccgctttagttgtggacaccggtttctagttcttaattaatttataacctcatgaacctttattatgataggtgtgagtgggtgaatattaacctatctccactaaagataggagttaagtagtgtttataaaatttggacaatctttactatatataaattgattttgaggaattgatttaggcttcaagtttaaattttaatatgttttcattttaagttttaatcctttttcttattcttgaaaactgtaagttttacctagtctctgtgtatgcattaaaattaagtttggtggtaataaacttccacaaaaatctgttgagaaactaaaacttataattcttttgtacaagactatcacttaaccaaataaatgatttaaccattttaatctaattgagaagaaaacgaagggaacaagtagtgatttcagtccttaatttagtttcgtgggtatatgagctaaagctttcttgatgttgtatgattaacacttgttttgaaattgtaaaaattgcaggaatagggggattgagaacaaggatattgtgatgtggtacgtggtgggaatccaccatgttccgtgccaggaagattttccaataatgcccttgttgagcaccggattgaatgaggccaac

SEQ ID NO: 6822 - DNA, 819 bp, Glycine max
ggtctgtttatctacttattaatttgtttagttgtaatattacactcagatgactatttagcacctgatgcctagtacatcaaagcaataaaggataacataaaactgaatcctattaaaatacttatatgcccttttttaaacagggacaaacgaatttggaaaggcaaacgatattgtctctatttataaaggttatgaagaagttctacaaatatctagatggccttgcatccaaggagattgaatcaaccttgccaagactgaaagaagtaagtttcttaatgacaatttacctttgtgtattccatggcatggtgctttcactagaattcatagaaaattttggttagtgaactcacttctgctgcagtgtgtttaggaacgcaaattctaatttgtgcatccttttttatcattcactaatcttgcacctctttttctcttctcttctgggttatgttttgttttgtccctagattgtcatggaacctcatagtgtctctttggacgaagatctcaataatgcagctaaacaagttgaggtatgtgcctttatcgtttgtggaagatccctacctcaaatcccatctttgcttgttttcacctccggttttcattgctcatatcttaaatgattgtcactggataggatgacatgaaatcaaaagcagaagcaacctttactcccgaattgctccagcagtttgccattgaaggagaatctggctttgagactgttttacaaaataatggtggaaaaatacccataggtggtcttattagcgtgaaatccagcaaaggaagcagaaaaggaga

SEQ ID NO: 6823 - DNA, 417 bp, Glycine max
  misc_feature (53)..(54): n is a, c, g, or t
gtctacaattcttgcttaatattttacgtttcttaccttgacgtgttgattgnntttgtagctctcatgaaacagttgacatgcaagagcattcaaaattatcaattctattatcataaatgcaatattttctgttcctattgcctttcatcttacatgtagcagttaatttgaatattacaatttacatcctccacggaatagtatcatcattgctattattttctgtaaaagtttaggtttgctttatcttatttgttttatccttgtgttgatgattcagatcttggttcatctttctggggcatggtattgatacttgcatcaacaaatcttcttaccgctagaatagctgctggctgttttattgctgctctacttattgtcctcttcattgccaaaaatggaagggaagaa

SEQ ID NO: 6824 - DNA, 495 bp, Glycine max
tcttcactgcactcccacccctcttattattaatatcagtgcttggaaagaaaaggaagcaaaagaaaagagaagatccatagctaataagctaggttcagtagttagtgagtgatcgatatctggagatgggtcgaggcaagattgagataaagttgattgagaaccccaccaacaggcaagtcacttactccaagcgaaggaatggtatcttcaagaaagctcatgaactcagtgttctctgtgatgccaaggtttcacttatcatgttctctaaaaacaacaagatgcatgaatacattagccctggcctcacgtccgtaccctagctacactctactatcaactctttctatctcttaattgttctttccaatatatatctggaaaatcacttcttttttactccatttggttgtgacttgtaataggacaaaaaggatcattgatcagtatcagaagactttgggggatattgatctgtggcgttctcac

SEQ ID NO: 6825 - DNA, 831 bp, Glycine max
tttgagagaatttttagtgatgactttatagtggacattattggtgccttcgagtgtaagtgcattcttctgaaatttccccccatttaagtgacatgagctattcatatttagccattatgtggttttgcttttattttattttataatttgttggttgtattttagcctttcttacctgctaatagaggtttaagtttgatgtacttgatttagatgatttcatttcttcattctgaaccacttggtttagcaatatgcagatgatccagaggttccttgtgttcaacatcatcgtaaattcttaaaggagcatgttgtttttaaggaggtatggtatgttatctttttatttttggagagctgcaatataggtagatctgtactctgtagatgtggtaggaaattttacctaataatattttacctactttctcttgtaggcgatacctataaaagatcccgttgtgttgtcaaagatacatcagacatatagagttggttttttgaaggtttgactctttttatgcctttaattgccgattgttttcgtcttcaatgtgatttttaccttcccttctcactttcaggatgttgttctggcgagagtcttggatgagggtattggtgcaaatcttaactccataatacattcaaacaatgcccatgtaagatttgattaacaaggaatgaagacatatcatttaatttagtaaatgttgtccttattgttgtctgctctgctattttttaggttgtctctttgttgaaggatgacagtacatttatccaggagttgttttgctaggctaaaatcgcccaccacctctc

SEQ ID NO: 6826 - DNA, 310 bp, Glycine max
actgtgcttgtgataaacacggttttctcagtggctttgttgaagagcatgtttagatccatgctccaagtagtgtttggtggcagtgctgctagtagttcttcaaacattgaacatgatgatgaaattagttcatcatcatcatcacgggaaaggagggtgtcaataactcagtacaagtcattgtgccacagtcatgacataggaggaggaacaagtgtggctatggtggagtgctgcgtttgtttgtgtcgttttgaagacaatcaagaggttagtgagttgccttgcaagcattacttccacagag

SEQ ID NO: 6827 - DNA, 340 bp, Glycine max
aggttttgctcaatgtgcacctcgcgaaaatgagggaaagtggagtgctagtgttttggaagaacaactacaccaagcgtgacccaaatgcgccgccacggcggggccgtggcaggccacccaagcccaaggagcctctgccaccgggcactgtcttatcaccgcccaggcccaggggccgtccttcgaaggacccaaatgacctgcagaagcctcttaaggcttcggtggtgggtagtggtaggcctcgaggccggcccagaaaaatggcctggcccactggaggccttggtgaagtatcgcaggcctctaaggcgaagcctgtcactagtaatgggag

SEQ ID NO: 6828 - DNA, 645 bp, Glycine max
gcaatgggggcatatcagcctaatcatacttgggcaaagaagcaatctatacctcatggacaggcaagatttatgaacttacaagtacttttttatgacaatttttttgagaactttagtctgtagcttgtgcatataatcagaatgatataacgcacgtgtgaattgatcatcatatagaggcttgaggtagcttatcatgcacatatacataaaacaatgtagaaaataactataatgtggaaggatgttcttggatcatatcattcgtatgcattatgagaaagcaatatgatgatacatgatacattcgaaggccctttacctgattccttctgttgaaatttaataaatcaattggatttttttttccctttaagttggagaattgtgttgtgtttttcaggtgcatggttatagaatgtcactatggagcgaacatataggagccgtggaagaatgttttgaggaaccagagagccttgaatgtgtaagacggataaggtcattgagtgagtttaactggagacaatatgcagcagaagaggtaactgaaatgaaaagtcatctattaaaatatccgcttgaagttgattcaaagggcaaagtgaagcctctttttggctgtgaggcattcccagacgt

SEQ ID NO: 6829 - DNA, 377 bp, Glycine max
ttggagttaactttggatttgtgagcatcaggtagctcatttttattcaagtttgatataattttaatttgtttgttcatattttaatgtctacaagtgcaacccttaatctattagccattgatatgtcttgtctatattgttaaatttcttacacatctttttccacagccaataggtttggggaaaattgcaaagtttattaatgctgggaagatagattcttctgaactgattacaatgaaaacactaaaggttttatgactgttacctcacttcttctggaaatgcttttgcttcatgtgcttcctctcattcttctggtcattattattaccataggatgcaggggtactagggaagcaaatgaaagatgg

SEQ ID NO: 6830 - DNA, 590 bp, Glycine max
cggtttgtcaatgaccgtttattcaataacatcaagagtaagtttttcttctttcttcatcctgcaacacaaattgctatttctggaaataactttagaaattgagtgaattaccaataacccctcttttgtcttcacttcaccatttaaaaaccatttttttcacctttgcatccaaagttcacaccattcttaccttcctatgtagcaagagttttgtagctggttgatatgttttactgacttaatggttgatcttaatgcagagtttacttcagaaaataatggaatgtcagctgatgttatcaataaagcattcttggcaactgaagaagaatttctttctttggtagagaagctgtggctgcacaagccgccgatagcatcagttggttcttgctgtttgataggcataatatgtagtggggagctctatattgcaaatgcaggagattctcgagcagtattaggtagactggatgaggctatgaaagagattaaagctattcaactatccgtggagcacaatgctagccatgcatctgtcagagaagagttgcactcattgcatcctaatgatcctcagattg

SEQ ID NO: 6831 - DNA, 441 bp, Glycine max
aaagcttttcagttttcaatttttcatcctatcctgtctgaattttctctcttaatatatataacttacatatgaaggtagagtgatatcatgaagaagcaagtctgagtacaagtttcataaaaagaggagttacctttgtatcactagttcaaagttcaccttctcagaagctacatagatacactgatggagaagcttgtaaggtcctgtgacaaagaatatatgaggatggccatgttaaaacacgaagaaactttcaaagagcaggtacttcttctctttctatattccttcagaatattcttcctcaatcaggattactagagcctgaaattcatgagaatgtttttcacaggtatatgagcttcatcgtttgtaccaaattcagaagatactgatgcaaaacatggatgccagaagaggaattgaagtgaccaa

SEQ ID NO: 6832 - DNA, 1468 bp, Glycine max
  misc_feature (406)..(414): n is a, c, g, or t
  misc_feature (423)..(423): n is a, c, g, or t
  misc_feature (425)..(428): n is a, c, g, or t
  misc_feature (431)..(432): n is a, c, g, or t
  misc_feature (434)..(439): n is a, c, g, or t
  misc_feature (442)..(442): n is a, c, g, or t
  misc_feature (444)..(447): n is a, c, g, or t
  misc_feature (449)..(454): n is a, c, g, or t
  misc_feature (460)..(460): n is a, c, g, or t
  misc_feature (463)..(465): n is a, c, g, or t
  misc_feature (467)..(467): n is a, c, g, or t
  misc_feature (469)..(471): n is a, c, g, or t
  misc_feature (480)..(485): n is a, c, g, or t
  misc_feature (488)..(491): n is a, c, g, or t
  misc_feature (493)..(502): n is a, c, g, or t
  misc_feature (506)..(517): n is a, c, g, or t
  misc_feature (519)..(519): n is a, c, g, or t
  misc_feature (526)..(551): n is a, c, g, or t
  misc_feature (553)..(556): n is a, c, g, or t
  misc_feature (560)..(565): n is a, c, g, or t
  misc_feature (567)..(567): n is a, c, g, or t
  misc_feature (571)..(574): n is a, c, g, or t
  misc_feature (582)..(595): n is a, c, g, or t
  misc_feature (597)..(616): n is a, c, g, or t
  misc_feature (618)..(619): n is a, c, g, or t
  misc_feature (621)..(626): n is a, c, g, or t
  misc_feature (632)..(640): n is a, c, g, or t
  misc_feature (642)..(649): n is a, c, g, or t
  misc_feature (658)..(659): n is a, c, g, or t
  misc_feature (662)..(694): n is a, c, g, or t
  misc_feature (702)..(708): n is a, c, g, or t
  misc_feature (712)..(717): n is a, c, g, or t
  misc_feature (723)..(723): n is a, c, g, or t
  misc_feature (731)..(744): n is a, c, g, or t
  misc_feature (751)..(753): n is a, c, g, or t
  misc_feature (755)..(759): n is a, c, g, or t
  misc_feature (768)..(773): n is a, c, g, or t
  misc_feature (776)..(782): n is a, c, g, or t
  misc_feature (788)..(789): n is a, c, g, or t
  misc_feature (792)..(797): n is a, c, g, or t
  misc_feature (807)..(812): n is a, c, g, or t
  misc_feature (817)..(832): n is a, c, g, or t
  misc_feature (835)..(846): n is a, c, g, or t
  misc_feature (855)..(859): n is a, c, g, or t
  misc_feature (861)..(866): n is a, c, g, or t
  misc_feature (869)..(869): n is a, c, g, or t
  misc_feature (871)..(880): n is a, c, g, or t
  misc_feature (890)..(890): n is a, c, g, or t
  misc_feature (899)..(910): n is a, c, g, or t
  misc_feature (912)..(920): n is a, c, g, or t
  misc_feature (923)..(926): n is a, c, g, or t
  misc_feature (929)..(941): n is a, c, g, or t
  misc_feature (947)..(954): n is a, c, g, or t
  misc_feature (957)..(959): n is a, c, g, or t
  misc_feature (963)..(964): n is a, c, g, or t
  misc_feature (971)..(973): n is a, c, g, or t
  misc_feature (982)..(984): n is a, c, g, or t
  misc_feature (986)..(990): n is a, c, g, or t
  misc_feature (994)..(998): n is a, c, g, or t
  misc_feature (1000)..(1005): n is a, c, g, or t
  misc_feature (1011)..(1016): n is a, c, g, or t
  misc_feature (1019)..(1028): n is a, c, g, or t
  misc_feature (1030)..(1036): n is a, c, g, or t
  misc_feature (1038)..(1038): n is a, c, g, or t
  misc_feature (1040)..(1040): n is a, c, g, or t
  misc_feature (1045)..(1055): n is a, c, g, or t
  misc_feature (1060)..(1061): n is a, c, g, or t
  misc_feature (1074)..(1077): n is a, c, g, or t
  misc_feature (1079)..(1094): n is a, c, g, or t
  misc_feature (1108)..(1110): n is a, c, g, or t
  misc_feature (1116)..(1121): n is a, c, g, or t
  misc_feature (1129)..(1134): n is a, c, g, or t
  misc_feature (1136)..(1140): n is a, c, g, or t
  misc_feature (1145)..(1150): n is a, c, g, or t
  misc_feature (1153)..(1168): n is a, c, g, or t
  misc_feature (1173)..(1186): n is a, c, g, or t
  misc_feature (1188)..(1191): n is a, c, g, or t
  misc_feature (1193)..(1197): n is a, c, g, or t
  misc_feature (1199)..(1203): n is a, c, g, or t
  misc_feature (1210)..(1224): n is a, c, g, or t
  misc_feature (1226)..(1236): n is a, c, g, or t
  misc_feature (1243)..(1248): n is a, c, g, or t
  misc_feature (1250)..(1259): n is a, c, g, or t
  misc_feature (1261)..(1268): n is a, c, g, or t
  misc_feature (1270)..(1273): n is a, c, g, or t
  misc_feature (1275)..(1288): n is a, c, g, or t
  misc_feature (1290)..(1296): n is a, c, g, or t
  misc_feature (1305)..(1314): n is a, c, g, or t
  misc_feature (1316)..(1325): n is a, c, g, or t
  misc_feature (1327)..(1327): n is a, c, g, or t
  misc_feature (1333)..(1341): n is a, c, g, or t
  misc_feature (1343)..(1358): n is a, c, g, or t
  misc_feature (1361)..(1363): n is a, c, g, or t
  misc_feature (1365)..(1380): n is a, c, g, or t
  misc_feature (1382)..(1386): n is a, c, g, or t
  misc_feature (1389)..(1393): n is a, c, g, or t
  misc_feature (1397)..(1400): n is a, c, g, or t
  misc_feature (1402)..(1408): n is a, c, g, or t
  misc_feature (1411)..(1416): n is a, c, g, or t
  misc_feature (1421)..(1435): n is a, c, g, or t
  misc_feature (1441)..(1444): n is a, c, g, or t
  misc_feature (1446)..(1450): n is a, c, g, or t
  misc_feature (1452)..(1452): n is a, c, g, or t
  misc_feature (1457)..(1457): n is a, c, g, or t
  misc_feature (1460)..(1465): n is a, c, g, or t
atgacaaacatgaacatgagggcagatcctgcgacaggttaccctggtagaacatacagattttataaaggggaaactgttttctcttttggagatggaataagcttctcaaatattgagcacaaaatagttaaagcacctcaattggtgtctgttcctctagcagaagatcatgaatgccgttcctcagaatgcatgtcacttgatgttgctgatgagcattgccaaaacttggccttcgatattcaccttggggttaagaacatggggaaaatgagcagtagccatgtagtgttattgttctttactcctcctgacgtgcataatgctcctcagaaacacttgttgggttttgagaaagtgcacttgccaggaaaatcagaagcacaggttaggttcaagattnnnnnnnnnttcttcaantnnnngcnntnnnnnntantnnnncnnnnnntcattnatnnntncnnntaccttatnnnnnnacnnnntnnnnnnnnnnccannnnnnnnnnnntncattctnnnnnnnnnnnnnnnnnnnnnnnnnncnnnncttnnnnnntncccnnnncaccatannnnnnnnnnnnnncnnnnnnnnnnnnnnnnnnnncnnannnnnncttctnnnnnnnnntnnnnnnnncacctccgnnctnnnnnnnnnnnnnnnnnnnnnnnnnnnnnnnnnttaatttnnnnnnntatnnnnnnattctntcatttcnnnnnnnnnnnnnnaatctcnnncnnnnnccctacttnnnnnnttnnnnnnntttccnnccnnnnnnctatccctcnnnnnngatcnnnnnnnnnnnnnnnntcnnnnnnnnnnnncctactctnnnnncnnnnnnctncnnnnnnnnnnttcttctttnctctccttnnnnnnnnnnnncnnnnnnnnntcnnnnctnnnnnnnnnnnnnttttcnnnnnnnntcnnnttcnnatcctcnnnttcttttcnnnannnnnatcnnnnncnnnnnnttttcnnnnnntcnnnnnnnnnnannnnnnncntnccaannnnnnnnnnnccccnnttaatcctccacnnnntnnnnnnnnnnnnnnnnctctcttttctttnnnttatannnnnntatactcnnnnnncnnnnnacccnnnnnnatnnnnnnnnnnnnnnnnttctnnnnnnnnnnnnnnannnncnnnnncnnnnnactgtcnnnnnnnnnnnnnnntnnnnnnnnnnntcccctnnnnnntnnnnnnnnnntnnnnnnnntnnnnannnnnnnnnnnnnncnnnnnnntcatacccnnnnnnnnnncnnnnnnnnnnancacatnnnnnnnnntnnnnnnnnnnnnnnnntannnannnnnnnnnnnnnnnntnnnnnatnnnnnctcnnnntnnnnnnnaannnnnntccannnnnnnnnnnnnnncttacnnnnannnnncntacantcnnnnnntac

SEQ ID NO: 6833 - DNA, 529 bp, Glycine max
actaccaatccagaggaagaacagagagaataataaaacaaaattttagatttaacaaaacaaacaaactcggacacaccaaaattacttccctaggaagagacaaaaacaaccccaaaaaaggggagagagggacaaaaaaatagaaggactacattttacatgcaaaccaaacctatgaaagtacaaataacaataccaaaaaacaaaaccaatcaagagactttgggataataagccatgcaacaaatgattacaaatcactaatcagctagcgtttgatgtgtttgactttgttccaccccttcttgcatgaatctcccacaatcttcacccctttcttgagcaagaccttgagctccttggctctatccttcatctgctgttcaaaaaaataagaagattatcattatatatagtcacatgattattgtggcaaggactttgttgtttattctttgactttaccgtttagtttttgttggggtgttttcaattactctttgatgtactttggggtgaatcattg

SEQ ID NO: 6834 - DNA, 366 bp, Glycine max
ttggcaaaagccaaatgtggatgcaactatatatggaagcatttgtcaactcaaagagaatatttaaatgagcatgaatgtattgttttgtgatggattttgtattacattgttgtatgtatatatgtcaaaatataagccactaagcaattggactaataactcccaaaaacactcactacagtactgcctgatggacactacaacattgtggccaaaaatgagaggaacactgtttttggaagaaaaaaaaatcattaatggaatggaataagtgtggaagggatacaaagggagtggaaggaatgaaacaaagctagctttattcttgcttggaagattgatgagggattaggaatggaacta

SEQ ID NO: 6835 - DNA, 384 bp, Glycine max
gggggggataaagagttactgccaaggagggtggttacccttgatggtattttcataaaggacgtggcatgtggcggtgtacacacatgttctgtaactcagggaggagcactttatgcctggggtggtggtcggtctgggcagctagggcttggcccccaaactggattattctcgtgtgttgctaatgactctcagacatttttccgaaacattccagttttagtagttcctaaaggtgtgcaacttgttgcatgtgggtattctcacacccttatctctatgagtgatggtcgaattcatggatggggttacaataattatggtcaggcagccaatgagaaatgtacatatgcttggtatccatcaccaattgactggtgt

SEQ ID NO: 6836 - DNA, 385 bp, Glycine max
  misc_feature (51)..(52): n is a, c, g, or t
  misc_feature (375)..(377): n is a, c, g, or t
atcagggtggtgatgcgattccaggggtttgggagttcgtagaagaaggtnntatacctgtcggagagagagcaacagatgaacaaaaggctgctgatagagaaaaagaaaaaaaaaatggcaaggcacttttcattttgcaccaaagggaaaatgctgctaactttgaaaaaataccatgggcccaaacccccaaaaaaccaggggacattctgcaaaaatcccaggagggacccccaaaaaccaaaaaaaccaagctgcaaactctgaggagacaatatgaactactacaaagggaaaaaaaggaatcagttgctgattccttcccaaaagggcaaacgggggggaattcaaggaagggctatggagaaaaannnacggggca

SEQ ID NO: 6837 - DNA, 395 bp, Glycine max
aattttgctgtagaagaagatcctactgtaaacagagtatggatgcctaaaagggactgccctggactggctatggcaagagcctttagaaatttttgcctaaaagactatggtgtcgcctcagtccctgatgtgtcttaaagaaaacttaccaaggaggataagtgtgtggttttggcttctgatggggtaagcattttcatatcaggatgtcaacttcgaattttggattttgattcttgagtaatcagttacaggaacagaacaatcattgttagtgtttaagttatgctcaattctcgtattcctctcaatccaaatatgtttgcaaatatttgatcaaatagtgtaagaaaagaaataaccaagaaggttaaatgaattaacagcatgta

SEQ ID NO: 6838 - DNA, 895 bp, Glycine max
tggccagcgcgtgcttggtgttcttgccacttcacgatccataggttagtttgaacattcaattcttcatattcactatactgctggttgctaatattaaattattaatcgttaactaagaccttttaatggtgtttcttcggtgttatgtgtgttgtgtttatccttttggtttgccatttttttaacatatcgtttttatcagctcagcactgtaaaagcagaagaatctcagcaccctctggcttatttagagtatagcagagcaacattgacaaaaaaagaatgagtactattattatcggcatcctctgactttaaatttgattatctacaattattaccttttaaatgttgaaccaaacaagatgacacactgttgcttagatccgcccatctgaaaggaatccaacagaatgtaattaacaatgatttttctatgtaaaacaagtttgtcttagttgtttttatgcatatcgcagaactggttttaaatttaagagtttttggtaaagtatctgttatttgaagtgttaaacttgaaggttggacagtatattgatgattcaaaaccttggacaattgtccccaagcttccacatgctttttctcctaacaattgcttctcttgtatggtcaaacacgtcgaactcttaaataataaatggagagaattttgtggtatggatccggtttaccacaagattaaggaatctcgatctatcaaattgcatggaaactttaatccccacatgcttaaatagtcaaacttgaatatttaaatttttgcatcgttaataaaatggtaatattgaatatgcgtattattgatgaaacagatctagaaaggactaatataaaccatcatctttagcaagacttggctgtatttgaa

SEQ ID NO: 6839 - DNA, 1071 bp, Glycine max
  misc_feature (394)..(394): n is a, c, g, or t
  misc_feature (442)..(444): n is a, c, g, or t
  misc_feature (563)..(563): n is a, c, g, or t
  misc_feature (1039)..(1041): n is a, c, g, or t
  misc_feature (1061)..(1064): n is a, c, g, or t
  misc_feature (1066)..(1067): n is a, c, g, or t
cacttgttgagattggctaggaaactttggctgcctgcttttttctttcttaccgtttgtcaaacttggacgactcaattacaaatattattcattaaacttactctattcctcctcagtacaaagcccaaccctttctctgtctatgtatttgttgataaggtcagatactgcattaataatttgacactgtaaactaaagaatgtacctgaattatctctgttgcctccccccacccccaaaaaaaaaaaattcccaccaccttaaaattttttctgcttcaagctttcaacatatttctgtggttaactcttgatttttcgttatgtggcaatgatttttgtgaccttattcttaaccatatatgtttttgaacattgataatgtttttgncatcttattttactgacaatgtgttgtttataatgtcttatattgcannngtgccaacaacatatgcgccaagaaactcgattcttttaaagcaaaggtgcatggctatctcatatatttggttatgtatggaaatctaataaactatttcagtttccccccttatatnctaatattatttcatgataaactggttgaataattgaatttcctttgcagttcctgtagcatttaatcacatattgtctagaaaccagcattttttcttatctgcagccttctgaaagcaaaatggcgaagcctaaagttagcatgttcaatcaaactaacttgcatgttcaatgatactataatcagatattcggatgtaataatgttgcattgatatagttgatcttctatgttgggaaaacaagtatcatactcagaatttatactttatagtgatcattatcatcatcatcaaaatcaaaatacaggacatttcagatcatactcatgctctgaatttcagtgatcccgacaactaggaacatttttgctgggtgactattgcctctgacatctggtgatccttttatctgcagtcactttatgccagcaaaatcgaagtgcaggactataagcttctttgcttggctgatnnnaaggagagacaaaagtcacnnnngnnattt

SEQ ID NO: 6840 - DNA, 390 bp, Glycine max
agtaagggtagttaaaaagcagcattctttgatgcattcgggaataactgtgaatttactccctgttagctctaaatttatcacatttacaaaacatgagagaaatagcggaagaagctcatctgacagttccaaagtaagaaattgaatgcttgaacacacaactgaggtcaatttcaaaacatcgtcaggcaatagcctccattgcaaactgctagctgaaatataatacagttctggcatcatgcagatgttcgaaacgagggtggcagcatcaaagtccattaactcacgacgtccgtgtctcagaatcaacttttgaagccgagtaagatttcgaaatgaaggtgggagttttgttgtggcacaaccagtccaggaaagttgtgt

SEQ ID NO: 6841 - DNA, 912 bp, Glycine max
  misc_feature (579)..(581): n is a, c, g, or t
  misc_feature (586)..(590): n is a, c, g, or t
  misc_feature (599)..(599): n is a, c, g, or t
  misc_feature (609)..(620): n is a, c, g, or t
  misc_feature (625)..(626): n is a, c, g, or t
  misc_feature (628)..(628): n is a, c, g, or t
  misc_feature (631)..(636): n is a, c, g, or t
  misc_feature (643)..(654): n is a, c, g, or t
  misc_feature (657)..(661): n is a, c, g, or t
  misc_feature (667)..(678): n is a, c, g, or t
  misc_feature (684)..(684): n is a, c, g, or t
  misc_feature (686)..(686): n is a, c, g, or t
  misc_feature (689)..(690): n is a, c, g, or t
  misc_feature (697)..(701): n is a, c, g, or t
  misc_feature (703)..(711): n is a, c, g, or t
  misc_feature (716)..(723): n is a, c, g, or t
  misc_feature (725)..(733): n is a, c, g, or t
  misc_feature (736)..(737): n is a, c, g, or t
  misc_feature (739)..(750): n is a, c, g, or t
  misc_feature (752)..(758): n is a, c, g, or t
  misc_feature (761)..(766): n is a, c, g, or t
  misc_feature (771)..(803): n is a, c, g, or t
  misc_feature (822)..(827): n is a, c, g, or t
  misc_feature (830)..(834): n is a, c, g, or t
  misc_feature (836)..(849): n is a, c, g, or t
  misc_feature (851)..(851): n is a, c, g, or t
  misc_feature (855)..(855): n is a, c, g, or t
  misc_feature (859)..(861): n is a, c, g, or t
  misc_feature (863)..(863): n is a, c, g, or t
  misc_feature (868)..(868): n is a, c, g, or t
  misc_feature (870)..(878): n is a, c, g, or t
  misc_feature (880)..(881): n is a, c, g, or t
  misc_feature (885)..(889): n is a, c, g, or t
  misc_feature (894)..(909): n is a, c, g, or t
tcttcaccaccaaaaaggttaatgtactcataacataactctctctagcactatcatgattacacatttgtttcactatttcttgtttatatattgttcaagcaaacttcaacagcatcaagtgtgtctaaatctaactaactgaccctttgttttggtaatgttatctcatttcagaaaataatggcaatggccagtgcaacaactctagccacaatcactgttgtggcggctagccccagtgttggcagcagaaggagtgggaagaggaatgtgaacttcatcagagggttgaattcttttggagggttgaaggctcagaacaatgtgacattactaggccttcctgtgtgcactgagcagtgctttgcaaaggtggtgagctcattgaaatatccatcatcatcatcacgtaaggggagaggtggaggtgctgccttttcaacatgcaatgctgctggtgagattttccagattgcagccatcatgaatggccttgtgcttgttggggtggcaatagggtttgtccttcttcgagtcgaagcgtttgtggaagagtctgagtgagaattgcactcnnnctcgnnnnncccccctcntacctccccnnnnnnnnnnnnccatnntnttnnnnnncccattnnnnnnnnnnnnctnnnnntcctcnnnnnnnnnnnncccccncnacnnccctccnnnnntnnnnnnnnnccccnnnnnnnntnnnnnnnnnttnntnnnnnnnnnnnntnnnnnnnaannnnnnccgcnnnnnnnnnnnnnnnnnnnnnnnnnnnnnnnnnactctttcccttcctcccnnnnnntcnnnnncnnnnnnnnnnnnnncnctcncccnnncnccacncnnnnnnnnncnncccnnnnnccctnnnnnnnnnnnnnnnncct

SEQ ID NO: 6842 - DNA, 204 bp, Glycine max
aatgctcacggttatattgtttgtcgtcataggccttgcttactgacacctgtcccaagcctatatgcgagaacaattggctctatatatgtatctaagacactattttgggatttgggaccttgctatgtgccattttttttaatggtgtagatgtctagtttaagaaggatattttttggcttggatttatggatttacctg

SEQ ID NO: 6843 - DNA, 358 bp, Glycine max
atttgaggaggtagcaccttgcactagcttcctgcaaggaggctcaaagcagccctcggtggcgtgttgcaatggaatcaagaaactaagtggtgaggctgggacccaccaaaaccgaacagctatatgccagtgcctcaaggaaggactggcctccattggaaattatgatcctaaacgtgtacctcaagttcccaaagattgtggactgtctgctacacttcctcctattgacaagaatactgattgctctaagtaagcttcttctttcctctctttcagattcaatttcttattatgcttcaactttggatataacttatgaaaatcatggtaactatttttcattttttttttt

SEQ ID NO: 6844 - DNA, 1267 bp, Glycine max
caaaaaggattaggtaatgagtcattttataattctgattttgattttgtctctattgccccccgtatgtcttgttcttttgtccatatcccttgaatatatatcagaagtttgatatcaattgactctgcgttgcatcttcagtacaaaggagcgtgagttgcttgaagaacttgcttctctaggtgacacaagcagacgttcaaaatcccgtcctaggactcactcttccagtaggtggcttttttattattgacatatttgttagtttttttccccctacctatcctacaatctataggaacatttagtcatttggcaactttaatcttttatgtaacatgacatttggctaggtctttgcaacacatttccaagttgcaatggagaaatctcacaatgcaatgagtagacactatatttgagttgtgaaccactgaaccatatttttaccttctgcagcaggtggtacggaaagtccgaaagctcaaaaggatgaaagtccaacatcaacagtcgaagaaaaaactgaaaaatcagaagatgaaaatgatgtatggaataaattgaaggactttgctgggtaatcattttctcttattttatttttatttgttttttcataaatgtgtagagagagccttcaattttcaaaaattgaaaactttaattctgacttaaataactaatttctgcagagcagcactcctctttttatggtataaaaacaatcaaaataaagcatttcagttttagtagcatttaaagaatccttaatatacaatgagcttttaaaaggacttatagttctgttttagataagtttgagcacagattatgttctttacgtactttagtgctatttttccaagtaagaattgatttttttttcaagagtgtatttttcattgagttgataacttggaatggagattgtagctactatgttgatgctttttattattgttcagagtcctcccaaatggtttgacaagaaaagaaatgctaaactggagtagtttatctttgcaaattgatagattgttttagatatgccgtttattgtaactttataggatgctaaattgccaaaaaaaaaattgtactggtcctactattagattgaaagcttcctcattggtcattgttttgttcatgtgtcaagttgactgaaacttaccaccactgaaacttgcagatctgtggcaaatggagctttaaagtggtttaaagataatctctagtcctatggggttgttgggtggag

SEQ ID NO: 6845 - DNA, 311 bp, Glycine max
tataatactcgcgctatagctccccctgttcttcctcaatgaccagatacttatggttttggagacaaatttttccgggcagtaaattaaaattatgactcatttattgtagagccttatttgattcatcatcaagattaatgatgtactatgccctgaaacttatcttgggttattcttcctccaccatttggagtgggactagtggttttgttatgaggcactaattgggctgatataaacatgggtatactgtaatatagagaatgtggtttagtcagcatgagctactagtaattgtgtttactagt

SEQ ID NO: 6846 - DNA, 409 bp, Glycine max
catcaggggaccatcaccattgatccatcaatggatagagttttgtctgcaatctgcaagagcactcccctttaagcaggaggtgatcccaggtgcctctccctctcatcttcaaggtcattcggccaatgtgcccgtggagttaaccaagggtgggccgaggataaatggcaacctagttgatggagcacctccaccagacatcttagaaaagtgtgagtttctagagccattatctaattcaacattgtcagattaccactggttgcttacctctatccaggaacctggccatggattgatacacaaaatgtatcagaatatcatatcagtggctaaattttctggatggtttaattcaaagcttacttgagtcactgtgctgtggaatacatatcaaggatccgat

SEQ ID NO: 6847 - DNA, 370 bp, Glycine max
tgctttgaaaaatgggatccaaggttgttgcatccgttgcccttctcctctccatcaacattcttttcatttccatggttagctccagcagccactacgatccacagccccaaccttctcacgtcactgctcttattacacgacctagttgtccggatctgagtatttgcctcaatattttaggcgggtctctaggaaccgtggatgattgttgtgccctcatcggtggtcttggtgacattgaagccattgtgtgcctttgcatccaactcagggccctcggaatattaaaccttaaccgtaatttgcagttaatattaaactcctgtggacgaagctacccgtcaaacgccacttgcccccgaaccta

SEQ ID NO: 6848 - DNA, 363 bp, Glycine max
gttctgtcactgataaatgggatgttttctcatttggtttggttctgctacgagttgtgtgtggaatggattatttcataatggcagcagagaggaaacgtatggagaagcctgttgaagagaatattgatttgaatatcaaaggaaagattgcaccggagtgttggcaagtctttacagatatcatggtcagatgcttggagtatgaaccagatgagcgaccagcaatgggtgaagtggaggtggaacttgagcatgctctgtcgctgcaggaacaagcagatatcacaaacactgatggtgattataccttattgtccaaaaccattattcccattgcccgtggtagtgaaatgaaagagt

SEQ ID NO: 6849 - DNA, 348 bp, Glycine max
tctataacaaccatgatgctcctcctccacctctacttaaagacctgaaggtgaccatccacaatgcctccatgatttttccatccaaagagattgagagaaagtcccttttcttgtcaaacattgacaaggtcctcaactttgatgtggaaacggttcacttctttggtgcccacaaagattttcctcctcatgttgtgaatgagaggctcaagaatgccctagaggatgcccttgtggtttatgacttcttgggtggaagattgaagctaaactatgacaccaaaagattggagatggattgtaatccagagggagctggattcgtggtggcttccagcgagtaca

SEQ ID NO: 6850 - DNA, 378 bp, Glycine max
acatggcaaagggcaaccacgacaccgccgggcctagaatcgagactgccacacacatcaccagtgggcccgggactgacaatgctatgtactctaacactgggcctgggactgagactgccacgtacaccactagtgggcttgggcatgacaatgctatacccaccagcactgggcctgggactgccacatataccacaaggcctgggcatgacaatgctatacccataagaactgggcctgggcctgggcctgagactgccacctaccccactggtgactatggacaaatgggggctaaccagggccatgagcatggacccaggcaaggaggactcactgaagatgtaacggcccaaaatacccttgttgcaggtg

SEQ ID NO: 6851 - DNA, 1289 bp, Glycine max
  misc_feature (722)..(724): n is a, c, g, or t
  misc_feature (727)..(727): n is a, c, g, or t
  misc_feature (733)..(736): n is a, c, g, or t
  misc_feature (741)..(742): n is a, c, g, or t
  misc_feature (755)..(755): n is a, c, g, or t
  misc_feature (757)..(763): n is a, c, g, or t
  misc_feature (771)..(771): n is a, c, g, or t
  misc_feature (773)..(795): n is a, c, g, or t
  misc_feature (797)..(800): n is a, c, g, or t
  misc_feature (807)..(810): n is a, c, g, or t
  misc_feature (812)..(815): n is a, c, g, or t
  misc_feature (825)..(826): n is a, c, g, or t
  misc_feature (828)..(829): n is a, c, g, or t
  misc_feature (831)..(831): n is a, c, g, or t
  misc_feature (841)..(842): n is a, c, g, or t
  misc_feature (844)..(845): n is a, c, g, or t
  misc_feature (853)..(854): n is a, c, g, or t
  misc_feature (857)..(857): n is a, c, g, or t
  misc_feature (862)..(863): n is a, c, g, or t
  misc_feature (870)..(878): n is a, c, g, or t
  misc_feature (880)..(882): n is a, c, g, or t
  misc_feature (885)..(887): n is a, c, g, or t
  misc_feature (889)..(890): n is a, c, g, or t
  misc_feature (892)..(893): n is a, c, g, or t
  misc_feature (898)..(900): n is a, c, g, or t
  misc_feature (911)..(919): n is a, c, g, or t
  misc_feature (921)..(923): n is a, c, g, or t
  misc_feature (925)..(939): n is a, c, g, or t
  misc_feature (941)..(942): n is a, c, g, or t
  misc_feature (944)..(950): n is a, c, g, or t
  misc_feature (952)..(954): n is a, c, g, or t
  misc_feature (959)..(969): n is a, c, g, or t
  misc_feature (974)..(989): n is a, c, g, or t
  misc_feature (991)..(993): n is a, c, g, or t
  misc_feature (996)..(1000): n is a, c, g, or t
  misc_feature (1002)..(1006): n is a, c, g, or t
  misc_feature (1013)..(1014): n is a, c, g, or t
  misc_feature (1019)..(1025): n is a, c, g, or t
  misc_feature (1027)..(1034): n is a, c, g, or t
  misc_feature (1037)..(1050): n is a, c, g, or t
  misc_feature (1052)..(1057): n is a, c, g, or t
  misc_feature (1059)..(1064): n is a, c, g, or t
  misc_feature (1066)..(1071): n is a, c, g, or t
  misc_feature (1076)..(1077): n is a, c, g, or t
  misc_feature (1079)..(1086): n is a, c, g, or t
  misc_feature (1088)..(1094): n is a, c, g, or t
  misc_feature (1096)..(1096): n is a, c, g, or t
  misc_feature (1098)..(1111): n is a, c, g, or t
  misc_feature (1113)..(1113): n is a, c, g, or t
  misc_feature (1115)..(1116): n is a, c, g, or t
  misc_feature (1118)..(1120): n is a, c, g, or t
  misc_feature (1122)..(1127): n is a, c, g, or t
  misc_feature (1129)..(1130): n is a, c, g, or t
  misc_feature (1135)..(1144): n is a, c, g, or t
  misc_feature (1146)..(1162): n is a, c, g, or t
  misc_feature (1167)..(1186): n is a, c, g, or t
  misc_feature (1188)..(1194): n is a, c, g, or t
  misc_feature (1196)..(1196): n is a, c, g, or t
  misc_feature (1198)..(1218): n is a, c, g, or t
  misc_feature (1223)..(1238): n is a, c, g, or t
  misc_feature (1240)..(1243): n is a, c, g, or t
  misc_feature (1246)..(1250): n is a, c, g, or t
  misc_feature (1254)..(1254): n is a, c, g, or t
  misc_feature (1256)..(1267): n is a, c, g, or t
  misc_feature (1271)..(1286): n is a, c, g, or t
aggtgctatgctaaggtactcagcaaaaccattagtattttcagattgaagtctatccttgagatcgtgggcctaaattacatatatatgagacttgctcaggtactggaaacgaggaaaacttgaaagtgattaatgatcttcagtcaaagttagaagttgcaaacgtagagttaatttctgaaaaagagaaggttgtactcatttatggcttatattacattacatttctctattagttgaatatcatacattctttactaataattttttatttgcaggctcaaatgcttgttgcagaaaatgcaaaacttcaataccgaattattcatcttctgagagcactcaaggaagctgatctgaagttagaaaaagtgagtatggttgttttttctttcaattcttgtaaaaatacatgttgattaattggtagaagcttgtgtaataataagtctgtattatttgagtcagtatgggtgtagaagttttctaccatattgccatacaataattaggattatatatttcgtgtagaaatgagacctaattttctttttcttggctacacttttgagaaacatatggttcaacatattgtgcattgtttaaggtgttgcttgaagtccaaattaggcattatatgtgtttataaaaaagaataaaattaatatcacttgaaaatttaagacaagaaccatgatagaaagactagcttggtaaannnagncctgcnnnnaaagnnagctttatgtgcnannnnnnntttttttncnnnnnnnnnnnnnnnnnnnnnnncnnnncgcctannnntnnnncccacccagnncnngntccaaaactnntnncccttatnnctnataannttcccannnnnnnnntnnnatnnngnngnnttttnnnaccctatccannnnnnnnnannncnnnnnnnnnnnnnnntnncnnnnnnncnnntctcnnnnnnnnnnnccacnnnnnnnnnnnnnnnncnnnccnnnnncnnnnnccccccnnttccnnnnnnnannnnnnnncannnnnnnnnnnnnngnnnnnncnnnnnngnnnnnntccanncnnnnnnnntnnnnnnntntnnnnnnnnnnnnnngntnncnnncnnnnnncnnccccnnnnnnnnnngnnnnnnnnnnnnnnnnnccctnnnnnnnnnnnnnnnnnnnncnnnnnnntncnnnnnnnnnnnnnnnnnnnnntctcnnnnnnnnnnnnnnnngnnnngtnnnnncccngnnnnnnnnnnnncccnnnnnnnnnnnnnnnntcc

SEQ ID NO: 6852 - DNA, 628 bp, Glycine max
ctttagagagccagcaggctgttccacatcatgattacctttgctgcctatagaatacacagttattagctcctttaagagccaaaaacctgcacagtactcttaatgcattcatacctttgtgcatgtctttctcaatcaacttgcaaggaatctgtgataatttagatggctccacctacaagtgaaacattgccaatataatgacatttttttaaaaaatacaccagaaaacaaaataaacatgtggccatactatggtgcaacagagaagaaagtaggtagataccaattttatttcatcaattccagtaattatattgtattctttagtattacaataagacttttctccctcacatacaacaacacttactctagcatcttttgttgccaatgatctaatcttgggcattcctttgtgttcagatacttgtgtctttttgggcaaggaatctctatgccgggacagcatgtcaagactttttctcccagtttccttaattgtttcagattcgcttttatcatgctcatcttcacacttccatttcctacctaagtctttccattttctgtcaaatattttgctgagttcctttgccatcaaatgaacatcattaactgggag

SEQ ID NO: 6853 - DNA, 366 bp, Glycine max
tctgctggtgactcaggtaggtttcaaattcaagcacctgcttcttcattctctgcagcttcaccctcttccaccaaccctaattcttcttctgctacacaaatcattgtttcctctggtgttcagtccccacatcagtgtcttacacatcgtcgaattgcagcatgaacatgaacaattcaagtttgtgtgcctgaagaaaaagttgaaggtgcttattgcttaactcaggagttcgagtttgtgatttcaagtagtgttgggaatcttggttctttgtttcatcttaatttggagttgttgtgagcgtgtggaaaacaaccaaaagggtctgtctcatacgcttaggtagtggtggtatttgta

SEQ ID NO: 6854 - DNA, 816 bp, Glycine max
ggacaggctaacgttgccatttatttattatatttttgttttcctaagtttgtggtatagttcagatgagaaagtagcagacgtaatggatgtagcaagtatatgcttaattcctttagttatgtcttagaaaatctatgcatacatgaggcttttatggaagatatgtgctatctgttgtatcacaatcgtgcaaacaagatattgtattttatttatttatttttgagttgtaggtaacacagctaatgtaataggatatggtcaccttggagatggtaatttgcatttaaacatttctacttctcattacgatgacaaggtagctcaagcaaactcaaaaaaaactgtttggatatgaaattatgctttttataacatcatcagcgttaaaatttgcagattttgtcacatattgaaccttatgtatatgaatggacatctaagcaccgaggtagcattagcgcggagcatggcctgggactaatgaaagccaacgaaattttctacagcaaatcacatgaaactgtatgtatattattgactcaagttgtagttctccatttgagaatgtaaacttgtgaatttaatgtctaaactagtaagaaattggacaggtacaagtgatggcttcaatcaagaatttgctggaccccaatcacatactcaacccatataaagttcttcctcagtctctcatttcataatctcttgtcgaaaacttgatgttgtattcatatctttgtcacttccttgaagtgagacaaacttctttacttgatccagtaagtacacaggaattctctcccacatgac

SEQ ID NO: 6855 - DNA, 652 bp, Glycine max
  misc_feature (591)..(593): n is a, c, g, or t
  misc_feature (624)..(624): n is a, c, g, or t
taagggacattctgaaggagcaggagcgaaaaggctcttctgcacttcctgtgactgtgagcccaatgcctccccctcagaaatctcagcctcctcagtctacatggagtactgtttcctcacggtcaatttcagcatcctctccatctaaaaatgcttctccaattcagataaattcccaagcttctcaatcaaagtacaaaggggatgatgacttgttctggggtccaatcgagcaatctaagcaagatactaagcagtatgttttctatctctttgctgtgttttctatatgcttgcttgcttttctgtttacagtcaaatttctcaactgaaacttttgttctgaatttttgtctataagcttttcgttttgacaagacttctgtagcattgcagttgtaataatttcccctataaaagtgtggtattcattataaaacttgaatactctaaagtaccctatccaacagtagttgagtattcgttgtcttgtctccacaaacatccagttttggtggacagttgatgatttatttgttttttcttctaagcaggtcagatttccctcagcttgcaagccagggtagnnngggttcgaaaaatggacccttaaaaggtaanctcctggattatgacaagacaaaaatca

SEQ ID NO: 6856 - DNA, 791 bp, Glycine max
ttccgaggcactaatagaaggaatgctgcattttgtgttggagaattgtgcaaaaatggtcatgaaccagctttgaagtatccttttttttcatgccacccatttgatagttttacacttatctttctatgttttgggttagtttacaagagtactatgtacatgatgattcatgtcaatatatatatatatatatatatatgcgcttttgggggtaaggttcttttcccgtatgctttacattttcttaaatccgataccagatactatgacaatattttacgtggactttatcccttgtttggtgagtctgagcctgatgatgcagtgagagataatgctgctggtgccgtggcaaggatgatcatggtacaccctgaatctatcccattaaatcaggtaatgtctttatttatatggatcatgctttctcaatgagaactctgtcatgaatacttaaactgatggtacattgctctaatttcttcaagtttaattttgtggtgtatacttgatagccaattgttggtattcaatctctttgatgctttttacaggttcttcctgttttcttgcgagttcttccattaaaagaagaccgcgaggagtctatggctgtctatagctgtgtctccactcttgtattctcatccaatccccaggtaaaggttctttccttgttttgttgtttcctcaatgataatattgtcttacctaattctgtttgtccttttctaaatgtaacgcagatcctgtccctagtccctgaattagttaatcttttgctctag

SEQ ID NO: 6857 - DNA, 518 bp, Glycine max
  misc_feature (84)..(85): n is a, c, g, or t
  misc_feature (89)..(89): n is a, c, g, or t
  misc_feature (133)..(133): n is a, c, g, or t
  misc_feature (140)..(140): n is a, c, g, or t
  misc_feature (156)..(156): n is a, c, g, or t
  misc_feature (197)..(197): n is a, c, g, or t
  misc_feature (204)..(204): n is a, c, g, or t
  misc_feature (232)..(232): n is a, c, g, or t
  misc_feature (245)..(245): n is a, c, g, or t
  misc_feature (285)..(285): n is a, c, g, or t
  misc_feature (293)..(293): n is a, c, g, or t
  misc_feature (303)..(303): n is a, c, g, or t
  misc_feature (314)..(314): n is a, c, g, or t
  misc_feature (337)..(337): n is a, c, g, or t
  misc_feature (349)..(349): n is a, c, g, or t
  misc_feature (355)..(355): n is a, c, g, or t
  misc_feature (399)..(399): n is a, c, g, or t
  misc_feature (415)..(416): n is a, c, g, or t
  misc_feature (450)..(450): n is a, c, g, or t
  misc_feature (462)..(462): n is a, c, g, or t
  misc_feature (476)..(476): n is a, c, g, or t
  misc_feature (485)..(487): n is a, c, g, or t
  misc_feature (496)..(497): n is a, c, g, or t
  misc_feature (503)..(503): n is a, c, g, or t
catggtgttggaagtctaagctgaaacaatcagtatgctttaatccaccctcttctaatcaatcttttatgatctaatgtatanngaancatagtgttcaatgaatattttggaacttggttgttaacaaggnaattganttattttttcttgttnaaatcctagaaattcttgatcattttttgaggggaccatanctgtttntaaatgatggttccttgccatttggttnatacaggttatanaccttttagatagagaagcaattgaatggagggaagaganccgggganctgtgttgantaaactcagcngatggagagagtatagctttctngacaccagcagngacagngacagtaatgattaagcatgtgtaagtgcatcagcttgttgtancatatttagatcaatnncctggtgaaaataaataaattagagctgtgacantgacatgtacantattttgttagccngagctagannnttgggactnntttggntttatcatatcatgt

SEQ ID NO: 6858 - DNA, 1095 bp, Glycine max
  misc_feature (1036)..(1040): n is a, c, g, or t
  misc_feature (1042)..(1042): n is a, c, g, or t
  misc_feature (1089)..(1090): n is a, c, g, or t
tgagagttctgtccttatttcttcaccttctcaacacataaccaccttggtctgtgtttgtttgtgtgtgcttattacttggtctcttcatattgtacatataaaaattatggatgatgaatatgccaagcttattagaaggatgaacccaccaaggtgagttgtttttgtttcacactctgccttcttctttcttttttgttttttggggacagcttttattttttgcttatccaaatttggttggcatcacaattttattagtactctttttggtttatggaagttttaatcaagtggggcataaaattaagcctcttttttgcagcttggtgctttcagtttttcccactgatagggaagttccttgcttaattcttcttttgtacactcttcacttttcagtttagtatcccatgtaacaattagcatactatgtttccaaaaccgtttttttcccttaagaaaactatatttggtcaactttagatgttgaatttttcctcacatgtgttcataattatattagccgtttacggtatgatttttcaggtggtttgatgtgattatcattatttccatgtttcagttattgtgtgtgtactgtatattatgtgcataagagtggtattgtttttttatttaactagcgtcttgctatgcagggttgtgattgacaacaatgcctgtgaaaacgccactgttattcaggtaaaacttgtgtttcccctttgtctaggtttcacaaaattgagttgacaattagaaagattcttcttctttttcagttttttctaatgatttgatgtcataaagctggtgttttcctctgttttggttcacaaaattgagttgacaacaagaaagattcttcccgttttcttttttctttcaaattttctaatgatttgatgttattgactccttagttgcattttttttcttttttaatataaaatcaaaattgtttcctgagtagattttttctttttggaaacaaaatacagctatccacttttttattatctaaatattnnnnnangttgacagtgtcaacaaacatgggattctcctcgatgtgtccaagtnntcaga

SEQ ID NO: 6859 - DNA, 723 bp, Glycine max
ggttttctctttctcacgttcctcttcgcagcgccacagtagcttcgcattagcaatgggtacatacgattaagcttctaactctgcagacgtttctactacgttgtgatttccttcaatggcgttacgatttcattcattcattcattcattttttcaaattttgtttgttgaaatgcaaaagcgagaatcaaggtgtacgagctgaggtacaagacaaaagcagagcttctgaaccaacttaaggatctcaaagcagaactcgctctcctccgcgtcgctaaggtcaccggcggagccccaaacaagctttccaaaatgtaccttccttttctctttcatatcaaatccccaattcctaattggatcgaaattgttacgaatttgaaagtgtatttggattagattcatggtgggaaataatcaattaagttttcatggtgaaggcaaagcaacaaatagttgcttctactttttcatggtgtcaccatgattctgtggagtaaaatttattcttgtgtgttatccaaactcactatgaatgtgctttgttgtgtgtggatgcagcaaagtggttcggctttcgatagcgcgggtgctgacagtgatttcccagaagcaaaaggcagcgttgagggaagcttacaagaagaagaaataccttcctttggatctgcgtcccaagaagaccagagccatcagaaggcgcttaactaagcacca

SEQ ID NO: 6860 - DNA, 373 bp, Glycine max
gcggcctgggcgtgcacatctccttcgtgcgatccgtgacgatggattcgtggtccgaaatccagatcaagaaaatggaagccggaggcaacgacaaactcaacgccttcctcacgcaatacggcatccccaaggaaaccgacatcgtcgccaagtacaactccaatgccgcagccgtctaccgcgaccgcatccaggccctcgccgacggccgtccctggcgggatcccccagtcgtcaaggaagccgtccgctcctccgcatcaaagggcaagccgccgctctcggctggcaacaacaacaacaacggcggatgggataattgggacccggacgacggattcggatcggccaggggcggggcggatctcag

SEQ ID NO: 6861 - DNA, 379 bp, Glycine max
atatattcacccaaagaaaaaagaaagaaagagaaaatagacaatataagtgtctaattcacatcactaaaatctgtccacccgctagtaggcccgagacattaacactagccagcggtgacaacaatctcaactaattgataattacatatttacaacatttcacaccaacacgcgtacgttgctacctatctccaggagttgaagatcacgtaattaaattgagacaagaagagtataatccatgttgtgtatgtaacagtacaagagaagagtggtggagtttgaagttaattaagaattggctagcttatttatcaaagccaaggcattgctagtcaattgagctacctgaataacgagtcttctgacggtgcta

SEQ ID NO: 6862 - DNA, 932 bp, Glycine max
  misc_feature (923)..(924): n is a, c, g, or t
tcagcttccatccatgtggtttcttcatcagactggagctacaacttataggtaagatcagaagtgccaattgctcactccctcgagagagaagagagagagagagagagaatggcccatatccaccttttatctctaattcctaaatgcagtaaattaaaatatagttacaattccttaacagtttcttttgaaattggacttcatgaatagtagggctcatgtcaaggataatgtgtgtccaaagctgtgtgtattttggtttagattagcttctttattgttctaggacggtcctattcctatggcttagtgttggcaggatctcatttgaagcaaataagtcttgcctccctagtttttgtgagatgactacttaacaatgcattcaccttggttataactcagatatgaattattgttggaacaaatattttttagttatagattctagtctttaatgcattgtgttatcagaaaaatgccagtatattaatttgtttagacatatctgactagtttgccatctgcagtcttgtaggttcactgaacaagataccactttctattgctggcatccttctcttcaaagttcccactagtttggagaactctgctagcattttgtttggttagttctttaaattaactgatttgaaagtgttactatcttcattgtcattattattgtagagtgcattggcacaagtttgtattacacttagtttcgtcactgaagctataaatgcaatttgtaggtctattggcaggagtgttttttgctagagccaaaatccgagagagatctcaatcctgaagaacagtaaatggaatttgatttctgggttcagttggacattcagtccaagtctctgaggtgttgtcaagagatggcatcagctaaactaaactgactctcccanncttcatat

SEQ ID NO: 6863 - DNA, 339 bp, Glycine max
atttttcgactgggaaatatgaaatttcagaattggtgaagctgattgctgagaacaagatggttgagaaccatgtaatggaaaaattggtggaggcagatgaagggaaagaggattttatagtttatggggtaaacttgacgtttgtgaatttggaagaagctaatatttatgatgggatgaatctgaatggacagaaaccaattatggcaaattgtacatttcgtggggtgagtgataaaggggttgttttggttcttccagcaccagaagatgacgaagatggtggtaatggaaggattgttactgtttctttgcctcgtgaagaactatatcagc

SEQ ID NO: 6864 - DNA, 407 bp, Glycine max
tgagagtgcacaaacttctccaagaacatccaactatgaaaatgaacagtggggtgttgaaggatcaccttccccgagccaccatgcagtagctgctgatgaaacccagatgcaagttttggagccaggctcaggctgctcaggttcagcaccagaattgcctattagctctcaacttgatatcagagttagttcatctgagttttcgtttgagaaaagacacattcctggaagtgattagatgtgtagatttagtttttagttaaccggttcaaatgtacagcttctgtacatatcaaagttccaaatgcatgcatgcatgcttttgctgcaatgcaaagccatgcatttgaagaatgaggcataatcttttttgatggagcacgatttgttgaatgaggagtgac

SEQ ID NO: 6865 - DNA, 817 bp, Glycine max
  misc_feature (748)..(750): n is a, c, g, or t
  misc_feature (754)..(756): n is a, c, g, or t
  misc_feature (758)..(758): n is a, c, g, or t
gagtgaggcacttgcaaagatgaaactgtaagtattgctgttattctttattacactttgtaccttttatccgaaactcttagtgcaatttcatgaaaaaatatgaatacagtcagtgcctgcatgggatttactatctttggtgtaagaaatttcatttgctatcatggggcttataatgcatgttgtcatccaaatttgttaagtagttttagtgcactgctaacaatcagaacacatttttcataaaatgtatccagaaaatgtttacataaatagggctcaaatttcttaagtggctttcctaaattttctatttagtggctagtagatcaattggttcaataatgtggtagtatggagcgacagtatgaagtgttactgatctatgcttttgactgaaaacaagtttcatgattccgccattgcatttgcatgtgatgttccctaaatatgtttagcttggccaaaattagtaaattttgttatattaatcatctttcttctgtttttccctttttggagtgtttttttgttttattcttttgatggtccatgcatctttcttttgacaaaatgtacgatgattaattcttgcaccagatctcatcttgctactgaggagaatgtgcaagaagcagtaaggcttttcaccgtgtcaacaatggatgcagccaagtcaggaataaatcaacaaataaatcttacacctgatatggcaaatgagataaaggtttgtcttgtgatnnncatnnncngtcttgttcatctagcttaatatcctaatggattactttacattgtgagcagcaagctg

SEQ ID NO: 6866 - DNA, 356 bp, Glycine max
tctctcagagatccaaaaccattcagtttagcacaatcatcatatggatgcaactgtaacaaaacatgtgtccctggggatttgagctgctcttgcattcaaagaaatgaaggtgactttccatatactgcaaatggtgtcctagtgagtcggaaaccattggttcatgagtgtggcccattgtgtaagtgttttcctaactgcaagaatcgagtatcccagactggtttgaagcaccaaatggaagtgttcaaaacaaaagatagagggtggggacttagatcactggatcctatacgtgctggtacttttatttgtgagtatgcaggagaagttattgacgttgccaaggtaaa

SEQ ID NO: 6867 - DNA, 586 bp, Glycine max
ctgcacaaccacaactgaaagaatccttgtataccctttcatggaaaatcttagtgtagcatatcgactgagaggtaaaactagtattaagcatatatttgagaacacaatgtgtatattttattttttgttactttactattctttaatacaattttaaagggtgtgcaaagatgaagaaatatcattttttaacactatttctctatcctgacttagatttaaaacctggtgagaaaggcttggactggccaacaaggaaacgcgtggcttttggcactgcccatggtttggagtatttacatgagcaatgcaatcccaagataatacatcgtgatctaaaggctgcaaatatcctactagatgatgaatttgaagctgttctaggtgattttgggctagccaagctggttgatgcaaggatgactcatgtcaccactcaagttaggggcacaatgggtcacattgccccagagtatttgtccactggaaaatcttcagaaaagactgatgtttttggatatggcataacacttcttgaacttgtcaccggtgagcgtgcattagacctctctcggcttgaaga

SEQ ID NO: 6868 - DNA, 741 bp, Glycine max
attactggatatttcatcttttcttgcattgttggagctcttggtggcgctctatttggctatgatcttggtgtttcaggtgagttaattctagctaccatcttcaaaataataaaccatgggaaatttagcacttttttgttttaaaagttttttttcttaaacaattctacattattgatcagcaattaatttctcacgtaattaaaatctatcgaattttgtaaattattttcaaaaaaccgtttaaaaaccaaaatattgaatcagctgagagatattaacttctcattcttttcttttgtttttacagttctttgttttctaaaatagtaatcaaacaaagaccttaatgttccctgcatgttttattaaattttgaaagataaaataacgttggaatcttttatcacttgttgcttggtaatacaggtggagttacctccatggatgatttcctcatacaattcttcccaaaggtgtatgaaaagaagcatgcacatcttgcggagacagattattgtaaatatgatgatcagatattgacactctttacttcatctctatactttgctgcccttgtgtccacgtttggtgcttccagtgtaacaaaaaccaaaggcagaaaagctagcatcttagctggttccgtaagcttctttataggagctattctgaatgcagctgccaagagcattacaatgttgatccttgggcgtatccttcttggtgttggcattg

SEQ ID NO: 6869 - DNA, 395 bp, Glycine max
cttcgcaaaaaaacactacacatccatggcaactgcgtaagacacttcttcattcattatcgctagtgaattattcatgaattatgatctgcagttagtttttaatttgaaatcggttcctcttcttcgttatttagtggcgtgcaagaagttcgtgttccccctctaacttccacctctgagccaccttctctctttgacggaaccaccaggtgcttcgtttttttctttcatcccgtttttatttccgatgtatatttttttttaattttaaattttttggattttcttttaggttgtacatcagttatatttgtccctatgcgcagcgtgtttggatcactcggaactataaggttgtttctgtgttctgtgttctgtcttattcctttttt

SEQ ID NO: 6870 - DNA, 457 bp, Glycine max
  misc_feature (413)..(414): n is a, c, g, or t
  misc_feature (416)..(416): n is a, c, g, or t
  misc_feature (430)..(432): n is a, c, g, or t
  misc_feature (439)..(440): n is a, c, g, or t
  misc_feature (443)..(443): n is a, c, g, or t
  misc_feature (448)..(450): n is a, c, g, or t
  misc_feature (452)..(454): n is a, c, g, or t
ttctctcattcatatattaacaaaacgttttttattaaattgttttaatgacttactactgaatgctttttagcttctaacatattaatttcccttgttttttttaattaataattcatattgttagttccttaatctatatgtctttactagcaattttacttttataaaattcaatagaatattacattgaaatcattttaaaaaaacttattacttacttttttaaagtgatttaaaaacttattactttaaacatataataagtttataaaatacattctgttataatcaagaggtatttggattttattttttttgcattcaactaatcatccttctacttggtcgactcattttttagtacacacttttaaatttcaattacaacttctatccaagccaacgataannanaatatagttggtannnacaaggnnacntatcnnntnnnatg

SEQ ID NO: 6871 - DNA, 461 bp, Glycine max
ctgcggtttccgtttcctctctgccttcaccactctcttttttttctcaacaggtaaaaattcattaaatctccaataacgtttgtgtttgcgagaaaagaaaaaaaaaagcattaaattaggaccgcgtaaaataatattctgtcgtgacaataatagatttgagttctgtaggaacaaagaaaaatggaagttgcggcagcgaaagccctgaaaccaagccttcggacagagttcattttccctcaagcaatttacgacgagattttgtgttttaacgccaacaacgttgttgccggcgaagatttctccgtggacgacctactcgacttctccaacggcgaatttcaagtcgggaaagatttcgatgactacgaggaagacgaagacgaagaaaaaggcagcacctccggttccttgcagccgcaggacaaaaccgaaaacgacagcaactctaattc

SEQ ID NO: 6872 - DNA, 395 bp, Glycine max
aaagagagaacacaacacaacaaactaaaacacacaccctctaagttcattaacctcttcaacatcaaaacttgtaatattttaatggcaacacgcgtgatccctccaagaatcctcaagaatcttcgttacaacacaacaaccaagcccctcaacgccgcccaaccctccatctctccggccatcgcctcaccgtcgctcttcgagaggtcgccgtcccctcctgccgcggacgtcattccggcatctgcggctgggacggcagcgctcaacctggacgacgcggagcggctattcgcatcggtgtcgacaaagaggctgctccggtcgtccgcagttctgcacgcgacggcggtggggcccatggtggacctgggaatgtggatgatgaagtc

SEQ ID NO: 6873 - DNA, 651 bp, Glycine max
  misc_feature (395)..(395): n is a, c, g, or t
  misc_feature (447)..(447): n is a, c, g, or t
  misc_feature (450)..(450): n is a, c, g, or t
  misc_feature (454)..(454): n is a, c, g, or t
  misc_feature (472)..(472): n is a, c, g, or t
  misc_feature (475)..(475): n is a, c, g, or t
  misc_feature (477)..(477): n is a, c, g, or t
  misc_feature (516)..(516): n is a, c, g, or t
  misc_feature (615)..(615): n is a, c, g, or t
  misc_feature (617)..(617): n is a, c, g, or t
  misc_feature (623)..(623): n is a, c, g, or t
  misc_feature (641)..(642): n is a, c, g, or t
  misc_feature (644)..(644): n is a, c, g, or t
tgagtttcatccaagtttctaaacgacaccgttactcagttttacaccgagcacctgtccgcgcttcaggtttgtttctttcgatcttttttattgattccttttctgggttgttgtcaaaatttgagcttgttcgtggtccgtgaaggatctggttcttgatcgagatcctgttttgttaactttttccttgtggggttgcttcacaatgaaaaacacttaatcatatttgtgtatatttcttttaaaaaattgttgttgctggatgggaattggagttttattacctcattaaaaatgagtataagttacagataaaacttcaattctgattaaatagttatagaaaacaataattgttcaacaaaaaaaaaaaaagaaaacaataactaaanaaaagatccaattaatttcatatcttgaaaatttggtagtcttaataattantanatcntctcgtcaaagaaatagnagnanatcataaacttttggttgtttttatttttttcaggaaanttttggttgttgaggtgtatcttgatgcctattattcaattaaaattaaagttttatctcccttgtttgaaattttctttttattttaatttgaacaangncaatanaaataaaaaaatatttgnntnaactttt

SEQ ID NO: 6874 - DNA, 754 bp, Glycine max
ctgagagagatcaccttgcttctgtggttagctctgctgtcaatgtccgttctcatgatgatatcacaacacttacagctgcagctgccacaggtagagtttattactattattattaggacaaaactttgatgcagtgtcatgaggaagtacttttggtgcgatttttcaatcagaattcaggtttcacctcgaaaatctgtttacttttaatgaacctttattaggcagattaccttgttgaaactccaattttgattggagtatcaaaagaacatataaaactgcatttaagttttgtccttcttattataactattgttaagaaaacattaagctactgctcctaagtcctaaccaaagttgatacaatatgaaagatctctgaataatcccttagtcccagatggaacattacttgtacacatggattgtgagaggtagtagctaattagtaatagtcatgttaagtatttttctctctttgtatagccacttgaagaatatgatcctttatatatgcagctttacgaggggctgcaaccttgaaagcaagagcattgaaggaggtgtggaatattactgcagtgaccccaattgagagaggcatagggattggaatatgtggtaaaggcaataacagtaattctagcaccagtgatagtggagagattatcaatggtgaaaattttttgggtgcctgcagccaagagttcctagctaggggcactgcattactcaaacggacacgtaa

SEQ ID NO: 6875 - DNA, 394 bp, Glycine max
tcatgatgcagtctgactctgataacataataaactctaatgtcttggttgttatttctctatattttacttttttttattcgtagaaattaaaataattaaaaaaaattataacaattcatacatcttcttaaatcaactaagttaaactccttgattttttctatattttgctaacttcagtattctctatctttttcttaaataatgaattaaatccttttttctacacacaagaatagatatttttattaaacatgtatttcatatagcaagttggccctatatatgaagtgaacaattcattgtttaattttattgcagattctcgaagaagagcctaataagaattatttctcgccatggtgtgtgatacccatgatgttcaatgctg

SEQ ID NO: 6876 - DNA, 364 bp, Glycine max
gggtctgctccagcagagctgaactgacagaatgtgatggaagattcttgtggatatgtatatgtgcatgtgttggaaattggaatgatataacatggatttgattggccaagattcatcaccaccacttgttgagaatcattctttgcttctgggccataaggaattctggttccagagtagtttattgatgtacgatattctgttactattatattcctcaaggatcgtttatctttgggcttatacttcacatggtgttttcatatttgttcctgtttaatacaacagtgtatggtatctttggcccaccgtattttcagtgtttgtttatgcttgtcgtttcttctatgattgcatggaa

SEQ ID NO: 6877 - DNA, 650 bp, Glycine max
  misc_feature (638)..(640): n is a, c, g, or t
ctttgtccgattgcaagatattaagacctcatattggattgttatcttcgcttctgtgaacttcgctcttgcgcaatgccccaacttaaacgacatctctgctatctcttttgctgcagctgtcatgtctttgatgtaaccaaactccttttctacctctgttgttctccaatcataattagggcatcatctcaataattggcataataaggatttgcattaaagatcaatgtaggttattgaggtatagattactctaattttcacacgggaacaatgtatatatatatacactaaaaatcaacatacgctactaaggtgatactctcattatgataagaaaacaacacttaaattacagccaaattttgtccttgatctaatcttacaattattagcaaatgattaatgttgagggtgaactgtttaatttaaacagatactcaaccatcgcttggtgtgcttctataaacaaggggattgaagcaaatgtggattatggctccagagccactagctctgctgatgctgtattcaacttcttttctgccttgggtgatgtagcatttgcctatgcaggtcataatgtagttttggaaattcaagcaaccatgccttcatctgaagatacaccttcnnnagaaacccat

SEQ ID NO: 6878 - DNA, 356 bp, Glycine max
gagtggctggtgatctcatgtcaaaaccaacatggtttgctgctagctgaatccatgacgcattaatacgaatggacaacgaatatttgagatcggctcttgactatctagagctgcagcctgatctaaaagttcttcttcgtggagcacatacctttaggtgtccaaatcttggtatcactagctgggcaaggcttccaatccatgatgctgactttggttggggaagacccattttcatgggacctggtgggattgcatacgagggactatctttcataattccaagctcaacaaatgatgggagcatgtctgtggcaatcgctctgccccctgagcaaatgaaagtgtttcag

SEQ ID NO: 6879 - DNA, 805 bp, Glycine max
tttgatatttagcagtcatctcagtgattttgcgaataaccataaactttgtgaagttgcacttccattccgtttacttagacaaagaggccattatgttcttgcaggtttaaattatcctcactacataaacatttgaccacacatatttactttctaaactacattccatacaatatagaatattacttttatctgatataacgagggaccgaccaattccttcaccatattgttaaacaaaatcatttatgcttcccaccatcacccaacggcttttcttggaatacgacgagtttggattaactttcaattctaccaaaatcacattgaataagggccaaaacaacgcaaatagttatttaaacttttctcaatgttttaccatgattcttggggtaagaattctaggaggtatctaaacacactaacagctggtcatgaccagttgaccaccattatctcattctttattagttcaccataatatatataccaactataatgattgtgcagatgtatttgacaacctgaagagtaacaaaaaagagtttagagaaaaacacggtgaagatgtgaagggtcttatttctctgtatgaggcaacccagctaggtattgaaggagaagacagtcttgatgatgcaggttacctctgccaccaacttcttcatgcatggctgacaagacatgaagagcataatgaagctatgtatgttgctaagactcttcagcatccgcttcattatgacttatcaagattcagggacgacacaagtatacttctaaatgatttcaagaccaa

SEQ ID NO: 6880 - DNA, 521 bp, Glycine max
  misc_feature (62)..(62): n is a, c, g, or t
gatgagacgtgacagtgacaaagaaaatggtaaatttaaccatgtacggtgacggacagcanaagagtatcgtcactggaaacaaaaatttcgtggatggagtcaggaccttccaaactgcatcatttggtaagtgtaaactctcttcacaatcaacctcaaaaaactgataacaaggaataattgttagcgttctttcctcatgcctctattaaataactgaacaccatttttgcatgcacaattaatgcagttgtacttggagagggattcttggggaaagacatgggattcagaaacacagccggtgcagagaagcaccaagcagtggccgcaagagtgcaagccgaccgagccatattcttcaactgcgccttcgagggctaccaagacactctctacgcccaaacccacagacaattctaccgcgactgctacatctctggaacaatcgacttcatcttcggcgacgcctccgcggtgttccagaactgcaccatggtggtaagaaagccactgga

SEQ ID NO: 6881 - DNA, 800 bp, Glycine max
  misc_feature (778)..(780): n is a, c, g, or t
  misc_feature (791)..(793): n is a, c, g, or t
atctgagatggacttggttgggctattggaataacaatcgccactcccgttccttgcattgatggtcatgcaatatgaggttggtcttttaatcaatgcaatttagaaacattcagttcactctggagttatattttagaggacaaagtgtagttacagggaagttgaaaattaaatattaagacattaatataataacttgaattaaatttattacatgcatacttatactttattacaatcttaactattggttttcaaattaataattataactttgttgacatagttggaatgttcagcattgtttaacctcagttaacttcttttgccttaaaaaaaaattataactttactacatcaattgtcataatattgaacaactcattctttaattgatctttgaattaatttatttggaattcacttcctgttttaattgttacagtattctacgatttctatattctcaaatataaattatttttaaaattaattctaccaatgtcaattctactgaaagataatagaagggaattgctgattgtatttagcaatccaggctactctgggaagagttccaatgggcgtgaatgtgctgcagccatagtgaaaagtgcctgcaggggagattcgtacttcacatatccatcacgatcaaagtgttttttccttggaaggtgctttatcctcatgtcgtagactgggcctgccgtttggtctttgggctttctccaaactcctctagcaataaaggaaaataaaatgtattagacannnatgtatatcannntataaga

SEQ ID NO: 6882 - DNA, 902 bp, Glycine max
atatctgtcagcagaacattccgatgttggacgtgaagtatcatatttgcgtggctcaagaacacaacgtgaaggttgaggtttcacccaaatcaccttcacctcctgttccgatctttggccaagtatggttttcctcttaacacctcgctttgaatccgttttttttcttccttttgggtttgcgttcaaccggggttggtacttgtttgatttggttgaacgaattagttttcaatccttttaggttagtttttttgtcaaatctgaatcgggtctgtggatttggttatgtttcattgattgataaatgtggggaagatccaatactcccctagtggttgctgagtttatgaatctgaattttggaagtagaatttggaattgggtgttttatttattcattaattacctttaacctaggctgcttaccatgtattgtatattatcacctctcctccaacgcacaacaaagtggagggtggaattttgatgaaatttattcatcagatgaaattagttaaaatagcgtgctatgatcttagtaatttcgtgctggtaggctttatgatcttagtttgatgatgatcaggttcatgttttttctgtttgttttttctttaacacttcagagttgatcgatttgttcttgttgtgctgacttttttgttaaatatgtatcaggcagtgagttgctctgagatcattaaagattccattttggaggcccctgcgatgaattttttcccaaatgtgcgttctggtagctatgccgagattggaccgcgcgtttctatggatgatgaacacatttgtattgatgatctgggagctcatcttggatttgtgttcaagtgtccgataccgagtgcattttatgcagtttttgatggccatggggg

SEQ ID NO: 6883 - DNA, 371 bp, Glycine max
ctggtaattgtatcggccacattccggagggttttttcatacacatgaatgctctaacagtacttaatatatcatataatgatttcttgacatctttgccgcattcgctgtccaacttgaggtctcttgtttctttagtgctccaaaattgttcaaatttggaatatatacctccattgggagagctacaagcattgtcaagattggacatttcaggttgttcgattcgccaagtaccagaaggcttgaaaaatctaataaacttgaaatggcttgatatgtccataaatgagcatttaacgctggcaccaagatgtgtactgcccggtttgaccaatttgcaatatctggatctccgttgtgattcaaaa

SEQ ID NO: 6884 - DNA, 392 bp, Glycine max
tccctgatccatttcgcgtgttagagcaaatcccatttggggttgacaaagatgaaacattcacagctctatcatcacatgcaagagtggattggaaggagacaccagaagggcatgtcataatgctagatgtgccagggttgaagagagatgagatcaagatagaagtggaagggaatagagtgctgagagtgagtggagaaaggaagagggaagaggagaaggaaggggatcactggcatagagtggagagatcctatggcaaattctggaggcagttcaaggtgccagacaatgtggacttggattctgtcaaggctaagatggagaatggagtgcttactctcacaatgaacaagttgtcacctgataaggtcaaaggtccaaggttg

SEQ ID NO: 6885 - DNA, 376 bp, Glycine max
agtttggtacaataggttgattcttttgggagttcttttccttgtattttgtaattgataatattatataggcttcattcatgtactttgctatatttttttttatctgaataatgatttgtagacacctaatgcaaatctataccttgagagaaagaactagaagagagagaagtgattatttgatgagtgatatgatgtgattaagaagggagaggaagagagatagggagaaatgaagggtcaaatgaaatgagtgtttaggtagctatgtatcattgttgtttttatctgcctttcatttgtattcattgtatgttattattcattattgtgggggagtaacgaaatcttcttttatttgtggctgtcccaa

SEQ ID NO: 6886 - DNA, 335 bp, Glycine max
ctaagtcaagctaagctttactagatttgaactgaatatgtaaagcttgaacttgacacaaggcttggctcgacttacataaaagcctgacttggctcacaagcctatttaaaagcttgcttaaagacgtctttgattaattaattattttaaaacctagtgaaatactaactaaaaaaagaaacctataaaattttgtataagtaatgtacaaatccaaaaataattgataaacaaaatcatattgaattcaagtcgttaaaatacaaagtatatcagaagaaaataaaaagagcataatattaaaaaaagtatggattaggtcctcaacccac

SEQ ID NO: 6887 - DNA, 412 bp, Glycine max
aagcatgatgagggattagattgtctaccagacgaacttcttcaagagattaaattctatatgtatgattaaattctacaaatttaggtttggatgcattaattttgtacattgtggttttcgtggttcataaagattaaaacaagttaggttttgatcatataaacttagagttagttttggacagaagttttaatggtctgcgtcattgaaataaaagtttaaggcctagtgaaattgtattataaatctccgccaccactgccaactttagtgttcattaattcaatatcattggaggaatcgaacgtgcgaacctcgaggcccgacctggtatggcccctagtgggactcgaccatggaaaatctgtgatctctagaaacctcactggagctgacaacaacactaaac

SEQ ID NO: 6888 - DNA, 370 bp, Glycine max
gctgcaccacaggcattcactaagcacagacagcagtggcaccaccacaatcaccctcaagactgccggcactcactacttcatatgtgcttctcctggccattgtgatggtggtatgaagcttgctgttaaagtaaaggctaaaaaagcatctgctcctgctacagcaccttcaccagctgcaaaggactcaccttctgattctgatgacaccaaagacacacccacttccacctccactaaccctaaaacttcaacctccaccaccccttcaactgaaacctccaccactaccacatcttcttatacatcatctgcaactgctgctggctccccaattgttgctatgttttttgcttctttgatccca

SEQ ID NO: 6889 - DNA, 383 bp, Glycine max
gccgtcttcgccaccgtgccatcgccgtcgatggagtctctcttcggctcgatcaacgttcgcgacctcctctcggcgcaggacctctcggaccctaactcccctctctcagcgccggatctccgtctcctgatccagcgcctggagtcgcagtccttccagatccgttctcaggtgcagtcctaccttgtctcgcaccacgaagacttcgcgcgcctcttctctctttgtaacgacaccgtttcgcagacgcgcgaggtctccgatgatgtttccgccatcctcggcctcctctccgaccacccgatcgatgccgaggtgcgcgagatcgtgtcggagacgaagtcgaagaaggaggagctgaagatgaagaaagagctgct

SEQ ID NO: 6890 - DNA, 294 bp, Glycine max
aaatacgtttgacgggtggggagccaactattagaaaagatattgaagacatatgtttggaattgtcaaacttgaagggattgaagacattgtccatgactaccaatggtattgccctggcaagaaaacttccaaagctgaaagaatgtgggcttaattctgtgaacattagtttagacactctggtaccggcgaagtttgagtttatgacgagacgcaaagggcatgaaaaagtaatggatgcaattaatgcttccatagaccttggatttaatccagttaaggtatttctta

SEQ ID NO: 6891 - DNA, 363 bp, Glycine max
atttttatattgaattttaaaataatttgtatcagtatataaaaataaaacttcatcctaggtttaattttgatcccgccactgtcagttgtaaaatttgaagaagaaatttcagattgtgttgtatttttttaactgtctccaaatttgctccgttcgatgtgcataattgctgatcgatgcagttccaagtttatttctgctgggttttgaattgaagtttgaagttgatttgaagaatgtttagcaatatggtaaaatttcgagttaaagtttgagattgaagttaaagatattaacaagtggaagttctaaaagtaaacaagtgtcaatgaaggatttcaaggtaagggttcaaaaaaa

SEQ ID NO: 6892 - DNA, 787 bp, Glycine max
atcaaggcacttcttgttgctgcaactgactgtgaacctcaatatctaatccgtttgctacaggttgaaattataatttttattgaaatgttatggtggacttacttcttgttaattgcatcttggtcttgttttctagacaaagttgcgaattggctatgctgagaaaactctcttagctgcattgggccaagctgcagtatacactgaagaacactctaaaccgcctcctgatattcagtctcctttagaagaggtaagctatcctgattgaagtgggaaatgtggtacagagtgaattggtttaaacagcttagtgaggccaggttgagtggcaatatgtgcgctgggttttaaatatttgaaagtgcttcagcactaagcattggggatggggtgctgctgctgctgctgcagccgaaatgggcatcagtgatttcatgttaagataccaccaaccttttccctattctgcattttaggaaactttaggcggtagtaattcattatatttcctttcctattatattttatttatttatttctggtttcattttgcatcaggcttcagagattgttaaacaagtctattctgtacttcctgactatgacaaaataatatctgcactgcttacagagggtctatggatgcttccaaagaaatgtaattttactcctggtgttccaattggacctatgctatcaaaggcaacaaagggtgtatctgaaattctaaataaattccaggatgtggagtttacctgtgaatacaaatatgacggaagag

SEQ ID NO: 6893 - DNA, 806 bp, Glycine max
  misc_feature (734)..(736): n is a, c, g, or t
  misc_feature (787)..(791): n is a, c, g, or t
attttcgctctcttcttcccctcccttcgcttctttctcgaccgattcatattcgaggttcgtaccttacctttctcattctctcttcttctcttctcttctatcgccgttgactcacgactaatcacatattacttattaaacttgtaatcaaaccacttaacatggatcagttaacactagcatttccatttttactaacacttcatctgttagtatcaggtaattgactattaaccatacacataatcaaaatcgcaagtaactagaaaccgaaattgaaactatagtaattaattaattttggtgcaggtgtagtagcaacaacatcgttcacactggttaacaaatgcgactacacagtgtggccaggcattctctcaaacgcaggaatcgccacgcttccaacaacaggtttcgttcttcaaaccggagagtccaaaaccgtaaccgctccaacctcttggggtggccgtttctggggccgcacactctgcacgcaagactccgccggaaaattctcttgcctcagcggcgattgcggctccggcaagctcgaatgcgccggaaacgccgccacgccgcctgctaccttagccgagttcactctcgacggcgccggaggcctcgatttcttcgacgtgagatgcctcacttatgaatcatttgttctttccatatgattttaatttataacctttttaacatacatttcaggttgaaattagaggcannntatatgcacgctgctggattttactcatactccatctttggtttaatactnnnnncaaacgaggcgctcc

SEQ ID NO: 6894 - DNA, 1531 bp, Glycine max
  misc_feature (583)..(586): n is a, c, g, or t
  misc_feature (588)..(594): n is a, c, g, or t
  misc_feature (597)..(600): n is a, c, g, or t
  misc_feature (609)..(615): n is a, c, g, or t
  misc_feature (617)..(635): n is a, c, g, or t
  misc_feature (638)..(639): n is a, c, g, or t
  misc_feature (644)..(654): n is a, c, g, or t
  misc_feature (658)..(660): n is a, c, g, or t
  misc_feature (662)..(662): n is a, c, g, or t
  misc_feature (664)..(665): n is a, c, g, or t
  misc_feature (671)..(671): n is a, c, g, or t
  misc_feature (673)..(688): n is a, c, g, or t
  misc_feature (692)..(696): n is a, c, g, or t
  misc_feature (699)..(699): n is a, c, g, or t
  misc_feature (705)..(718): n is a, c, g, or t
  misc_feature (720)..(724): n is a, c, g, or t
  misc_feature (726)..(734): n is a, c, g, or t
  misc_feature (737)..(738): n is a, c, g, or t
  misc_feature (742)..(746): n is a, c, g, or t
  misc_feature (751)..(752): n is a, c, g, or t
  misc_feature (755)..(755): n is a, c, g, or t
  misc_feature (761)..(764): n is a, c, g, or t
  misc_feature (766)..(766): n is a, c, g, or t
  misc_feature (768)..(774): n is a, c, g, or t
  misc_feature (776)..(778): n is a, c, g, or t
  misc_feature (781)..(784): n is a, c, g, or t
  misc_feature (787)..(792): n is a, c, g, or t
  misc_feature (799)..(802): n is a, c, g, or t
  misc_feature (806)..(817): n is a, c, g, or t
  misc_feature (829)..(829): n is a, c, g, or t
  misc_feature (831)..(834): n is a, c, g, or t
  misc_feature (836)..(840): n is a, c, g, or t
  misc_feature (844)..(848): n is a, c, g, or t
  misc_feature (852)..(862): n is a, c, g, or t
  misc_feature (864)..(865): n is a, c, g, or t
  misc_feature (867)..(868): n is a, c, g, or t
  misc_feature (870)..(876): n is a, c, g, or t
  misc_feature (878)..(878): n is a, c, g, or t
  misc_feature (880)..(884): n is a, c, g, or t
  misc_feature (886)..(887): n is a, c, g, or t
  misc_feature (897)..(906): n is a, c, g, or t
  misc_feature (908)..(911): n is a, c, g, or t
  misc_feature (916)..(918): n is a, c, g, or t
  misc_feature (924)..(929): n is a, c, g, or t
  misc_feature (931)..(931): n is a, c, g, or t
  misc_feature (934)..(937): n is a, c, g, or t
  misc_feature (940)..(942): n is a, c, g, or t
  misc_feature (944)..(947): n is a, c, g, or t
  misc_feature (949)..(955): n is a, c, g, or t
  misc_feature (958)..(963): n is a, c, g, or t
  misc_feature (967)..(973): n is a, c, g, or t
  misc_feature (975)..(985): n is a, c, g, or t
  misc_feature (988)..(998): n is a, c, g, or t
  misc_feature (1007)..(1011): n is a, c, g, or t
  misc_feature (1013)..(1022): n is a, c, g, or t
  misc_feature (1030)..(1043): n is a, c, g, or t
  misc_feature (1047)..(1052): n is a, c, g, or t
  misc_feature (1055)..(1059): n is a, c, g, or t
  misc_feature (1063)..(1072): n is a, c, g, or t
  misc_feature (1078)..(1081): n is a, c, g, or t
  misc_feature (1083)..(1085): n is a, c, g, or t
  misc_feature (1087)..(1087): n is a, c, g, or t
  misc_feature (1089)..(1089): n is a, c, g, or t
  misc_feature (1102)..(1114): n is a, c, g, or t
  misc_feature (1125)..(1131): n is a, c, g, or t
  misc_feature (1138)..(1141): n is a, c, g, or t
  misc_feature (1145)..(1145): n is a, c, g, or t
  misc_feature (1147)..(1148): n is a, c, g, or t
  misc_feature (1159)..(1161): n is a, c, g, or t
  misc_feature (1166)..(1178): n is a, c, g, or t
  misc_feature (1180)..(1187): n is a, c, g, or t
  misc_feature (1189)..(1192): n is a, c, g, or t
  misc_feature (1194)..(1218): n is a, c, g, or t
  misc_feature (1224)..(1245): n is a, c, g, or t
  misc_feature (1247)..(1249): n is a, c, g, or t
  misc_feature (1252)..(1257): n is a, c, g, or t
  misc_feature (1259)..(1260): n is a, c, g, or t
  misc_feature (1263)..(1263): n is a, c, g, or t
  misc_feature (1265)..(1268): n is a, c, g, or t
  misc_feature (1276)..(1279): n is a, c, g, or t
  misc_feature (1282)..(1285): n is a, c, g, or t
  misc_feature (1291)..(1300): n is a, c, g, or t
  misc_feature (1304)..(1304): n is a, c, g, or t
  misc_feature (1306)..(1322): n is a, c, g, or t
  misc_feature (1324)..(1328): n is a, c, g, or t
  misc_feature (1334)..(1338): n is a, c, g, or t
  misc_feature (1349)..(1354): n is a, c, g, or t
  misc_feature (1358)..(1358): n is a, c, g, or t
  misc_feature (1379)..(1385): n is a, c, g, or t
  misc_feature (1387)..(1396): n is a, c, g, or t
  misc_feature (1404)..(1404): n is a, c, g, or t
  misc_feature (1417)..(1422): n is a, c, g, or t
  misc_feature (1425)..(1433): n is a, c, g, or t
  misc_feature (1435)..(1443): n is a, c, g, or t
  misc_feature (1447)..(1449): n is a, c, g, or t
  misc_feature (1451)..(1463): n is a, c, g, or t
  misc_feature (1466)..(1468): n is a, c, g, or t
  misc_feature (1474)..(1477): n is a, c, g, or t
  misc_feature (1479)..(1479): n is a, c, g, or t
  misc_feature (1481)..(1492): n is a, c, g, or t
  misc_feature (1495)..(1509): n is a, c, g, or t
  misc_feature (1512)..(1523): n is a, c, g, or t
gatgatttattacacaaatatccagcacttatatccactttatttacaacacagcccatgatcatgaaattatataagtatataatgatagtgagaaactgacaatagaatgacttgtaatatcaaatctgcattctacgtttcttcttgttctactcgtccaagcctgaattgggagtggaagcattttgatcacgttgtgaattttcagcttttctgagaccctctctgagacccaagacaatgaacaagttagtgagagtgaggagcgactcagccccaccgtgtaaccagtctacattggacaaagaagtcccataatgcaccttcgctgccgtaacataaaaacacaaatcaaacattcgtccatcttcatcatttataaaattgaacataattttaaacaaataaacgcaccataaattccagctggtactgctcaatggcaaaaggttcaaaacacagcaaatcagcaaccttaatatgttaaagcatctaataaaataattggagcagagagagagagagagagagagagagagggagactgacttgtgtctccaacaaaggcaagcaagaagtnnnncnnnnnnnccnnnnccttccccnnnnnnngnnnnnnnnnnnnnnnnnnntcnntcttnnnnnnnnnnnccannnananntctacnannnnnnnnnnnnnnnncctnnnnnctnctctcnnnnnnnnnnnnnntnnnnncnnnnnnnnnccnncttnnnnnttcannctncctccnnnnanannnnnnncnnntcnnnnctnnnnnnttagaannnncttnnnnnnnnnnnntatctctctctntnnnncnnnnncccnnnnncctnnnnnnnnnnntnnanncnnnnnnncncnnnnnanncctccccctnnnnnnnnnncnnnnctccnnncctccnnnnnncnctnnnnctnnncnnnncnnnnnnnccnnnnnncccnnnnnnnannnnnnnnnnnatnnnnnnnnnnnaccccatcnnnnncnnnnnnnnnnctctctcnnnnnnnnnnnnnntctnnnnnnacnnnnncaannnnnnnnnnttccannnntnnncngntcgcccacgcccnnnnnnnnnnnnnccccccatccnnnnnnntcccccnnnntcangnncccctaccccnnnatctnnnnnnnnnnnnncnnnnnnnncnnnnannnnnnnnnnnnnnnnnnnnnnnnnacctcnnnnnnnnnnnnnnnnnnnnnncnnncannnnnnanntcncnnnnctgtcccnnnntannnnccactnnnnnnnnnncccngnnnnnnnnnnnnnnnnncnnnnncccccnnnnncccccaccttnnnnnnactnccccccccccctcctctcccnnnnnnncnnnnnnnnnnctctctcnctctcctccactnnnnnntcnnnnnnnnnannnnnnnnncacnnncnnnnnnnnnnnnnccnnnatttcnnnnanannnnnnnnnnnntannnnnnnnnnnnnnnctnnnnnnnnnnnnttcatctc

SEQ ID NO: 6895 - DNA, 289 bp, Glycine max
tgtatttctaattttccgcttttttatgcttcggcaatgatactgttatttgattacatagagtaattacaatcctttgtaagtaagtatattaatttttgtaattattatcttaaaaattatatttattatatattttttattaatcactaatcgacaaaaaattatactgccagtatttaattttttttttataaattttttattatgtaatttgatatttgttagtgcaatactggtattcactaatctggtgtaggtcttttctagaagcattcaattcaagtgt

SEQ ID NO: 6896 - DNA, 850 bp, Glycine max
tgcatgacccagatacagagaagtctcaaaatcaccatcaccatcaccatcctgcaaatggtgacaaagctgattctgatgtcatggttgatgtatttcgatggtctcgatgtaagaatcctctaccccagaaactgatgcgcacgattggaatccctctgcctcttgaacatgtggaggtattgttcatctcttttccatggggatgtgaataatgcatacagaattttttctcctcgattatgagtaactcttgtatttctattgaatgttttcatttgcctgttagtctacttttgcatttgcttaggcttacaacctatgaaatgggagacgatgttagggtgtttttaaaaggtagaggggaatatcatatggtaggtcttggaggatatcaaacaataacctgcagaaccaatacctgttgccattgggcatgggctataagcctgtgatcattgtatcaactactccagtcactagtctgaactttatcttttctcagtcagtatgctgcaggccttgttttttgctcgtatttcagtttctgcataacatcccaaggccttatatgtaaaccataattgttttgcttcaacatgtgcaaaatctctcaatttggtgctgtataatgttattctaatgaattccagaatgcaaatgtatgtttcaacttgattaaaaattccaattctgcattttttaatgcaggtgctagaggaaaacctggcctgggaagatgtacagtggtcacaaactggcgtctggattgcaggaaaggaatatacccttgctcgggtgcatttcttgtcaatgaattagttcattctcctgttttgttgaaagggag

SEQ ID NO: 6897 - DNA, 352 bp, Glycine max
ggcagcatccaggaaaaggaggatgggaattctgaagaagatggaggaactcaacttcctagggcaaaggatcgagaagcaccaagagaagataaagaaactacaaaaggaaatcaggaagaaggagatgagcatgttcatatatcggtgcgttcatgcagggaggcttctgcctggtagcgacaacatgaccctggatgatatgaacaatcttgtgtcgatcgttgaacagaaaatgaaggacattagtggaaggtttgaagccatggatgttaaggagaagacaccacaccaaccacagatccaatcaccagcgttggatgagtgcaaaccccatttaaaggcagaagaa

SEQ ID NO: 6898 - DNA, 459 bp, Glycine max
  misc_feature (355)..(357): n is a, c, g, or t
  misc_feature (359)..(360): n is a, c, g, or t
  misc_feature (364)..(364): n is a, c, g, or t
  misc_feature (395)..(395): n is a, c, g, or t
  misc_feature (417)..(418): n is a, c, g, or t
  misc_feature (420)..(421): n is a, c, g, or t
  misc_feature (431)..(433): n is a, c, g, or t
  misc_feature (440)..(444): n is a, c, g, or t
  misc_feature (446)..(448): n is a, c, g, or t
  misc_feature (450)..(450): n is a, c, g, or t
agatttgtacaggccatggagatactttcagaggaaacacaaagcaatggactcatcaaactcaaagaagtgcctattgaaccatcagaagaaggtaagccaagtggggaatcagagaggaatgcttcagaaactgaaaaacctgaaacttccattgtgactgaggtggttcctatgcctgaggagagagtaattgaagaaattccaactgatgcaaagtctgtagagaaggtaacaaaggaagctgcatcaagcacagaagagacaagccataatggggtggagaatgcacctaaggttgttgatgctggaactgagattcactaagacctcaaatctgaatgagaaccaagannnanntacngtggaggtttcaggtatttcaatttaagaancattcctctctgagtcccccanntnnttaaccttcnnntgatggnnnnntnnncncttctttga

SEQ ID NO: 6899 - DNA, 397 bp, Glycine max
tgtgtcgaggaagatgcatcgggaagaatgggttgagcaagttccgaatggaaaggggacttgagaggtggactgtagattgcagctgcggggccaaggacgatgatggagagagaatgttggcgtgtgatatatgtggagtgtggcgacacaccaggtgttctgacatccatgatactgatcctgttccagctcgttttgtttgcctgaaatgccaaaactgtgaatcaaaactcaaatgtagtgggcactgcaaagatgagaccgtgactaacgttagtggtagtagttgcttcagaaacggcttgccagtgccatctgatgttatttgattagtcagattagatgtgtatgaaaagctccttttttttttgttttggcctgaaaaaacttgaaa

SEQ ID NO: 6900 - DNA, 678 bp, Glycine max
gctatgataatggatctcaggcttggaaccaggggaatgcagataaggagcatccaagctggaaccaagctggaaataagcagagctggagttcagcaagtggtggaggtaacaataattggaacaacaatgggtcatcgcagactgcagaggctagctggaaaaaatctacaactgaagggaccaatatccagggtggtgggtggaacaagggatctagttcaaacactacttctaaggactggggtcaatcaagtgctgcagacaagggtcaagcatctagttggaaagaagcagcagatggtaagaaagaaataatgataaccgaatagaagtccatcggattatcctctatttttgttttattattaaaattgcggtagtgttcaaaagaaaattaagttactatgcaaattaatgattttaatttccagttcagaatcattattaattataagttaaccttcaaatcacaacatagttaatctaatgttttatcaatataaatttacatatacgagatttattctcaccttaattcatagacttgtgactatcattatatgtaggtgcatcaggttcatggggcaagaaaaatgacgggggtgacaaaggtggatggtaattgctttcttgaacgtgctagatgggccaaagaagggaagaattgagttcact

SEQ ID NO: 6901 - DNA, 751 bp, Glycine max
ctaagatgacggctctggttttaaagatttcattgatgaaacttgttggacgcctctcaacctttcaatggggactcttcatcaggtataaattagaagtaaagagtaacaacattataaataagtgaatgataataacaacttatttgaatatagttttttttaataaacataaagaatgtgtttgggtgtcaacaaaggtgggttgagttgataagaaatgaacttatcctacagtgatgtggtttgatttccgctgctgaggtgaacatcttattaatgaataatcttttataagtacgtattgaaccttaaggtctattcaaattctagtgaagtctttctggatctcattcacctaaatttttcttcattaaaaatataaaagaatgtatttgggtcttgggtaacagtttttggatatttgttctcaaattttcagtggtacactgattcgaagacacaggctgagagagagttgctgagttatggaagcggtgaaaatggcgggggattggaggtggtgagtttggcttgtggcctggtgggaggggatactcttctgagttacacacccttgagtgttacattgctttcctctcaggtacaagacaatgaagccgcataccagtctttgaagttcttagaagaattggatggaaaaatcccaatagttcacgttgaagatgtctgtgaagctcacatcttctgcgcggagaatccatcaattaatggcagattcttggttgca

SEQ ID NO: 6902 - DNA, 374 bp, Glycine max
tgaagatgcccttgatatgaactccaataatgtgcaagtgaaagacgccttatcctcgtgtcttgccgagcttaattatcgacagttttagccaattcatggaaagagtttacccaggagaatcattttgcttccgatctcttctttgcaatgatgttatatctatcgttgatccagcacctgcggcaggaatatttgcataagtaacctttgacacaaatgagttttggttcccagtgtcgtagtctatattgattctccctagaatcagatgaagacagcgcgtatagtaacagcaataataaggttaaaatgtaaccatttttgctttgcatttttgtatcatgaaactccttccaacacaattaccatga

SEQ ID NO: 6903 - DNA, 417 bp, Glycine max
gcaaacaaccccaacaaagaaaaccaagcccaagaagaagaactcaccccacccagtgaaggtagtctacatatccaaccccatgaagatcaagaccagcgcctccgagtttagggctttggtgcaagagctcaccggccaggacgccgagtccccaccagatccctctcgcttccacggccatcaccccgattcctcctcctccgtcgagaatatcgaagaggaggaggaagaggataatattcaccgtgtgaattgtgttgtccctcctatgacagcaaccgatgagatcagtcttctcatcggctgctgcaaccagaacggacaacatcagccttcctcaatggagagtaataatttccagctgctggacgacgatgacgttttcacgccccagatgattgagaacatctctgc

SEQ ID NO: 6904 - DNA, 776 bp, Glycine max
  misc_feature (488)..(488): n is a, c, g, or t
  misc_feature (491)..(493): n is a, c, g, or t
  misc_feature (496)..(496): n is a, c, g, or t
  misc_feature (501)..(501): n is a, c, g, or t
  misc_feature (510)..(511): n is a, c, g, or t
  misc_feature (521)..(522): n is a, c, g, or t
  misc_feature (525)..(525): n is a, c, g, or t
  misc_feature (552)..(552): n is a, c, g, or t
  misc_feature (554)..(557): n is a, c, g, or t
  misc_feature (560)..(561): n is a, c, g, or t
  misc_feature (564)..(565): n is a, c, g, or t
  misc_feature (579)..(582): n is a, c, g, or t
  misc_feature (585)..(587): n is a, c, g, or t
  misc_feature (596)..(601): n is a, c, g, or t
  misc_feature (603)..(608): n is a, c, g, or t
  misc_feature (613)..(615): n is a, c, g, or t
  misc_feature (617)..(624): n is a, c, g, or t
  misc_feature (626)..(626): n is a, c, g, or t
  misc_feature (631)..(631): n is a, c, g, or t
  misc_feature (633)..(633): n is a, c, g, or t
  misc_feature (636)..(637): n is a, c, g, or t
  misc_feature (665)..(667): n is a, c, g, or t
  misc_feature (669)..(670): n is a, c, g, or t
  misc_feature (672)..(677): n is a, c, g, or t
  misc_feature (686)..(692): n is a, c, g, or t
  misc_feature (696)..(702): n is a, c, g, or t
  misc_feature (704)..(706): n is a, c, g, or t
  misc_feature (721)..(726): n is a, c, g, or t
  misc_feature (730)..(739): n is a, c, g, or t
  misc_feature (742)..(752): n is a, c, g, or t
  misc_feature (760)..(763): n is a, c, g, or t
ccatcattccaccggcgccgtcgacctcaaaggctcgaaccaccttccttctactcaactgcactcgcactcgtcggcgcaagctcccaccgtcgcacgcctcagccgcttccagttaacaaggtacggtgctcttagtttgttgctcttcttacttcttagtaagttcttaatcagtgcggtgggtttaatgcatgtgtaaacaaacattttcatatttttttaatacagaccgagtcatgcagctcagtcagtgactcactcgctgcagtgacacagtgccttgaccggatcggtttttaagtccactgttttcctttttcgtctcataggaaaggttgttggttgttcacatttgattaacgatgtggatttttatgttgttgaattctctaattggagcaaaatccctctctcatcctaattttttgttttcaaatttttattttcagtttttttttttttttttttttttttgggaaattttnggnnnaanttggnttttttttnnaaaaaaaccnngantttttcctttccccctttttttttttnannnnaannaannctaaaaaccccttnnnnggnnngttttaaannnnnngnnnnnnggatnnncnnnnnnnnanccccntntannaaaattttccccggggaagggggaaaannnanntnnnnnnaaaaggggnnnnnnntttnnnnnnntnnnttccccccccaaaannnnnngggnnnnnnnnnnaannnnnnnnnnngggggggnnnnggggggggccccc

SEQ ID NO: 6905 - DNA, 612 bp, Glycine max
atggtactatctcttatttgatatcttattaacattttccttttccacttcctctttattttgttgcacttatttgtacgaaacatctatttaagatatttataatttctcaatttatttaatcccgtttgatgtttacctgatcattcaccatatctcattttgtggcatttctgacaaaaaggagaaagaattggctttgaaagagtatgagtctttggagactacaaataagaacttgaagacacaggtaagatgttttgctgtggtagaaatctgtaagcataatataacttttgtttgcaaagaaagtatatcaatacaggtaaatcaacattatcttccatttgcagatagccaagtcaataaacactgaagtggagaaaactcctgttgagcctgtgtcatctgtggctgagataacaccttcatccggtaatggtccatggttcctttataacctttttccagttccacaaatattttggccttccatccttcaatcttctaatccaattcatctacaaaatacatcatttaattccatcgccattccacctaatgctaatgtttcatgttcttctgagtctgaatcacatcacaagcaaaaaa

SEQ ID NO: 6906 - DNA, 600 bp, Glycine max
catcctccacccttaacgacgacgtttcctgcgaggaatgcggcggtggccactccccttccaagcttattctctgcgacaaatgcgaccgtggctaccacctcttctgcctccgtccaattcttccctctgttcccaaaggctcttggttctgcccctcttgctccaatcacaaacccaagtgtatgtattgcatgcatcactttcatttccattcagatcccaaatcgatcaaactagtgtgtacttaatattcatgagctagattttagggtttaattagatctcaatagggttttctttacattctatcaattaacctccggtgcttttgaaaattgcagctttcccccttgtccagaccaaaatcatcgacttctttcgaatccaacgctcccctgaggcattatcaaatcaaggtaaggcaaaaccattttcaaatttattattgttatttggattaaaggttgaaacttgaatctggtgtgtggtttttagacacgcggaggaagcgaaagcggggtgggggcttggtggtatcgaagaagaagaggaagctgttggcgttcgtgccgagtgaggatcccaatagaagattgg

SEQ ID NO: 6907 - DNA, 701 bp, Glycine max
tagttttggcatggcatttaagctatttcatgggaaggatggagtcattcccctatctgagaaatctgactttcacaatggcagcacagaagcagattctctgcctgttttcaaccctttggcaggaagagctgcctccataagtctgtctggaccaggtggcccatttagtttttggaatttttctgagaaatggaagaagcagaagaattccgaatcatcaaataaaaaggaatactcacctcaggtaaacatttgttctttattttctttttttcctttttctttttgtttcacacacacactgataggcatgtttgtagaaaggaaatccattgtgtcaattagcatttcatcattgtctatcattttgataaatttacacccatctgacttgcaataattttgctgtcagcgtttgtgatcacaggacaattttgatgtgcttcatgattttcttttcctgttgcttactaattatcgtgaactagtttaagtaacttcaaaaacatgagttgcattgatttttcttactcgggtgagcttcatttcagaatggagatgtatcaaagcatgaggcacttggaaatgaatggttggccaaaggaacttgcccaattgccaagtcttatagagctgtaagcaatgttctaccccttgttgcaacagcttttcggccaccgagtggagtgaagcttaat

SEQ ID NO: 6908 - DNA, 584 bp, Glycine max
  misc_feature (422)..(529): n is a, c, g, or t
  misc_feature (534)..(545): n is a, c, g, or t
  misc_feature (547)..(549): n is a, c, g, or t
  misc_feature (551)..(556): n is a, c, g, or t
  misc_feature (559)..(565): n is a, c, g, or t
  misc_feature (567)..(578): n is a, c, g, or t
attttcttactcataaatattttcccaattgcatgctatcaatgcactatacagatccttctacttctacttgatgaagaactactaagcagcaacatggcaccccaaaagggcctaatggttatgctcaaattaccaatgcaccctcttgtaaaggactatgcatgatctcaggtcttcaatgtaatatattttgtactccatggcagatttctacaagtgtgcttcatttagatcctgtgctcttgtacctgctgaagagagttccccttggaaacttcaaaacatgttcactcttttaatcctttactgaatactagctttgtttattatagcagtaagtctatgattttgcattctatatatggtcgtaatagtactgttgaattttaattcctcgttgtttgcagcagattataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctnnnnnnnnnnnncnnncnnnnnnccnnnnnnncnnnnnnnnnnnncccccc

SEQ ID NO: 6909 - DNA, 399 bp, Glycine max
acgtagtagcatagtaaatattagtataatttttccctggcagtgtgagcatgcttgactttacatttttggtggttattgccatagatgtgtaagaaatgaggttgagaattgagatagggctagtaggtgttttggaggttgctgcaagtttgattctggcttgtgctcagctgttggaagttggactgactgacagaacaaacaagaaagttgtgtctggtagaaaaaaattctagtgaaatctgctaacggcttgtatttgtaagtaaactgaagcttttgtggctgcctctgttttgagagtgcttcaatgctacacagcccaaatgcatctgtatcttttaaacttatgttatacaaatacaactacatgtctcgaatgtctctgtgaattca

SEQ ID NO: 6910 - DNA, 380 bp, Glycine max
gctggtcttacaattcaggtcccattggctgccattgtggataccttgactggcaatgctccgcgctttatggattaccttggagcgatagctgtcatgattggcttcactggaatcaacattccttctgatacttttagcaaatccacagaaactactgtggcattggaaaatgagaacttgaatacaaggactgaagagcttactttgtctataagccaagattcagttgccatatcatagcattgtacattacattcacttcacggtttagttgacgggtggtctttttgtaaccatgccagattaattgcaaaatctgaaatgtactactataccagacaggaaaatagaaaaggtagaacaacggaagatggttc

SEQ ID NO: 6911 - DNA, 396 bp, Glycine max
ttctttgatcaattggaggggagcactgaaaattgaattaactatggaatatcagctttggaatagctttattttgttttgccatttcttctagccattggcctttttgcttgctcgaatgaattcatcggtgactggtaattttgccaggttagtttaacatgttcgctgttgttaggcatgctttgttttccttgattgagtaataaatagatttggaaatggttttgcagacagttttctgtttgtttccatctgttttgcctctttaaaattgtattaccccctttttttccgaagggagaatgatcatacactgcatgggagctcttatggacctgtatatttcatttctgtattagtttattactttctggtttggtttcttggtctaaa

SEQ ID NO: 6912 - DNA, 1228 bp, Glycine max
  misc_feature (431)..(435): n is a, c, g, or t
  misc_feature (458)..(458): n is a, c, g, or t
  misc_feature (471)..(473): n is a, c, g, or t
  misc_feature (488)..(488): n is a, c, g, or t
  misc_feature (516)..(517): n is a, c, g, or t
  misc_feature (537)..(538): n is a, c, g, or t
  misc_feature (545)..(547): n is a, c, g, or t
  misc_feature (550)..(555): n is a, c, g, or t
  misc_feature (562)..(575): n is a, c, g, or t
  misc_feature (591)..(604): n is a, c, g, or t
  misc_feature (606)..(606): n is a, c, g, or t
  misc_feature (615)..(638): n is a, c, g, or t
  misc_feature (640)..(643): n is a, c, g, or t
  misc_feature (649)..(650): n is a, c, g, or t
  misc_feature (653)..(658): n is a, c, g, or t
  misc_feature (661)..(665): n is a, c, g, or t
  misc_feature (670)..(673): n is a, c, g, or t
  misc_feature (675)..(683): n is a, c, g, or t
  misc_feature (688)..(708): n is a, c, g, or t
  misc_feature (711)..(722): n is a, c, g, or t
  misc_feature (724)..(765): n is a, c, g, or t
  misc_feature (769)..(778): n is a, c, g, or t
  misc_feature (780)..(782): n is a, c, g, or t
  misc_feature (789)..(790): n is a, c, g, or t
  misc_feature (793)..(793): n is a, c, g, or t
  misc_feature (795)..(796): n is a, c, g, or t
  misc_feature (799)..(799): n is a, c, g, or t
  misc_feature (803)..(803): n is a, c, g, or t
  misc_feature (810)..(815): n is a, c, g, or t
  misc_feature (820)..(824): n is a, c, g, or t
  misc_feature (829)..(832): n is a, c, g, or t
  misc_feature (837)..(839): n is a, c, g, or t
  misc_feature (844)..(844): n is a, c, g, or t
  misc_feature (846)..(856): n is a, c, g, or t
  misc_feature (859)..(870): n is a, c, g, or t
  misc_feature (873)..(888): n is a, c, g, or t
  misc_feature (893)..(896): n is a, c, g, or t
  misc_feature (903)..(907): n is a, c, g, or t
  misc_feature (911)..(912): n is a, c, g, or t
  misc_feature (918)..(921): n is a, c, g, or t
  misc_feature (927)..(932): n is a, c, g, or t
  misc_feature (935)..(939): n is a, c, g, or t
  misc_feature (944)..(947): n is a, c, g, or t
  misc_feature (952)..(953): n is a, c, g, or t
  misc_feature (969)..(969): n is a, c, g, or t
  misc_feature (973)..(977): n is a, c, g, or t
  misc_feature (980)..(982): n is a, c, g, or t
  misc_feature (985)..(985): n is a, c, g, or t
  misc_feature (987)..(992): n is a, c, g, or t
  misc_feature (994)..(1000): n is a, c, g, or t
  misc_feature (1002)..(1004): n is a, c, g, or t
  misc_feature (1006)..(1015): n is a, c, g, or t
  misc_feature (1019)..(1023): n is a, c, g, or t
  misc_feature (1025)..(1031): n is a, c, g, or t
  misc_feature (1053)..(1055): n is a, c, g, or t
  misc_feature (1057)..(1059): n is a, c, g, or t
  misc_feature (1064)..(1070): n is a, c, g, or t
  misc_feature (1080)..(1081): n is a, c, g, or t
  misc_feature (1096)..(1102): n is a, c, g, or t
  misc_feature (1105)..(1111): n is a, c, g, or t
  misc_feature (1113)..(1117): n is a, c, g, or t
  misc_feature (1119)..(1121): n is a, c, g, or t
  misc_feature (1132)..(1135): n is a, c, g, or t
  misc_feature (1137)..(1142): n is a, c, g, or t
  misc_feature (1145)..(1146): n is a, c, g, or t
  misc_feature (1149)..(1151): n is a, c, g, or t
  misc_feature (1153)..(1154): n is a, c, g, or t
  misc_feature (1157)..(1170): n is a, c, g, or t
  misc_feature (1172)..(1178): n is a, c, g, or t
  misc_feature (1186)..(1195): n is a, c, g, or t
  misc_feature (1199)..(1205): n is a, c, g, or t
  misc_feature (1210)..(1214): n is a, c, g, or t
  misc_feature (1216)..(1220): n is a, c, g, or t
tatccttgtgttgcttctctatccatttctttgggcttggactgtaattggtaccctgtggttcagcagtgccaagaactgtgtatgttttattcctgttttaccttcagtgtactcttgttaacaagcttttgatgcacaatgcaattaattacttgcagttgcctgaagtgggtaaaaaatggggctttctcatctggttactttttagctactgtggactcttttgcattgcttgcatgtctctggggaaggttagtagtggtctattgctacctgttatatgtttttacagcttgtttctgtgtgccaaatctttttgtttggcttgtcatgtttttcttgtttctgaacaacccatcaacagggaatttctacagaatactattctccttcgttgtttcatatctaggttagcgatgctctcattnnnnnttgtttaactctttgcagcggtngactcgaagacannncatttattgcgtgantttaactctttgcagtggttgactcgannacagcacatttattgcgtgnnggaaaannnccnnnnnnccaaaannnnnnnnnnnnnnaaaaaacaaacaacannnnnnnnnnnnnnancaacccacnnnnnnnnnnnnnnnnnnnnnnnntnnnnctcccnnccnnnnnnacnnnnnttcannnntnnnnnnnnnaaatnnnnnnnnnnnnnnnnnnnnntannnnnnnnnnnncnnnnnnnnnnnnnnnnnnnnnnnnnnnnnnnnnnnnnnnnnncttnnnnnnnnnntnnncttcaannacncnnccncacnacccccnnnnnncccannnnnatctnnnnttctnnnccccntnnnnnnnnnnncannnnnnnnnnnnccnnnnnnnnnnnnnnnnccccnnnncccaccnnnnnaatnntccctnnnnctccannnnnncannnnnccccnnnnccctnnttcctcccccccccantatnnnnnttnnncancnnnnnntnnnnnnncnnnannnnnnnnnnattnnnnncnnnnnnnccttatccactcaccccctatnnncnnncctcnnnnnnnccctcccccnnccccccttctttccnnnnnnnccnnnnnnncnnnnntnnnctctctttttnnnntnnnnnnccnnccnnncnnccnnnnnnnnnnnnnntnnnnnnncccccccnnnnnnnnnnttannnnnnnctcannnnntnnnnnccacccca

SEQ ID NO: 6913 - DNA, 359 bp, Glycine max
acaatgacattgcttattttctcctttggtattagtggcttgaacttttgatgtaattgcttttatgcaaatttttttaatagcagcaatttggatggagtgaaatacaccactttaggttatctctggctttggtgaatcgtatgaatggaagcctgatagctctgctgtaagagaagtgttagcgacacactccctaacacacttcctattattattagtgaaaatttattggaaattacaaagtttgagtgaaactcattaaatagttaagacttaccaataaatttcagtcactaataagtgtgttaagtatgttgttaacatttttcttactgtattcatctgtgaagcctgct

SEQ ID NO: 6914 - DNA, 366 bp, Glycine max
gaatttgaggatgtgagcagcttcatgactggcattgaaatcaaaggatcagatacaaattaccagaattcatcaggaagtaccagcatgatgggtggtgtagactattattcaccaagagatgtttctaaaccgatccttaaggagactctttgggagggtaggtgagaattggtgtactctttagtgattagatcaagtactgtggcataatgggtaatggaactacactccaaaaattgtttccattttctatttttcattttctttagcctttttttttgtattgtatacttaattcgttgtgtaaataacggcctaagttagtaattaaaaactgtacatcaacgtgttagtaataagccc

SEQ ID NO: 6915 - DNA, 538 bp, Glycine max
aatgtttcgacgacgatggtcgccccaaacgaaccggtattaaaagcaagcttcatattatttttggcctttttgttgtgtttctaattcctctcatacacatattatgatgtgtttgagatgtacagggacggtgtggactgcaagtgcacacataataactgcagtgattgggtctggggtgctgtctctggcttgggctatagctcagcttggatggattgctggtcctattgtcatggttctcttttctgccatcacttactacacttccactcttctctctgattgttatcgtactggtgatcctgtaactggcaagagaaactacacttacatggacgctattcagtctaactttggtaaaattcacccacctaactcactcaattaaactctctttcttgcagaattttaatcttggttatgtggttgtgcttcttcaggtggaaatggctttaaggtcaagctgtgtgggctagttcagtacattaaccttttcggagtcgccattggttacactatagcggcttccact

SEQ ID NO: 6916 - DNA, 1503 bp, Glycine max
  misc_feature (461)..(462): n is a, c, g, or t
  misc_feature (512)..(515): n is a, c, g, or t
  misc_feature (517)..(517): n is a, c, g, or t
  misc_feature (526)..(530): n is a, c, g, or t
  misc_feature (532)..(532): n is a, c, g, or t
  misc_feature (541)..(541): n is a, c, g, or t
  misc_feature (553)..(558): n is a, c, g, or t
  misc_feature (560)..(579): n is a, c, g, or t
  misc_feature (588)..(589): n is a, c, g, or t
  misc_feature (594)..(595): n is a, c, g, or t
  misc_feature (597)..(602): n is a, c, g, or t
  misc_feature (604)..(604): n is a, c, g, or t
  misc_feature (611)..(611): n is a, c, g, or t
  misc_feature (613)..(613): n is a, c, g, or t
  misc_feature (618)..(621): n is a, c, g, or t
  misc_feature (631)..(633): n is a, c, g, or t
  misc_feature (635)..(641): n is a, c, g, or t
  misc_feature (643)..(644): n is a, c, g, or t
  misc_feature (646)..(646): n is a, c, g, or t
  misc_feature (648)..(648): n is a, c, g, or t
  misc_feature (651)..(663): n is a, c, g, or t
  misc_feature (672)..(675): n is a, c, g, or t
  misc_feature (679)..(692): n is a, c, g, or t
  misc_feature (696)..(720): n is a, c, g, or t
  misc_feature (722)..(727): n is a, c, g, or t
  misc_feature (730)..(731): n is a, c, g, or t
  misc_feature (734)..(737): n is a, c, g, or t
  misc_feature (739)..(740): n is a, c, g, or t
  misc_feature (753)..(771): n is a, c, g, or t
  misc_feature (774)..(778): n is a, c, g, or t
  misc_feature (784)..(792): n is a, c, g, or t
  misc_feature (794)..(796): n is a, c, g, or t
  misc_feature (801)..(803): n is a, c, g, or t
  misc_feature (805)..(806): n is a, c, g, or t
  misc_feature (808)..(817): n is a, c, g, or t
  misc_feature (821)..(828): n is a, c, g, or t
  misc_feature (830)..(830): n is a, c, g, or t
  misc_feature (832)..(837): n is a, c, g, or t
  misc_feature (840)..(843): n is a, c, g, or t
  misc_feature (845)..(848): n is a, c, g, or t
  misc_feature (851)..(855): n is a, c, g, or t
  misc_feature (861)..(865): n is a, c, g, or t
  misc_feature (869)..(874): n is a, c, g, or t
  misc_feature (878)..(881): n is a, c, g, or t
  misc_feature (892)..(893): n is a, c, g, or t
  misc_feature (897)..(898): n is a, c, g, or t
  misc_feature (901)..(901): n is a, c, g, or t
  misc_feature (904)..(915): n is a, c, g, or t
  misc_feature (919)..(920): n is a, c, g, or t
  misc_feature (925)..(929): n is a, c, g, or t
  misc_feature (931)..(938): n is a, c, g, or t
  misc_feature (940)..(940): n is a, c, g, or t
  misc_feature (946)..(948): n is a, c, g, or t
  misc_feature (954)..(956): n is a, c, g, or t
  misc_feature (959)..(965): n is a, c, g, or t
  misc_feature (968)..(972): n is a, c, g, or t
  misc_feature (976)..(984): n is a, c, g, or t
  misc_feature (987)..(1004): n is a, c, g, or t
  misc_feature (1011)..(1012): n is a, c, g, or t
  misc_feature (1014)..(1020): n is a, c, g, or t
  misc_feature (1024)..(1028): n is a, c, g, or t
  misc_feature (1037)..(1038): n is a, c, g, or t
  misc_feature (1040)..(1047): n is a, c, g, or t
  misc_feature (1049)..(1078): n is a, c, g, or t
  misc_feature (1081)..(1090): n is a, c, g, or t
  misc_feature (1093)..(1102): n is a, c, g, or t
  misc_feature (1107)..(1110): n is a, c, g, or t
  misc_feature (1113)..(1113): n is a, c, g, or t
  misc_feature (1115)..(1122): n is a, c, g, or t
  misc_feature (1124)..(1129): n is a, c, g, or t
  misc_feature (1131)..(1136): n is a, c, g, or t
  misc_feature (1142)..(1147): n is a, c, g, or t
  misc_feature (1155)..(1156): n is a, c, g, or t
  misc_feature (1158)..(1163): n is a, c, g, or t
  misc_feature (1166)..(1171): n is a, c, g, or t
  misc_feature (1175)..(1181): n is a, c, g, or t
  misc_feature (1183)..(1199): n is a, c, g, or t
  misc_feature (1203)..(1215): n is a, c, g, or t
  misc_feature (1218)..(1218): n is a, c, g, or t
  misc_feature (1223)..(1236): n is a, c, g, or t
  misc_feature (1238)..(1255): n is a, c, g, or t
  misc_feature (1257)..(1262): n is a, c, g, or t
  misc_feature (1264)..(1269): n is a, c, g, or t
  misc_feature (1271)..(1277): n is a, c, g, or t
  misc_feature (1279)..(1285): n is a, c, g, or t
  misc_feature (1287)..(1288): n is a, c, g, or t
  misc_feature (1291)..(1295): n is a, c, g, or t
  misc_feature (1298)..(1300): n is a, c, g, or t
  misc_feature (1302)..(1307): n is a, c, g, or t
  misc_feature (1313)..(1321): n is a, c, g, or t
  misc_feature (1325)..(1330): n is a, c, g, or t
  misc_feature (1333)..(1350): n is a, c, g, or t
  misc_feature (1353)..(1359): n is a, c, g, or t
  misc_feature (1362)..(1372): n is a, c, g, or t
  misc_feature (1376)..(1385): n is a, c, g, or t
  misc_feature (1387)..(1392): n is a, c, g, or t
  misc_feature (1394)..(1394): n is a, c, g, or t
  misc_feature (1396)..(1400): n is a, c, g, or t
  misc_feature (1402)..(1402): n is a, c, g, or t
  misc_feature (1406)..(1408): n is a, c, g, or t
  misc_feature (1414)..(1417): n is a, c, g, or t
  misc_feature (1422)..(1429): n is a, c, g, or t
  misc_feature (1431)..(1441): n is a, c, g, or t
  misc_feature (1443)..(1452): n is a, c, g, or t
  misc_feature (1456)..(1462): n is a, c, g, or t
  misc_feature (1464)..(1464): n is a, c, g, or t
  misc_feature (1467)..(1469): n is a, c, g, or t
  misc_feature (1475)..(1493): n is a, c, g, or t
  misc_feature (1495)..(1496): n is a, c, g, or t
  misc_feature (1498)..(1500): n is a, c, g, or t
actaatacaggttagtgcagccttctgcttttgtgccatttactaaggttattgttttacatattgaaagtgcctcataatttctgttgctcatatctgttgtactgctataattggttagcccattcttgtgatgcttttaatataattcatgcatttggcaaattccaattgaagggaaagactactcgcatacatggttaaattttgaaataatgttgatgcaggcatgaattctaccagaaacctgatgaaatggttattaccatatttgcaaagggcattccacgagacagcattactgttgactttggtgaacaaatagtatgactcacattaattatcataatatttagtaaattcatgttacaaccccatcagttacagtcccttacatcattgatgaataatattctaagattgctccttcctttttttcttaattcttttttatgatgttnnagttaagagttacaattaatatcccttgcaaagatgcttatgtcttccannnncngcttatttnnnnngntatgaatgncagcttcgttcnnnnnnannnnnnnnnnnnnnnnnnnntttaatgcnnaaaannannnnnntngattttntnctttnnnncaaaccctcnnnannnnnnnannangnttnnnnnnnnnnnnntcgaaattnnnnttgnnnnnnnnnnnnnnatcnnnnnnnnnnnnnnnnnnnnnnnnnannnnnnacnnaannnncnnaacagagtcttannnnnnnnnnnnnnnnnnnccnnnnntcctannnnnnnnntnnnttttnnncnncnnnnnnnnnntttnnnnnnnnanannnnnnatnnnncnnnnttnnnnntatttnnnnnttcnnnnnnaacnnnnctttaggcgcnnatanntcncannnnnnnnnnnntatnnacctnnnnntnnnnnnnntnttaccnnncccttnnnccnnnnnnnttnnnnnattnnnnnnnnnttnnnnnnnnnnnnnnnnnnttttctnntnnnnnnncaannnnnataacaatnnannnnnnnntnnnnnnnnnnnnnnnnnnnnnnnnnnnnnntcnnnnnnnnnnctnnnnnnnnnnttttnnnnccnannnnnnnnannnnnncnnnnnncccccnnnnnntctatctnngnnnnnnagnnnnnnctannnnnnncnnnnnnnnnnnnnnnnnattnnnnnnnnnnnnntancaccnnnnnnnnnnnnnnannnnnnnnnnnnnnnnnnannnnnnannnnnncnnnnnnnannnnnnntnntcnnnnncannntnnnnnnccccannnnnnnnnaccnnnnnnaannnnnnnnnnnnnnnnnnacnnnnnnnttnnnnnnnnnnncttnnnnnnnnnntnnnnnntntnnnnntnaacnnntttccnnnntatcnnnnnnnntnnnnnnnnnnnannnnnnnnnntttnnnnnnncnttnnnactaannnnnnnnnnnnnnnnnnntnnannngtg

SEQ ID NO: 6917 - DNA, 656 bp, Glycine max
ttgagtgttaatgacataggaagggcaataaaaataatcaaggtgaggttcttaacaaggtagagatgataccttagcagttttctcctgtaacctttatgtttatggcacttttgctctatgatgtgctcaaatatgtgtacagaagcaaaatcccagctgctcagttatggtggacaattgctatggcgaatttgttgaaagcattgagcctcccatggtggtatgtggtaacaagacacacttgtgtttgctgctttattccaagaatgtgtagcatcacattgtaaattggtgggcagggtgcagatttgattgcgggcagtttgatcaagaatccaggcggaacaattgcaccgtgtggtggatacattgctgggaagcaaaaatgtgttgaagcagctgcagcccgtctttctgcaccaggacttggtgtggattgtggttcgacccctggtgatatcatgcgagcctttttccagggattgtttctttcacctcaaatggttggagaagcaatcaaggtaagagattcttcatttttatgggagagaatgtgcttttgatgcttgtatcttgtagtgagacaattatgtattctatgtaagggatccttcctgattgctgaagttttggcatctaaaggctataaagtg

SEQ ID NO: 6918 - DNA, 401 bp, Glycine max
  misc_feature (309)..(311): n is a, c, g, or t
tgacaaggagctggagacctatcatgctgaagccatgaacatctcttgatcttggaagccgcagtttattttgtaatatcacttaagattggcttccttgtacaaagctggtttccttggcgtttactttgaatctcttactgcttggtgcttttaaacatgccatcttatttgaccgcatttaagtaattgttagaggctgaatgatctacttggggatttttgaagttcagagatatagattgtagtttgatttgcgtatcattattttatgttattgctgcaacctgcaattgtcttcccaaaaannnagggaggggaagcttcttgttttcttctttttgtggttcgtctagtgactacatggtaatgtcaagttgtcaaggacgaccacgaataac

SEQ ID NO: 6919 - DNA, 368 bp, Glycine max
  misc_feature (354)..(356): n is a, c, g, or t
gtgtttggagccagcaatgtgagcaagattctgattgaagtgccagaagagcagagagaggacacggtgaattctctggcttatgaggctgaggcaaggctgagagacccggtttatggatgcattggtgccatagctctgttgcaaaggaagatggtggagcttcaacatgatctggcaattgcaaaggatcgtcttgcgcgttgtcacgctgctgctgctgctgctactactactatcccttctcctgatatcttgcatgccaatgttagccttcccccattccctgacttttgcacttcttcaagtgatttcaatgatatcttttgccacagttcttcgtctcaattattnnnccgacattatta

SEQ ID NO: 6920 - DNA, 391 bp, Glycine max
  misc_feature (7)..(7): n is a, c, g, or t
gagtctnatatgctccgtggagttgaagcatggtttgctcagcccatattcaacatggttctacgaatggtcgtcgggaagcggtttctgagtgccacggcgaccgacgagaaggcagagaagtgtgtaaaggctgtggacgagttcatgcgtctggcgggcgtgttcaccgtcggagacgctattccgtatttgagatggcttgattttggtggctatgagaaggccatgaaagaaactgccaaggaattggatgtgatgataagtgagtggttagaggagcatcgacaaaagagggctttgggtgagggcgttgatggagctcaagacttcatgaacgtgatgctttcctcgcttgatggaaaaactattgacggaatcgatgcagata

SEQ ID NO: 6921 - DNA, 444 bp, Glycine max
  misc_feature (358)..(358): n is a, c, g, or t
  misc_feature (366)..(370): n is a, c, g, or t
  misc_feature (373)..(376): n is a, c, g, or t
  misc_feature (378)..(378): n is a, c, g, or t
  misc_feature (393)..(419): n is a, c, g, or t
  misc_feature (421)..(431): n is a, c, g, or t
  misc_feature (434)..(441): n is a, c, g, or t
ctctttctctctctctctcttaattcctgaaaagcaagtagctaaggaaaacaaaaacatcctcacagaaactcacaaaggaaaaacaaacaaacaaacaaaatgtcttctccaagcaagcggcgagaaatggacttgatgaaactgttaatccctaatttcttctgttttccttttttttttaccttttctttcccttccaattaaaatctttttccatttggggggccaaatttgaacccggaatccggttttgaatggtggtttggtttttggttttcccccattaaaaagaagaagaagggctaccagggggaaaagaataaaggaggaatggaaaaattttatgggccctttnctggaccnnnnnaannnnanttcccctttggtttnnnnnnnnnnnnnnnnnnnnnnnnnnntnnnnnnnnnnnttnnnnnnnnaaa

SEQ ID NO: 6922 - DNA, 388 bp, Glycine max
gggatatggcaaggggacatcaaacgagaagccaacatccccgatagtttgttgaagaaatccatcaagatgcttatcaccaagaaactcgtcaaggaggttgtgaacgtgcagaacaggtccaagaagttgttgatggcatcggatttcgaaccctccaatgagatcagtggtggagagtggtacaccgaaggcaaactcgacacagaatttattgacaagctgtctgaggcttgctttagtagtattcgtcgcctgaaggtcgcgacttgtgagggcatccttgagtggattaggaaggcgggtggtggagtcagtaaagggcagatggagcagattttgaagaagttggttatggagaataaggtgcaggaagtgactagtgatg

SEQ ID NO: 6923 - DNA, 768 bp, Glycine max
  misc_feature (617)..(617): n is a, c, g, or t
  misc_feature (727)..(727): n is a, c, g, or t
  misc_feature (750)..(751): n is a, c, g, or t
gtttctcaggtatttaaagattgtcaccacttgcttaagaaacattttgttattcctttgatcttgtgaatttgttgcaaactaaccgtataatgtttcttgatttttatgtttataatttcaattttcaagtagagtgcttcagttttttgttatgttgatatctttgcattcaatttaccgtaacatgttaaaaaaatttattaagtattcctctggaaaccatctagtcaggaattttagatacctaaccaacctttcactggaagagaaaaaaaagaaaggaaaatatcaatatttccatcctccaggggtctgtttttctttgcagtttgtgctgtattttgccttttgctgtatggtatatttactgggttgactcctaccttttcttcgtatttgccttgtccttaacacgtgtaatttttataggttgtgactagtttggctgatccttctgctaatattatatttggggctgtcgttgatgatcgctacacgggggagattcacgtgactatcattgcaactggcttttcacagttttttcagaagaagttgctaacagatccaagggctgcaaagctgcttgacaaggtggctgagggccaagaaancaaggcagtccctcctcccctcaagtcctcaaacaaggttgaatttagaccatccccgcgaaagctctttttttagttgcatggttttttttaccctttttcatttttcncaattattattattatattatannggccgatcaaaaaaaat

SEQ ID NO: 6924 - DNA, 771 bp, Glycine max
  misc_feature (58)..(60): n is a, c, g, or t
gagatgctagaatcagttgattctgagggtgatactgtgagtatttatttacccttcnnnccttttgagttcctacccaactactcgcgatgctaacgtcaatcaagcatttctatccctaactgtcttttggtcatgtttgatgaatttctcctgatttgttctccatcattgtcttgtgatcattttctcacagcctctccatcacgctgcaagaggtgagcatattgatgtaattaggttgctgctgtctaatggcgcatctcccacaaaggcaaacttatacgggaaggtaagctctgaaaggaatgtggggcatttttggtttgagaaaacgttttgtttttactagtaatttaaaaatattatctgttttcactttgtttatactttaaaggatttgtgtatgaaatggtcaaagcattttattgtttttgctttttaagtgaaaattttataattattgaatgtagaaaatgtcttgtcaacttaaacagataaatatgaattacccatttctattcttcattaatttctaaaatatttttttggcaggcccctgcggatttgcctgaacaggaagatgctcggaggctgcttgaagctgcagctcttgccatggcatgccagtagcatttcagtagaaatatttagttccattttgacagagatgctacactttttggaccataaaatctgtatttcatacactactcttttttcgaagttcaaaaatcaaaatgatttattagaggagcaccataggaagtt

SEQ ID NO: 6925 - DNA, 949 bp, Glycine max
  misc_feature (918)..(920): n is a, c, g, or t
gtttttctcctttttatatatttttgttacattcctttggggttgcgttttggttgtggttgcattgcaggtcaatgtggtctgcaactcggtgcaattgagatgatgtagtcttcaatttataggtaatgagatactttttgtcttgttaggctggagaaaaagctgtaagctgtggagtaactaatgctgatagtattgatgagctcaacataataaaagatcttcatctcaggtaaggacaatcaattttcttattaacttttttatgtttagtgaagatgttttcgaagaataatgggaagtcacattttttttagacttaaaagctctctattagtcgttgtgtgttgttgtcttattttaggactgtggaacagcttggagtggacagaaatgttattgagagtgagctactttcttccatactatatcttattttggtcacattagtttttgcttgttatgtcatgcaagtttttattttattctaccataacctttctttcttgtcaatatgcatgttcaagtaattttgatatgtatgtactcatatttttgtcaacatcatatttgtctgtgatttccagagcatctagaagaattggagcaacttctaaaggggatagctatgatgaaagagttgactccacggactcaagactatttagtttcatttggagagtgcatgtccactaggatatttgctgcatatcttaatacattaggagttaaggcccgccaagtatgttttggttgcctatctaaaacttattacaaataaaaaagtttcgtaatggctgattaggattgtccaactctgaatctcgatcaatatagtttgtttctaaattttatttgtttgtttggcagtatgatgcatttgagatgggtattataacaactgatgacttcacnnnatgctgacatttggaagcaacatatcctg

SEQ ID NO: 6926 - DNA, 1234 bp, Glycine max
  misc_feature (1066)..(1067): n is a, c, g, or t
  misc_feature (1100)..(1101): n is a, c, g, or t
  misc_feature (1219)..(1221): n is a, c, g, or t
acatgtatagacaagtggctgaaggagattcacaggtatgtgaaaataggaatttgagttttcttcttgttaactataaaacttcgaatttatgcaaactcccaatttactggtgtactgtatctatgcatatctggactttacagcctcactgtatctatgcataagggtttatggcatagataaatgagctctacattttttgttcaagaagcacaactaatggaatttaatgctggcagaatttagatattttcaaaattatgagctggttaaattgtacattggcaaaatatggtgaatgttgaaccatcttatggtcatgtgccttagtctatggcagttatcgacctgataagatcttagtatcactagaatgactatctaactgtcattagacattggttttcatttcactgtggaaaaaactggagatttcatctactgccttgttttctatcgatacttctacctgtgctattctttccaaaacataagatatttggtgatggagttaatgtatatatttaaaattcaagagggaccgtaaatttaaatcatgaactcaatttcttgtcattaaagagcacctaatggtcgatgagattctagtctttaatttgtgctacatatatgcatgtgatgtacctaccattccatgttgttgacccaagtaatgatgaagagtgctcagaacacattctttctaatatacactttatcattggttgaaatatattgaaaactataaaattaggagatagactcgttaaatgataagtgagacccaccaaaatctaagattttcaataaatgtgttcaacagagtgtgtattcaacatttttcattggaataatttttaggttatttacataacattgttaagagtaacaccacttgctcttgattggctttggaagtttttgctgacttttttatattatgcacagggtatgcccactttgtcgaggggacatatgcatatctgattcagcgccaacagagaactcgagggactagtggttgatgaatatctgctttgaaacgtcctgtcacttgcctttnnttctgtaaatatcagaacttcactccttttctnntgaaactatcaatgcttatttactattatggctgaataaacatcaaatccatggtagagataaaaatgaccagcttaagggagaggacaaaaggtaaaagaaggttcataaaaggccnnngtgtgtatccata

SEQ ID NO: 6927 - DNA, 338 bp, Glycine max
gattacttatgttgttttgagattccaatgagtggacaaagtttttgttggaatcgaaaggatagtgaagagcaattaaaagagtctatgtggtagacacgattttagcctttaagaccatacaaatgaaaagtatggtgaacaacatccgactccaacaggttgttgtttattcggcctaatcatctagggttaacgtgcgttgtcatcaaaatccatctgggcgtttgagagaatgaaatcaacttcattgttccatttgctgaacatgccttgagaaatgtgaatcttcccttatcacttcagtaagcatgacatgagcctccttaatggattta

SEQ ID NO: 6928 - DNA, 835 bp, Glycine max
gaggttatttaccatttcttctgccgccctttctctgttccatagtcgttttttcattccctaatgttccaaattctgacatgatatttttttgttttcagatattggatatgaatccagaagatgaagctgaagaagatggggccaacattgatcttgactctcaaaggaaaggaaaatgtgttgtgctaaagacatccactcgacaggtgacaatttcatatcttttggacagaaatttcatgtcctccctatttcgatttccagtgttactgtttcattaagattgtttcttatctttaatagtgtctttgcatttcttttggatcctttgaaaaacataatggatttgttggagttagtaggcaaagaaaagcccttaatataactgactgcaatagtaaattatgctttcgtttgactgcagacaatctttcttcttgttgttgggcttgttgggcttgttgaccctgacaagttaaaacctggttatctggctggtgttaaccaagatagttacttaatcttggatactttgccttctgagtatgattcatgatttaaggccatggaggttgatgaaaagccaacggaggactacaatgacattggtggtttagagaagcaggtactctataattacgggcaatttatcaatgcactctttctttctttttttcttcttatttacaattaggtaacagggtctctgatagtgtgatcaataacttggtctctgccaacagatccaagaatgggttgaaactattgttttgccaattacccacaaggagcggttccagaaatttggagttggtccaccgaagggagtgct

SEQ ID NO: 6929 - DNA, 411 bp, Glycine max
tatctttgacaatccatggatgatagaatgggggtgcagatgcatttttctctttaaaaataattggaatctggttccttcggtctgcatagccttcaagcttgttcttccgatcccctgaaaacaaaaccatgatgagaaggcactcccttgtgactgcatcaccaaaacaagtgtccctcttctttgttggccacaaaagcaacccaacaacaattcatcctcacactcacacccttctgactccatcacccaaacaagacccacaaaaccataatcagtggtggggccaccccaaaaccatcaaacccagtttcaatcacagtaggatcaggttcaacaccttgcacactggttccaccgaagaacaagttgaaacgggtgaggttgaagtcgatgtgtggacgaaga

SEQ ID NO: 6930 - DNA, 366 bp, Glycine max
aaagatctacgcgctggcgtggccttgtcggcgcgtgcatctttactcggccacatcgacgcgcttcgggagttaggccattgccttcaagacggatacggcgtgcggcagaacgtcaccgaggggagaaggctcctcgtgcaggccaacgtgcgcgagctcgcgtatgtcctacgcgccgtggcgcctccttcgcgctgctgcgacgagtcctcctcgctgctgacgtggggcgcgctgagatgtcagagaaaaaacaacaacgcggtgtcatcactggcgtgtccgttgctgagtgattacggttacagcgtggcgccgccggaagtgcaaccggcgaattggtttctgagagagtggtttgag

SEQ ID NO: 6931 - DNA, 343 bp, Glycine max
ttttttctctgtagctatctaacaacttggctttagaataaaatgggcaattgtcttgatctttgtaaacccagttcagggtcttgcatcgcaaaaaaggttaaacttgtgagggtggcaaaacgagatggtaagatcctagagttcagcaccccgatccatgtcaaagatatcttgacaaattatccagcttatggtgttggtgtttcaaagaaagtcagagaacatctctccccagatcaagtattgaaggcaggaagattgtactacttgcttccctctttgcattcccctccaaatcttgcatctttaaggacaggtggagggattaagaggatcaaag

SEQ ID NO: 6932 - DNA, 388 bp, Glycine max
agagcgagcaaagatgtcgggtcgtggaaagggaggcaagggtttgggtaagggaggagccaagaggcacaggaaggtgctccgcgataacatccagggaatcacaaaacccgccattcgccgtttggctcgcagaggcggcgtcaagagaatcagtggcctcatctatgaagaaacccgcggcgtccttaagatcttcctcgagaacgttattcgcgacgctgttacctacaccgagcatgctaggaggaagactgttaccgctatggatgttgtttatgctctcaagaggcagggcaggactctctatggtttcggtggttaaattttagggttttgatgggcttagcagctggttatttttgtaaatggtcgtttgtttgggagt

SEQ ID NO: 6933 - DNA, 505 bp, Glycine max
  misc_feature (488)..(489): n is a, c, g, or t
tcttggttgcctggtccctcagaaaacctagcacatctttctggtcctcctggtcagatgagtgctgctgctaatcagcttcttcggcctcctggggtaattattttgaattatcatctagtttgtataaatagtttggctgtttattgatattcttttcttgcgtacatgcagttgacaccagagatggagaaggcactgcttcagcaggtcatgagcctcacaccggagcagataaatctcctgcctccagaacaaagaaatcaagtgctgcagctacaacagatgttgcgtcaatgatataatacgcatatatactcaccatgaaagttaggcaatctttaaagtttaatcctagtttggaagaggttattatgtcgtatatattcaaaccgattggctgccaagttttatagaaattaatacaaattcatgcaactaattatagaccatattattcgtttcttctgaaatttggcacgacaaannagaaattcaacacgac

SEQ ID NO: 6934 - DNA, 378 bp, Glycine max
aaatagtagaatacaaatccacgtaagacatatacaagatataatttatttaacgtaaaaaaactttcttttctagaataaatactatttaaatgttttcacctagaagtgttcgcatttgtataagcctcacctcttaatacacacttcaagtttcttgtggcagccaggttctctgatttgtcctcaataacagtatttattgttaaacttgccttcaaaagttcgatcctggtaccgctgttcagattgtaaccagaaaaagtctcagcgaaatgaagtacataaccttggtgtctactcatctatagaagcaagtctacataagcatcaagtccttgtttgacaaggcacttcttcagcttgtatagtgctcgg

SEQ ID NO: 6935 - DNA, 390 bp, Glycine max
ttcccattgaggtggtctagcaaaggaactaaatcaagcaataacgtattgagatctcccatcgatggaacagctgatcctagagacctgacacttatgaagtgaatcctggatttgttcattgtctttgaacatttttttacttttcagcattctggtgcacagtattcattcttcggttttcctttttttttcattttagttttcttttttaaaattggattccagctaagctatagttaaaaaagaaaaagaaaaaaaaacgaaaaaaattgcttgttattattcttttattcttacacctatactttgcattcctattttgtgttagttagctgaactaaaattgcaagattaattaataccagtatttctttccatgcttcccag

SEQ ID NO: 6936 - DNA, 702 bp, Glycine max
aagccgaaccggcaaagaaacctcctgctaaagctccagctaagcctctgcctcagatgatggaggaggatgtgatcccttcactgaaatcaatatttgaagcccaagaagatttctcaaatattgagctggtcttcaaggacaataaggttgctcttttttgtaagaataatgtttcatcctttacaagtatctttctgttaatcctcctaatatttgatgaagtactaaattacaaagtaaaaatatttaatgaggattagtaagaattttttttagaaggattagtaagaaagtgttttagaaggatatagagttattcattttataaatctttgcattactagaaattcataacgttttgattgggttatgattggcagttggaaggttcctttttgaagaaaggcaacccctattcattttgggcattttttcccacaggaaaccttattggtatgtatgtacatgtttccttgagaaagtagcaccacactaacattgagttaaatgcacatgtaaagcatcattctgttcttcccttgaacaggtccaaaggggttttctctgtcatcgtataactcgggagcaagcaccgttgagccatttctcattgatgaaaagaagattactgcaagacacattatcttttgggttaaaaaacgtttggcagcacaagggatcattcctgtatgggaagat

SEQ ID NO: 6937 - DNA, 729 bp, Glycine max
  misc_feature (700)..(701): n is a, c, g, or t
  misc_feature (724)..(726): n is a, c, g, or t
ttacattcgcgatggcggcttccactaccagccaggtctacatcgatgtaatcgaggatgtcatggtcaaggtccgtgacgagttcgtgaacaacggtggtcctggagaggaagttctcaaggagcttcaagctgtaatttctcttctctgcctctgctattctcattcgtccatgatttcccttttaattatacgaatgaagaaattaatgagattatttgatgcttttacttctaatttgaaacgcgtattgatttagtttggggaatttgtttccttctcagctgggttgttgatttagggtttggatccgatctattctttggccgtgctatttatttaacttttattgctggtgtttaagatgttcatcgtttctcttttgttggtaatttgattagatgtgggaatcgaagatgatgcaagctggtgctgtgctcggtcccatagaaaggtccactgcagctaagccaactcctggtggtccaattactccggttcatgatctcaacgtaccgtatgaggggaccgatgagtatgagactcctacagcggatatgcttttcccccctgtgagttttgacacaccctagttataagtttgacaagtgatgtctccttttcatgagttaagaatattggattgttgtgttgatgtgggtttttgaatgtgcagacaccattgcaaactccaattcnnaacccctctaccaggaactgggnnnctc

SEQ ID NO: 6938 - DNA, 373 bp, Glycine max
gatttgaaatccaccttccaaatttgcaatcactcttagagagcacagaacaactttggagcatgcggcgaggttgccattactgaaacatgattccggtattgtggtaatgggagcggtgtgtgtggtggggatattggcggtggttctgagcgaggaaaaggccttggctttgggcccagaaggcccacttgtggaagagttttgggacaacgtgaggagatatggactctacgctctcaccgtcagcacaggtgccctttacaccatcttccgccctatagcagaacttctcaagaatcccatttccgcaattttcatccttgctcttttcgggggttcaatcttcattgtttctcaagtcctctctgcc

SEQ ID NO: 6939 - DNA, 351 bp, Glycine max
ttcaattctgaagacccatctgtggaagaagctttcaggtcatatggcgctgaaagatggccccgtgtatttccactaaccattcgtgcaaacctcgtaggttccgttttgcagtgggagaacccattggtgtgttctgttaggaacaatattgtcatacctaagctagtcaggctcgggccattgctggagcatacaaattttacttgtgagggtctataaagaagacaaagcaaggctggcaatggcaagcacaatgaaagatggagttgtcagggaatagagagagtttcatttctgttcaatatggatactgcatttgatgggtgtaaagagagttagttatgttcg

SEQ ID NO: 6940 - DNA, 910 bp, Glycine max
  misc_feature (460)..(462): n is a, c, g, or t
  misc_feature (491)..(491): n is a, c, g, or t
  misc_feature (494)..(494): n is a, c, g, or t
  misc_feature (531)..(532): n is a, c, g, or t
  misc_feature (534)..(534): n is a, c, g, or t
  misc_feature (537)..(537): n is a, c, g, or t
  misc_feature (854)..(859): n is a, c, g, or t
acataaccctatatcacttaatgtagtcagtgtaacacaatattgataattttatctggccttaattaattgctttcaggctgctcgtgctggtgcaatgcaattagaagtaacaattaatgggattggtgaaagggctggtaatgcctcattagaagaggttggtatcaataatttattgtgtaacgaatctaataaatgttaatggatcaattttctattgaatattaatgtaaaagttatctacagtaacttggtgacagaattacaactctcaattagggttcggattcccaattcatattggacctgttaacaaaatgatcatattgctcttctattgttttttattaactatctcagtcacttaatttcatttcccttaatgtattataacttattttatatttttttgttcaaggttgtgatggccctaaaatgcaggggagatcatgtcttnnntggtttgtatactggaattaatacaaggnacntattgaagacaagcaagatggttttatattttcaaannantcnatgaattttgggatacttttccccctttaagttacctttgtttaattcaattttttttttttataaataaaatctttatcaataggttgaagagttctctggtatgtatttacaaccacacaaagctgttgtaggtgataatgcctttctccatgaaagtggcgttcaccaggttagtggaattaaatgcatttgcagttaactaattatataacactaaatatatagacaatgcacttaattaccattatattcttttaatgtaaatcttataaaaatcatttactatgctacatacatttactttgtaggctggnnnnnnaaagcatagaggtacatatgaaatatttctcccgaagatatggccagaaaa

SEQ ID NO: 6941 - DNA, 729 bp, Glycine max
actgcacttctgaagatatctcagaagatgacaaaaaatgtcgccttcgtaaggtcagatattttattttagtttgtgttaattcactagggtgataatcttcttttcagtgagaaaattacttggtgatgtgtcagttgtgccagctatttatgtctctttgagaagtgttgctttgcagaacactagaactataataaatattatatttatcatttgtagaaaaattgggtagagatatttattcttgatgactaatttcaggcattaggtcagacagctgactggtttaggagagcattggctgttgagcctgtcaaggggaacctgcggttgagtggatattctgcgtgtggacaagatggaggtgtgcagcttcctcgtggatatattgagggtacattttatttgttgagttcattgtatttcttgtaaaagctggatgtcaaatttgaatatgaatttaagagatcacctttttgttcaacttccccagagggtgtatctgatgccgacttggttcttttggtgactacaagacctacaactggaaatacacttgcctgggcagtggcatgtgaacgagatcaatggggtcgtgctatagctggtacattatccccgaaacatatgttggtttcagtggtgttttttattatattgcatctggaatgcttcagagctgaaagtattttttgtttttctccaggacatgttaatgttgcgcct

SEQ ID NO: 6942 - DNA, 402 bp, Glycine max
  misc_feature (16)..(16): n is a, c, g, or t
gagcatgctcctgggngttattccctcaagacaacaaagccaagttcaacttcccttctccttctaagtctcttgtctccaaagcacaatccactatctcaatctgcctccttctctttttcacaactctcctcctttttactctctccaccctcccaaacacccctcacacccctcccactcaccctcctaaacccaccccccaccacctggctctccagcgcatgggcactctccaccgcagaggcaccaaatccatgtccgacctcctcatctgccacgtgcctgacgaaacccccctccaagacttccgcatcttcctccgcctcctccaccgttcttccctcacttcctcatccgacgtcgttttcctcttcccttctccttcctcatccatcaaat

SEQ ID NO: 6943 - DNA, 477 bp, Glycine max
gtaaaagatgcttcctttaacggttctgctccaccagtgtttgagttgaatcacaaagaaaggattcacagcagcaaggaagccacaaagaagagtgtaactccatttttcgacttgaaccagatttcggtaatgagagttacacatgcatttgtgtcatgaatccttgtttatgtttttgattcaagtagactcatagtttccttccattttggtcccatgcagagagaagaggaggaattgcaggggaacagtgaggccatgaggattgaagaaccaaagagaagtacacaaagagttgcgactgacgagcagcacagcgacatcaagctctcggctgcctgtagaagtgttggggatggatcaaatagggcagggaagaggaagatttcatggcaagaccaggtggctttgagggtttgatctatatataaagtacagtagactgaatctataccctttcagaacgtgtattct

SEQ ID NO: 6944 - DNA, 978 bp, Glycine max
  misc_feature (693)..(699): n is a, c, g, or t
  misc_feature (701)..(701): n is a, c, g, or t
  misc_feature (703)..(703): n is a, c, g, or t
  misc_feature (707)..(712): n is a, c, g, or t
  misc_feature (714)..(716): n is a, c, g, or t
  misc_feature (739)..(744): n is a, c, g, or t
  misc_feature (746)..(752): n is a, c, g, or t
  misc_feature (754)..(754): n is a, c, g, or t
  misc_feature (757)..(758): n is a, c, g, or t
  misc_feature (762)..(768): n is a, c, g, or t
  misc_feature (774)..(775): n is a, c, g, or t
  misc_feature (782)..(787): n is a, c, g, or t
  misc_feature (789)..(792): n is a, c, g, or t
  misc_feature (794)..(794): n is a, c, g, or t
  misc_feature (811)..(814): n is a, c, g, or t
  misc_feature (831)..(831): n is a, c, g, or t
  misc_feature (834)..(838): n is a, c, g, or t
  misc_feature (841)..(847): n is a, c, g, or t
  misc_feature (851)..(853): n is a, c, g, or t
  misc_feature (859)..(864): n is a, c, g, or t
  misc_feature (867)..(868): n is a, c, g, or t
  misc_feature (873)..(879): n is a, c, g, or t
  misc_feature (881)..(889): n is a, c, g, or t
  misc_feature (892)..(897): n is a, c, g, or t
  misc_feature (899)..(906): n is a, c, g, or t
  misc_feature (911)..(914): n is a, c, g, or t
  misc_feature (922)..(931): n is a, c, g, or t
  misc_feature (934)..(938): n is a, c, g, or t
  misc_feature (941)..(943): n is a, c, g, or t
  misc_feature (947)..(951): n is a, c, g, or t
  misc_feature (956)..(960): n is a, c, g, or t
  misc_feature (962)..(965): n is a, c, g, or t
cgacagcgatactttctctctttctctgagtgaaactgaaaagtggaaacaaaacgtgtgactgttgcatgaattgtccaagttaagaagattgtgaaatcctcagaaatggagaggttacctttggaaatctgtatgaagatattctatctcttggactatcagcatcttgctgttgctcaacaaggtcagccacgcacgctttcttcatttttacgttgttttctgttcgaaaacatataatttttatttcaatgcaattagcgttgcaattgatttctaaatttcgaatcagtagcgcgttttctatcagttgaaatattaatgctagatctgaactgactttcttcgattcaattcagttctctatattgattggcttggataatctattctatttagttttttgatgttttctatctgtctgaattggatctgaaattgaagtgatcacgagatgaatatgaatatgatcctctaaattcggttgatttgcttgttcagattttccgcgaatcgtatcaatcactaactcttcctttcatttaatgtctgaattgaggcgtttttgctatcagaaaaaaattggtggaaggcaatacggtgattactagtctagactctagtcactgttttgccttagtgtagatcatatggaattaaaaacaggaatatgttttggctttgtgtagnnnnnnntngnggannnnnnannngcaaccagtgtcacctgttgctnnnnnngnnnnnnntnatnntatnnnnnnnatctannaaaaaannnnnncnnnntnatcttttatctttttcnnnntaatttgaaacaaaaanatnnnnnatnnnnnnnaccnnnttcctnnnnnnctnnatttnnnnnnnannnnnnnnnaannnnnntnnnnnnnntgggnnnnagggttgnnnnnnnnnnagnnnnntannntttnnnnnaaaannnnnannnnaaaaaaaaaaaaa

SEQ ID NO: 6945 - DNA, 1032 bp, Glycine max
  misc_feature (531)..(534): n is a, c, g, or t
  misc_feature (553)..(554): n is a, c, g, or t
  misc_feature (556)..(562): n is a, c, g, or t
  misc_feature (565)..(569): n is a, c, g, or t
  misc_feature (571)..(581): n is a, c, g, or t
  misc_feature (583)..(586): n is a, c, g, or t
  misc_feature (590)..(592): n is a, c, g, or t
  misc_feature (594)..(594): n is a, c, g, or t
  misc_feature (596)..(601): n is a, c, g, or t
  misc_feature (605)..(618): n is a, c, g, or t
  misc_feature (620)..(620): n is a, c, g, or t
  misc_feature (624)..(650): n is a, c, g, or t
  misc_feature (652)..(656): n is a, c, g, or t
  misc_feature (658)..(658): n is a, c, g, or t
  misc_feature (662)..(673): n is a, c, g, or t
  misc_feature (679)..(680): n is a, c, g, or t
  misc_feature (683)..(698): n is a, c, g, or t
  misc_feature (702)..(707): n is a, c, g, or t
  misc_feature (714)..(721): n is a, c, g, or t
  misc_feature (724)..(726): n is a, c, g, or t
  misc_feature (730)..(735): n is a, c, g, or t
  misc_feature (746)..(748): n is a, c, g, or t
  misc_feature (751)..(760): n is a, c, g, or t
  misc_feature (762)..(765): n is a, c, g, or t
  misc_feature (770)..(770): n is a, c, g, or t
  misc_feature (774)..(777): n is a, c, g, or t
  misc_feature (780)..(780): n is a, c, g, or t
  misc_feature (782)..(794): n is a, c, g, or t
  misc_feature (796)..(801): n is a, c, g, or t
  misc_feature (804)..(807): n is a, c, g, or t
  misc_feature (810)..(812): n is a, c, g, or t
  misc_feature (815)..(825): n is a, c, g, or t
  misc_feature (830)..(837): n is a, c, g, or t
  misc_feature (840)..(843): n is a, c, g, or t
  misc_feature (851)..(857): n is a, c, g, or t
  misc_feature (859)..(860): n is a, c, g, or t
  misc_feature (862)..(865): n is a, c, g, or t
  misc_feature (877)..(882): n is a, c, g, or t
  misc_feature (884)..(888): n is a, c, g, or t
  misc_feature (890)..(909): n is a, c, g, or t
  misc_feature (913)..(915): n is a, c, g, or t
  misc_feature (922)..(924): n is a, c, g, or t
  misc_feature (926)..(927): n is a, c, g, or t
  misc_feature (931)..(931): n is a, c, g, or t
  misc_feature (933)..(933): n is a, c, g, or t
  misc_feature (942)..(954): n is a, c, g, or t
  misc_feature (958)..(958): n is a, c, g, or t
  misc_feature (965)..(968): n is a, c, g, or t
  misc_feature (970)..(982): n is a, c, g, or t
  misc_feature (986)..(988): n is a, c, g, or t
  misc_feature (990)..(995): n is a, c, g, or t
  misc_feature (997)..(998): n is a, c, g, or t
  misc_feature (1001)..(1001): n is a, c, g, or t
  misc_feature (1003)..(1005): n is a, c, g, or t
  misc_feature (1011)..(1011): n is a, c, g, or t
  misc_feature (1014)..(1025): n is a, c, g, or t
agaaagggtcttaaggactggatttctctcaaagaaattagttggcctcaattcaaatcacggtgctcaacaaaggcattattggaaaatcctcctggcatggaacatggtggattcccactacgtaccacaacacaatatccttgttctcaatacccctattcctgcaattttatttttcaatttcaaaacaaatgttaatcatacaatatcaagaaattttttaactcatacccacaaaagttaaggactgaaatcactacttgttgtcttgttacattcgttttcttaattaagttaaaagggttaaattatttatttaattatgcaattgtcttcattttaagttagtctcaatccatataaaaaaaatctataagttttaatccttcaacagtttattctagcagtttattattgccaaaaagtttctgtaatgggtttataccataaaatgttttctctctgttattaacaataaggaatttccacccaaaaaaaaaaaaaaatcggaaaaaaacttaaattttnnnnatgccactgcggccaaatnnannnnnnntcnnnnntnnnnnnnnnnnannnncctnnntntnnnnnncccnnnnnnnnnnnnnntntctnnnnnnnnnnnnnnnnnnnnnnnnnnntnnnnntnaatnnnnnnnnnnnnactttnncannnnnnnnnnnnnnnnaatnnnnnnccccacnnnnnnnnccnnntccnnnnnncctccctctcnnnacnnnnnnnnnntnnnnacctncttnnnnatntnnnnnnnnnnnnncnnnnnncannnnttnnntcnnnnnnnnnnntcccnnnnnnnncannnnacaccctnnnnnnntnncnnnntaaccatctctnnnnnntnnnnncnnnnnnnnnnnnnnnnnnnntctnnntttcccnnntnnctcncnatttcaatnnnnnnnnnnnnncacntctcctnnnnannnnnnnnnnnnntccnnncnnnnnnannctncnnntcactntcnnnnnnnnnnnnctctccc

SEQ ID NO: 6946 - DNA, 405 bp, Glycine max
aaacaacatccaaatttagatcatggtgcttgggtcaattcggattcatggggaacccaaacctacaaacacccctacacgtgatgcattcctttaataattaattgaaaaattaacaagggttgttttgtttcacacactttacagaccttaagaattgagatacaactctttaaatattagagacaaagaggttgtttcacacacatgatgcaaagttgcaaaccttgagagtgtcaatttgcattttctcctatattttatgagcatgagtaccaatcatggcaattcttagagtccctatccatatttatttaatatatattatggtgggacatcgatggaaccttgccaaatggtcaccaaactcatcaataaaaaacaaagttgattatccctgcagac

SEQ ID NO: 6947 - DNA, 877 bp, Glycine max
  misc_feature (871)..(873): n is a, c, g, or t
cattgatgaaattctgaccgaacctcttttgggtatctctcagatggtctcttagctcgagcccaagagaggaagaaaggtatctttgttgtttcaatctatcccaatatatatgtgtcagtacaaaatatgcagtttctatagctcttttttccccattatttttagatactatatgaatttgttgatatattatttgaaattattgttagtaaagaaattatatatgcactagctagtgtcttttttcctgactttttggaaaatcttttgattattattgttgtagtacttttccttcatccctatctagtatatctaccatttcattttttatacatatacctataaataatctaacattgttgttatgcattttttttaatgcatatatacttaacaggagtgccatggacagaagaggaacacagaatattccttgttggacttgagaagctgggaaagggtgactggaggggaatctctagaaactttgtgactacaagaaccccaacacaagtggcaagccatgctcaaaagtactttcttcgattggcaactatagacaagaaaaagcgacgttcaagtctctttgacttggtatgcatacataacaatgaattaatttactatatattgcttttattaattagctacctgataatttcacactgaatgaatgataaatgtttctctttaaactgaaaagtaattcacttttcttttttacttttcctttgtcgttgaattattgtggcaggttggtagcaacaaagcaggttctaattcagtttcggctcatcaaaaggatgagtctaaatgtgaagttaagaataatgatgctgccactttgtcgttgctagggcgaaannnccta

SEQ ID NO: 6948 - DNA, 338 bp, Glycine max
ctggggaattatgcactcctggtccgaatggtttttacttcttagtatattggtttccttttttcttcccactttttttttcatggtgttttgaagaatgtgcaaccatgcatacaactatatgcagctagtgcgctatagcttggtgacatgcatgttgtgaagttcattcagattttttgtgtacctttactgttaggctatagcttaacttgcagatgagtgaatagctagattactagttctgaataatggtttgtgttgagttgaagtgttaccataccttgattaaggttaaggtatgagaatagtgtaaaagcgtcgcttgctactgattt

SEQ ID NO: 6949 - DNA, 274 bp, Glycine max
atcaaagaacaaccacaaatgacagagccattgtactaagctcaaattcggtgcaaaatatcctcagctcaacatcaacataacacttagcaggaactttgaaatagtatcacacagatgtcactcctccaactccaactcagctctcatgcattgcgctctatcacttcctcttcccataacttcagacccacctattcctctaagcgtgtcagctatgtaagaaccagaattagagctgttggcacagtccccgagaaggactctgactcag

SEQ ID NO: 6950 - DNA, 359 bp, Glycine max
tttgacccccaagagtgacgtctacagctttggggtggttttgcttgagttgctctccggctacaaggccatccataaaaacgagaatggggtgccacgaaatgttgttgattttgtggtgccattcattttccaagatgagattcacagagtgttggacagaagagtggccccacccacgccctttgagatagaggcagtggcctacgtcggttatttggctgctgattgtgttaggcttgaaggtcgagatagaccaactatgtctcaagttgtaaataacttggaaagagcattggctgcatgtttagccaagccaatactctctaggtccaccaccgattctatttcttcacaat

SEQ ID NO: 6951 - DNA, 401 bp, Glycine max
  misc_feature (390)..(390): n is a, c, g, or t
cttcacccaagctagcttttcccttttctccaacttccaagttgcatcacaacccttgtcacaagttttctccgattccattccaacctcaacaacaacagacacaccccatccacttcgatcatcatcatctcccattaatctcttcataatcccatatgttccacttcctaatcccacaattgcacacaacctcgttctaatctcaaacttttcaaccctgggtactctctctccttccaatattccttagcaacacatttataaaaaccatccaattatgtaactctaccctttctagtagcatataaactccccccaaaaaaaaaccaaaaaaaagactttttttttaatcttcttctttcaaacctcaaagttttcaaaccgggntccccaatccc

SEQ ID NO: 6952 - DNA, 1033 bp, Glycine max
ccgcctgcaaatccatccaatgcaatgaattcattcaaacaattttcatgcaaagaatggtactttcatttaaaacaagcaacatcctgagtaggctgcatctagctgctcttgatcatcttatattgccatgagataagagaagcataataaatgaaaagcaaggaagaagtattgcttactcgcacagaaatgcatcagcttcgtcaatgaaaagcaataaacccttatttgatttcttagcccaatcgaacaactggtgtatctttgttacagcctgcggtcccagtggagcaacgtcacctccagtcattaatgcgtaatctaatccctgcattaaattaaaaaaacacaaattaagtaaaataacaacttatctggaaggaatggatcccggttaaaaacataaaataaaatagaagccgataatgagtcaactcatgatgatgatgaaatttagtgtttcataaaacatgcaataaccagaaacatgatactgactaactgtttcaagtactgaattccacacaaatgtgaaaattttgtatttagaaaagtatggggaacataaatttatagagaagttaaaaaatacttttggatttattaattatatgtcctaaattgccagcaaaagttatgaaacaatacaaaataataaaaatatgaagatagttttattgatataatgtattcacaccaattaatacaaaaggataacataaattcaaaatttcttcattaaataggaaaaaaaacccaagtttgaacaacgcacctagttatttgacccaagaacaagaaaggtagatgatatgaaatacttgaaatttggaataagtagatcaatagataagtaaaaaatcatacagatttacgagctaactccctagcagccattgtctttcctgttccaggagggccataaaaaagcatgtttctgaatggcgcttgatgtgcttttgtatttgccgtagcagaagacaactgctgaattcttttttgaagagaaggatgcaaaatcacatcacca

SEQ ID NO: 6953 - DNA, 690 bp, Glycine max
tctcagtgcggtgctgattctttatctggagaccgattgggatgtttcaatctttcaattaggggtcatgctgagtgtgtcaaatacatgagatcattcaatgtgcccctcttgctactaggtggtggtggctacaccattcggaatgttgctcgttgttggtgctatgaggtagaatgttgtttcaattgataaaatttctgccatttatttattgtaatttcattaaatataaggtagcatggttcataggagtaccatattttagtcagggtgctgcaatccacaagtggggttattgtcttgaaatttcaatattttctcctttcatacgttgattataaaaaatgtagaattctaaacatgaagtaacttgttcagtggaagtagtgatgttggaggggtcaaagcagttgagttattgtttcattttgcttgtcttgaactataaagtataaattagatatcctaaagcttcttagtattcaatggggcttaccatgtagttgttgtttctcacttctcagattgttcatgttttaatagttatgtattacttgagtaattgttttgtaaaaacaataatccaaatacagaaaattatacatgttatatgttaaggcagacaggagttgctcttggaatagaagttgatgacaaaatgccacaacacgagtattatgaatattt

SEQ ID NO: 6954 - DNA, 562 bp, Glycine max
cctggtgctccccaggcaccaggtcaactaaataccataccaaggcccccttcattagctccccctccagcagttcctggaagcactgctgctccagcttccaatggtgctccctctatggtatcatcagcaatgtatcaagccaatcctccggcaccatcatctggaagttatgataattacaatgccagtgctcaagcacctgagggtaatcactgacctggttgaactggtatgttattttatattgattattggattttacactaatacaatacttgttcaataaagtttttctgccttttctttgctatttccaaccgtaactcagggagaaagcatagtatttgctgggatcaagtattcattgaatttctactaatcaacattctttactattttatttgtgttatgcaggtcactctgcataatcttatctccattagagtcttatggctagagctatttgtgctctccctaccagctgttcatcaaattaggactctccatttgtgatcatatatagagtaatcattggtatgtagcatgtccagcacttgaa

SEQ ID NO: 6955 - DNA, 408 bp, Glycine max
tccaccagctaaagttagtcaagtgcaaagtctcatgcgctacctggcacacaatggattctttgaaagagtaagaatccatgaaaaagaagcatatgctctcactgctgcttcagagctacttgtcaaaagctgtgagcttagtttagctccaatgattgagtttgttcttgacccaactttgtcaaattcattccatcaattgaaaaagtgggtttatgagaaagatctcacattatttgacatctccttaggatcacatttgtgggactttcttaataaaaaccctgcacataacaagtcattcaatgaggcaatggctagtgattctcagatgatgaacttggcgttgagagattgcaattgggtctttcaaggactggaattcattgtggatgttgatttttt

SEQ ID NO: 6956 - DNA, 640 bp, Glycine max
ttaggacaaaaaattcaagaaatcaaaagcaataataaatatcaattttgtaacaatctaaacatacataggtcttcaaaaaccagacctcagtttcctttcactaaatttattaggaatcaactcctattgaagatgagatgggagacacgcaaggaaaccagtaccgccgtctaccatctctatggccatcatcaatcattgcaagtccttcctgcacaagccaacagtgtttcattgttacatatgtgatttgagattgaaatgtgttaatcagataaagagaaagaaacagattttctcataaaaaatttagttatcttacatcgagtaatgtatcaagggcatcgatggcacggccagaactccatgacaaccgcctctctacttcatctacagtcacaaatccttgagcctgcagtaaataaaatgttacacgcaaatgtgaaaagactaatgcttctcaaacagcaaactgattgcatagctatttttgctacactggataagttggacacaggcaatcttttcttcacaacaaggaatccaatttctaactaatgtcaatcaaattaaatcacaccatggatgaagcttcttgtacacattgttaacaatcaaacaagatccaaagcaagat

SEQ ID NO: 6957 - DNA, 607 bp, Glycine max
ccttttcgtgacccttgcatgtgttgcgatgctcatcccagaaataaataatcatgaaagcaagactcaataaagttaacgcctttccctctgtcacgaaccaaattttttttcctaaccgttgcatgtgttgcgatgttcaacagttaaaagtgttgatttgttttttaggttgattgttggtttatttatgtgattggggttatacgcctggctaagaagagatgcgctcctctaatgctccgtttggcgtacgttcttttttattctttctatttaacattagatctctgttatttacgattgagtttatggattgtcattttgacgcgttttggtgcgtttcgtgtgcagatggcactctgctggaacctttgtgacatgggtcagatatatctatactatttaccttatttctgcttaatcagtattattgttgttgcaattgttgttcctgctcaatgttatcgtgttctaatttatgttataaacttataatactcttctatgtgtgtgttttggtcataatgtttgtgtgcaatgaatgagttattattgacaaaataaaaatgacatccatgttcgtctgaggctcaaatttcctatt

SEQ ID NO: 6958 - DNA, 293 bp, Glycine max
agcagtttctttcatctgattttcaagtgctgcctcagctctttccctggcctgctcacatgtctccatccctgaattgcacttgtcagcctccttttgatactgtgatgctaatttcttagcctccaaaagtttcgtgtctacacttctttgtttttcctcagcttcagcttccttttgctttacttcttcggctaaaagatctgtaaaactcttcccaacctcttcactctcctctgggtcttgcctcatgcaatctacaacatacatatgctgtattaaatctcaaattg

SEQ ID NO: 6959 - DNA, 657 bp, Glycine max
ctcttatcttcttttgggcagagaggcttcacgcttgagtagccatggcctccttaagctgccaggttcattccaccaacttgttgaattctaagaatgtcaatagcaggaggaaacgtttaatttcttgctcagcacagcctacacaaaacaatattaaggtataagctgaaatgaaatgcaatactctttaattcaatgcacaaaatcaaagtacaaagtgcttgcattgcaacgtaccctttgtggaacaggtagtgattaatggagcaaccaaggaaataggaaaggcagcagtagtggcagtgactaaggccagaggaatggaggtagcaggagcggtggatacttgtcatatcggggaagacattggaaaggtttttttttgcctttggtgtcattatccaaaccaacttaattcttatgttgtccttaatctatttttagattgtttttaattctttcagatatgtggcatggaagagctccttgaaatacccatcataaatgaccttactatgattttgggctccatatctcaggtaacaaacttggtatttttttctcttcttaatctgttttcttgaataacgttttgaatgacaatttgcagtccaaggcagcaggagttgtagtcgatttcactgacccttccta

SEQ ID NO: 6960 - DNA, 404 bp, Glycine max
gctcttcatcgagcgagctacacccaacttccattacaaaaccaaaacactcaagttaacttcaacacctttaattttctgaacgaaattcagccacagaatatcaaagggagcgaagatgagtcaggagcagccaaggcgcccccaaggccaagaccccatcaaatacggcgacgtttttgacgtctacggtgaccttgcacagatgcccattgcaccggaagatgctgccatgatgcaaagcgcggaagctcgagtactcggaaaaacccaacccggcggagcttcttccgtcatgcaatccgccgccacaaggaatgaacaggctggtcttgtcggtcaccaggacgtcaccgacatcaccggcgaccatggcgtcacagtcacagaaactacattccatg

SEQ ID NO: 6961 - DNA, 510 bp, Glycine max
tttcacttgtatattcatcacaattacaggcattagcagccttgtggcggcttttcaggtattgaattctggttcagttttagatgattgccacgagtaaggaagtgcacacattttcttctttctcgcatattttcatgaagttgctggctattttggcaggggtcggaaatggaatcctctgaggcagcggttggatagctttgactatactgtgaagcaacacattgttggatctcttttatttacaccacttctacttcttttaccaactacttccgttttctatatattctttagtatcatggacacaaccattaaccttgtctgtctactgattgaagtcactatttcagtaattcatgttaccccttataccaagatatttctttggttggtaagacaaggaagattcccttctggaatatggcttgaaattattggttgtcagagtaatagtactgcctctccaagtgctgatattactgatgaaatgacctcatacaagga

SEQ ID NO: 6962 - DNA, 727 bp, Glycine max
ctgcagctgattacgacactgtgtgggatcgttttataccctctgatttctcctctaccatttctccactttcttcctctaactctaagaaggatctctatttcactctctccgaccgtcccaccatcatcgaccagggtagaaaggtacgtacattatttctccttgcatgtagtgatgttttttatggaatacctgaaatgaaatgtgttgtgtacgttgcgtcactcaaattcctgcagagctttcaattggaaaagcgaactgcgaagaagtgctacatgctttccgctagggatatttctattacatggggtgagaattttatccaaagtttaaatactttttacatattctcatacaatttttattttgtataaaaagtttaatgttgtattgtagatcttttcacacagattttgcagatagttttgtaaccattgacaaaagagtaaaagccgtaaaaaaaacttgaggataattaataaagaaagattaatatttaaataataacattcaatacttaaaattactcataaaaaataatcttaaaattattatatttaattctaatttattttgattcttcctatttttgttcttcaagctccaacgcagggagaggcttctcaatattgggagtggaaaagcctgccagagtcaaggtaaacttttatttcactctcccttttttttttatcgatgaattgattttttcaaaaggttt

SEQ ID NO: 6963 - DNA, 397 bp, Glycine max
ccactaggttcaaacgtgactcaggtgtttgttgatcaactaccgggactaaacacgctcggcataggtttggctcgcatagattttgctccaaagggtttgaacgctccccacactcaccctcgcggcactgagatccttatagtccttgagggtactctttatgttggatttgtgacttccaatcaagatggaaatcgcctcttcaccaaagtgctgaacaagggtgatgtgtttgtgttcccaattggtctcattcatttccaattgaatgtgggatatggcaatgctgttgccattgctggtcttagcagtcaaaatccaggagctatcactattgcaaatgctttgtttaaagctaatccacctatttcttctgaggttctcaccaaagctt

SEQ ID NO: 6964 - DNA, 1343 bp, Glycine max
  misc_feature (294)..(294): n is a, c, g, or t
  misc_feature (333)..(333): n is a, c, g, or t
  misc_feature (529)..(529): n is a, c, g, or t
  misc_feature (532)..(533): n is a, c, g, or t
  misc_feature (568)..(568): n is a, c, g, or t
  misc_feature (653)..(653): n is a, c, g, or t
  misc_feature (663)..(663): n is a, c, g, or t
  misc_feature (666)..(666): n is a, c, g, or t
  misc_feature (669)..(669): n is a, c, g, or t
  misc_feature (671)..(671): n is a, c, g, or t
  misc_feature (679)..(680): n is a, c, g, or t
  misc_feature (699)..(699): n is a, c, g, or t
  misc_feature (701)..(701): n is a, c, g, or t
  misc_feature (703)..(704): n is a, c, g, or t
  misc_feature (707)..(708): n is a, c, g, or t
  misc_feature (711)..(711): n is a, c, g, or t
  misc_feature (717)..(717): n is a, c, g, or t
  misc_feature (728)..(730): n is a, c, g, or t
  misc_feature (738)..(739): n is a, c, g, or t
  misc_feature (742)..(743): n is a, c, g, or t
  misc_feature (749)..(758): n is a, c, g, or t
  misc_feature (762)..(762): n is a, c, g, or t
  misc_feature (773)..(774): n is a, c, g, or t
  misc_feature (780)..(784): n is a, c, g, or t
  misc_feature (790)..(790): n is a, c, g, or t
  misc_feature (812)..(818): n is a, c, g, or t
  misc_feature (824)..(825): n is a, c, g, or t
  misc_feature (832)..(838): n is a, c, g, or t
  misc_feature (840)..(865): n is a, c, g, or t
  misc_feature (870)..(875): n is a, c, g, or t
  misc_feature (878)..(879): n is a, c, g, or t
  misc_feature (881)..(881): n is a, c, g, or t
  misc_feature (883)..(883): n is a, c, g, or t
  misc_feature (885)..(892): n is a, c, g, or t
  misc_feature (894)..(901): n is a, c, g, or t
  misc_feature (903)..(909): n is a, c, g, or t
  misc_feature (911)..(922): n is a, c, g, or t
  misc_feature (924)..(924): n is a, c, g, or t
  misc_feature (926)..(931): n is a, c, g, or t
  misc_feature (933)..(935): n is a, c, g, or t
  misc_feature (938)..(938): n is a, c, g, or t
  misc_feature (942)..(942): n is a, c, g, or t
  misc_feature (949)..(954): n is a, c, g, or t
  misc_feature (957)..(957): n is a, c, g, or t
  misc_feature (963)..(963): n is a, c, g, or t
  misc_feature (966)..(970): n is a, c, g, or t
  misc_feature (972)..(976): n is a, c, g, or t
  misc_feature (978)..(984): n is a, c, g, or t
  misc_feature (986)..(994): n is a, c, g, or t
  misc_feature (996)..(1003): n is a, c, g, or t
  misc_feature (1011)..(1017): n is a, c, g, or t
  misc_feature (1025)..(1027): n is a, c, g, or t
  misc_feature (1031)..(1048): n is a, c, g, or t
  misc_feature (1051)..(1054): n is a, c, g, or t
  misc_feature (1056)..(1058): n is a, c, g, or t
  misc_feature (1063)..(1065): n is a, c, g, or t
  misc_feature (1068)..(1074): n is a, c, g, or t
  misc_feature (1084)..(1086): n is a, c, g, or t
  misc_feature (1088)..(1088): n is a, c, g, or t
  misc_feature (1090)..(1097): n is a, c, g, or t
  misc_feature (1103)..(1105): n is a, c, g, or t
  misc_feature (1107)..(1107): n is a, c, g, or t
  misc_feature (1112)..(1113): n is a, c, g, or t
  misc_feature (1117)..(1120): n is a, c, g, or t
  misc_feature (1122)..(1125): n is a, c, g, or t
  misc_feature (1129)..(1131): n is a, c, g, or t
  misc_feature (1137)..(1144): n is a, c, g, or t
  misc_feature (1146)..(1146): n is a, c, g, or t
  misc_feature (1148)..(1150): n is a, c, g, or t
  misc_feature (1152)..(1156): n is a, c, g, or t
  misc_feature (1160)..(1163): n is a, c, g, or t
  misc_feature (1166)..(1168): n is a, c, g, or t
  misc_feature (1174)..(1179): n is a, c, g, or t
  misc_feature (1183)..(1189): n is a, c, g, or t
  misc_feature (1191)..(1198): n is a, c, g, or t
  misc_feature (1203)..(1210): n is a, c, g, or t
  misc_feature (1212)..(1232): n is a, c, g, or t
  misc_feature (1235)..(1238): n is a, c, g, or t
  misc_feature (1242)..(1244): n is a, c, g, or t
  misc_feature (1246)..(1260): n is a, c, g, or t
  misc_feature (1264)..(1264): n is a, c, g, or t
  misc_feature (1266)..(1284): n is a, c, g, or t
  misc_feature (1286)..(1302): n is a, c, g, or t
  misc_feature (1306)..(1320): n is a, c, g, or t
  misc_feature (1323)..(1323): n is a, c, g, or t
  misc_feature (1325)..(1325): n is a, c, g, or t
  misc_feature (1327)..(1329): n is a, c, g, or t
  misc_feature (1331)..(1331): n is a, c, g, or t
  misc_feature (1335)..(1337): n is a, c, g, or t
aggtgtcttgcgtcacactgaggtggctataaaaatgttgaactctgacagcatgcaaggacccttggagtttcaacaggaggtgagatggtttgacttttatgtgatagtttaagcatcatcttattttgatcaaaaataatttttgggcatgtaggatgtagcacttatcatttgataaatcttatgtgaaagttgttagatgtccaagaataaaataaatttggccttaactgatctttcttgtaacttgcagattgtgttataaataatcaatatgagaaaaaaagaaanaaaactgggacaagagttagcaccaacaattttaaaagngtctcgaatttctcctaaaatccaaactcccatgttttaacattttttttaaaaaacttgggtttgttggtccttggtataatatattatcaaccttgtctctaaaggtatgaatgaaggggaagaggatccgtccataattgatgtaaaaaggatatttattttgaccccacttttggttttgtatcaggttgangtnntgagcaagctaaggcatcccaatcttatcacactnataggagcctgcccagattcatgggctcttgtctatgagtatttacctaatggaagccttgaagatcgtcttgcctgcaaggatnaacacccctnccnttntncatggcannctcgaattcgcatttgctncngnnctnntgntcggcncttatctttcnnnattccagnnaanntcacannnnnnnnnntggnggacttaaaannctcccnnnnntctccnttgatgcaacccttattaacannnnnnngacttnnaaaatcnnnnnnngnnnnnnnnnnnnnnnnnnnnnnnnnnccctnnnnnnccnncncncnnnnnnnncnnnnnnnncnnnnnnnannnnnnnnnnnncncnnnnnntnnncanctcncctactnnnnnnacnttttcnctnnnnncnnnnntnnnnnnntnnnnnnnnncnnnnnnnntcctcccnnnnnnncccctccnnncccnnnnnnnnnnnnnnnnnnctnnnntnnntcccnnncannnnnnncccctcctcnnntngnnnnnnnntctccnnncnccccnncctnnnntnnnntccnnnccctcnnnnnnnncncnnncnnnnnttannnnttnnnataccnnnnnncccnnnnnnnannnnnnnnacctnnnnnnnntnnnnnnnnnnnnnnnnnnnnnctnnnngacnnncnnnnnnnnnnnnnnnatcntnnnnnnnnnnnnnnnnnnncnnnnnnnnnnnnnnnnntcannnnnnnnnnnnnnnccntncnnncnttcnnntcccac

SEQ ID NO: 6965 - DNA, 389 bp, Glycine max
atgagtgatgtggttaaagaaattgaagacatgttgcagtctgttggtatgcacctaacatctgaatcagtaacatccacaacatctagtcatagatatcaggaggtaagtatagtgagtttccatctggaccaaccttacagcaatgagtcctttggttcaagtgcagaacatattcaaaaattgaacctagttagttaagttagtcttttttctcaagattgaagtcaagagagacttgtttattagtatttcttggccaaaacacagaaaagtagaaattgtggaatttagagtttgtggctgtgagcttcagagtataagtgtggtagcaaggttaacatttccttgactatcatttcttttccttctttctctcccactaaaga

SEQ ID NO: 6966 - DNA, 254 bp, Glycine max
ttctctttatttctattcacggatcggaacggtgcactgtgaaagggtttttgttttgtgagtgtattaaaaaatgctgcgtagaaacatccgtttgaggagagagtatttgtaccgaaagagcttagaaggcaaagaacgcttgctctacgaaaagaagcgcaaaatcagagaagctcttcaaggtcttccctaactctaatccctcttcattcattttattatttctcataaattatacttttttttttttt

SEQ ID NO: 6967 - DNA, 155 bp, Glycine max
  misc_feature (93)..(93): n is a, c, g, or t
ctcagttagattttcatgaaacaaatcgattgtacacattccaaaggtgggctttgtgtagattctgtatttattgtacctaatgatttgagngagcgcaagagaagaggcattttgaaatagccatgtgcagaataggaagcttttttttttag

SEQ ID NO: 6968 - DNA, 390 bp, Glycine max
gcgactccagagcgcgtgggagaggctgcgcgtggccgaggaggctgaggagaggctctgctcccagctcggagagctagaagcagaggccgtttaccacgcgcgtgactaccacgcgcgcatcgtctccctcatggaccagctctcacgcgcccagagcctcctcctcaagaccggtgcctcctccatttcgcttccttcctcctcctaaatcataatcacacacacacacatatatatatacaaagattgtaataaatttttttcattttctggtcagagtcattgtgattattagatgtatatgatgatgatcatgatcaagatgatccatatcgccgtggatcgaatgtgttgtaaaattttggtggatgattgagaatagtttga

SEQ ID NO: 6969 - DNA, 613 bp, Glycine max
  misc_feature (601)..(609): n is a, c, g, or t
tgggacagcatcccgatcagtcaattcagtacccatcaacaatgctattgactgctgatcatgatgatcgtgttgtgccattgcattcgttaaagctgttggcggttagtctgtttctcttaactcaaaagtattggttggataaactttccaactttgatttattgaattattttgcaaactacaaaataagttgttacaactcacaagctaccttcgttatcaaatcactatttgcataatgaagattttggtttctgctgcagcactctttaacatgtaattcaattttactttttatttccagaccctgcagtatgtcctcgttaccagccttgataaaagtccccaaacaaacccaataattggtcgcattgaatgcaaggctgggcatggagctgggcgtccaacacagaaaatggtaatcgattagcttcccttctccattgttgattgttgtagtgtcgtttttaagttaaataagttgttaaccgcagatagatgaagctgccgaccggtacagtttcatggccaaaatgttagacgcacattggattgaatagaggagcatatcaaacatagggggaggaaggaaaaacannnnnnnnnttcc

SEQ ID NO: 6970 - DNA, 326 bp, Glycine max
ggagctacttgtttgactgaaattgacccgtctgttacacacgtagttgctactgatgctggaactgagaagtgccggtgggcagtgaaagaaaagaagttcgtggttcatcccctatggatagaggctgcaaattatttttggcaaaagcagcctgaggagaacttcattctcaaaaaaaagcaatagtcacttttcttatggtatcaaacagtgctgtgttcataatagcttgcttacttagtggcccaagtatatgaaaggatatctaatacctaaccaacaaccttctgattgggaaacgtgaacagtcaacttaccatttg

SEQ ID NO: 6971 - DNA, 590 bp, Glycine max
  misc_feature (144)..(144): n is a, c, g, or t
  misc_feature (231)..(231): n is a, c, g, or t
  misc_feature (282)..(282): n is a, c, g, or t
cagatggatacatatgaaggaaatgttttcaggttcccaggtggtggaacgcagtttcccaagggagctgatgcttatattgatgaacttgcatctgttattccattggacaatgggatggttagaactgcattggatactggntgtggggtacgtcaaattataagtaatcatccttgttttgattgcatttattttgttggcctctacataatgtttgcatgaagaaantattgtccataatgagccattcctggctaattgtaagttttcctaggggancctcccacttttgaatgcttcaccatgcaacattttcttattcattgaaatacaatttgtttctttttcaaaagttgagtttgagcccatatttgtgcccatttgttgtatattatagcttatttgctgattattgatggtgctaggttgctagttttggtgcatacctgtttaagaaaaatgttgttgcaatgtcaattgccccaagggactctcatgaagctcaagttcaatttgctttggaaagaggtgttccagcaatcattggtgttcttggaacaataatgctgcccttcccttctggagct

SEQ ID NO: 6972 - DNA, 372 bp, Glycine max
acagactcctttgattcaatggattgccgctgacaaaaaatgataaacaggacaacatcctatttcttctcagttggaaggacccagatgagaacgttgttaagtaaagctgttctgatctggcaacatcacctaattgtgtcacaatttatttatttttttaaatgatgatttttttatgttcttgcaatctctatttgtacaagtctgatgtcctttattgaggttttccaaagctaacggattggtgagaaagcacatgcggtgggctccatcgttacacatgccatgatttgacacaatctagattctactcacatgccatgccagccaaccccaagctttcggtggtggaagctccataagttataa

SEQ ID NO: 6973 - DNA, 362 bp, Glycine max
tcactccagaggagagcagctctggtggaagtgattatgaagattataataaaactgcagagagaggttttgatatggatgcattgcctgttataggaatgggcgcagaaacaagttatttgggttcagaagagaagttatctaagggggggttatgagcttctccaggagagagagagagagagagagagaggttagctggcactgatttttagcagagattttcttatggtaattttagatgcagtggagatttgaggtaggattcaggttgcagtgcttacaacacagtgcttaactgtgagttttgtcatttttaatgtttttattaaggtgttcgtgttggcttcgtgccatattgc

SEQ ID NO: 6974 - DNA, 334 bp, Glycine max
tcggcgacctcttcttctccatcaacggtatcgccgctcccgatttaactctcgtctatgtccccgagggctgccacgtcgacatccccatccacttggactacatgctccctcccactccctccaccgatgattccgacgccgccatgcatctctccaatcctagggttctggtcgtcgtcgagaaaggagcacacgtcaatataatcgaggactttcccgcttctccagagaatcagaatgactcttactggagtaatgccgcatttgaggcagtgattggtcaaggtgcaaagcttacgcattcttatattcaaactcagtctttccgtgc

SEQ ID NO: 6975 - DNA, 979 bp, Glycine max
  misc_feature (710)..(712): n is a, c, g, or t
  misc_feature (755)..(756): n is a, c, g, or t
  misc_feature (790)..(790): n is a, c, g, or t
  misc_feature (792)..(799): n is a, c, g, or t
  misc_feature (808)..(809): n is a, c, g, or t
  misc_feature (811)..(813): n is a, c, g, or t
  misc_feature (822)..(822): n is a, c, g, or t
  misc_feature (825)..(826): n is a, c, g, or t
  misc_feature (829)..(831): n is a, c, g, or t
  misc_feature (840)..(843): n is a, c, g, or t
  misc_feature (874)..(879): n is a, c, g, or t
  misc_feature (892)..(895): n is a, c, g, or t
  misc_feature (903)..(905): n is a, c, g, or t
  misc_feature (909)..(912): n is a, c, g, or t
  misc_feature (914)..(927): n is a, c, g, or t
  misc_feature (931)..(931): n is a, c, g, or t
  misc_feature (933)..(937): n is a, c, g, or t
  misc_feature (950)..(951): n is a, c, g, or t
  misc_feature (957)..(960): n is a, c, g, or t
cgttgaaactcgctgctctcgattcctatctctctggttcccctaattccattgccattcttctcgtctccgacgtttttggtacgctatcatcacaatccctgcttttctttctccatgctcttattcttgtcgtttttctaattaaggtcctgtttgatttatagaagaaataaataaacctggttaaagttcttatattatatgtaaactctgctttatctattgagtttattatattgacggtatgtatttgcgtcattttttatttttttttacttttatagtctttaacattagtattgtttttttaacttagcatgctcaatgtgttttgcaggatatgaagcaccaaatttaaggtacgggctgattctcaaatcttgtgtctatttttttgtttatattttactagtcttctaagttagtacaaatagtagtttgcctctcatcatatttgattctaactcctctttattttgggatgatgccttttaatgataagatcaatgattcattgtgtatttcttgggagcaaatacgtgtttccttggatgcaattactcatatagattaattaaaatttacagagattttgaaaaatatattctacattttgttctaaataaacccacttgtcctttttaaaccactagctcacaacctttgggttgtattgaatattgatagattttttttattttggtagnnnaataatcaaagaacatctatttcaacatgtaactataaattanngagttatgattgattcatgaaaacaatgctatcntnnnnnnnnatgtgcctnntnnnttgttttantgnnctnnntaccttttnnnntttttttttttttttttttaatttttaaaannnnnncccccaaaaaaannnngggggttnnntttnnnntnnnnnnnnnnnnnncttntnnnnncctttttggggannaaaaannnnaaaaaccccccggaaaaaa

SEQ ID NO: 6976 - DNA, 417 bp, Glycine max
tgctctgccagcttcgccaccctaattgtgtctctcttataggattttgcaaccacaaaaaagagaagattcttgtgtacgagtacatgtctaatggatctctacatcaacacctacgaggtggcctattgtcatggaagaaaaggctagagatttgtatagaagcagcgcatggactacactaccttcacactggagctaaacgcaccatcattcaccgtaacatcaaccctagcaacattcttttggataacaacatgaagtcaaaacttactgatttccgccttagcatacagggaccacgttatgggtcaaagccaaaaccaattaaagtatatgttattgagggtaagattttattttatgaggctttgatttttaacatgctgaatgatgttgtgtgattcatgtgaccta

SEQ ID NO: 6977 - DNA, 183 bp, Glycine max
catgaggatccattgaaggaggaagaacaggagatttatgtcgtcttggttttatttggaagtagtgattggagctttgttgaagctcgggttcggttacgcttgtgtttgctgcatgctactctggttggtgttgaattctgctgtttcgatgagtttgaggtcaaaaaggtaatgttggat

SEQ ID NO: 6978 - DNA, 410 bp, Glycine max
agataggatccaaatcaagttattgtcaagatccatttttgtctgaggttaagttattcttatgtgctgtcacaagagaagcaaaggaggaatattattccacctagtgttttctcggcttagagcatttgaaatgtaatcattgggcaaatttcaatccctccagataaacctatgggaagcttcatgggctttcacgaggtggtgattgatgggaggatccatactcttagattacaagaacctatttcagatgtggcgtggatcaaaagaaggatctaatattgtcaacctgactcaagaaaacttctagtactcatacttgatagttgaattttgtttgccctccacatccttttccggtcatgattttgcttacattcttcatatctgtaacttgccagtgtctg

SEQ ID NO: 6979 - DNA, 476 bp, Glycine max
  misc_feature (364)..(366): n is a, c, g, or t
  misc_feature (368)..(370): n is a, c, g, or t
  misc_feature (396)..(398): n is a, c, g, or t
  misc_feature (412)..(413): n is a, c, g, or t
tctttgcatcaatgcattttgggtcgttgattgtcgtcagtgctatattggccactacttttctagcacaaatatgaatcttttaggattcttaatgagtgaacagtaacctcgcttatatcaaggtgttatgggccattaattgtcatcggtgttattccagccactacttttctggcacaaaagacaaagctctacatgattcctaatgaatgaacagtaaccttgtttccgtcaatgcattatggttgggccgttgattgtcgttggtactatcatggtcgttacttttatgacacaaaagatgaagatctacaagattctcaacaagtgaacagtatcctcgtttacatcaatgcaagtnnnannngagcttgactctaccggagatacgtnnncaaacatgagagcnntggcattaccccctagtgaatcactcatcaacatagttagcttgtgatttctgtaaggtatgt

SEQ ID NO: 6980 - DNA, 381 bp, Glycine max
ttaaaaattggactgatgatgagaaagtactagccaaggatacgttcttgaaggatcctaactttattaggtggaaggatattctacctcaggaactcaaggacacttcttcctagctagtctagttactgctgtgaaaggatattctgtattagtcttttttccactcaatgaggaagctataagcttctgatgatgcttttgatgtgtatttgtcatgcaggtgtagtgttggttacttcagtgttgtaactttgtatttgtattcctaatgtttttgattcccaagttttgtattacttgtgagaaccaaaaatcattcagactgctggactaaataaatttgtttaatagtagggtctgaactagagcggtactcaa

SEQ ID NO: 6981 - DNA, 401 bp, Glycine max
cttccacccattcaccgttccatcatcgttgatttcatccaatcccttggttccattccccactctcgtcaccacccatcacccttttcgtggtggcgaatcaccgcgaggtacagaggaggcccccgcaccctcaccgtagggaatcaaaccctcgacaacacctactccctcggtaaatcacttaaaacaagccacctcctcgcactcgcttccaaaaattcagcaccaacaactcgcagtaacgctaacgccatccacgtgctgctaacctctgctgacgtggcggtggatggtttctgcatgagccgatgtgggacccacgggtcgggtcgggttgcaaagagaaggatcgcgttcgcgtgggtgggtaacccggttacgcagtgtcctgaggagtg

SEQ ID NO: 6982 - DNA, 1129 bp, Glycine max
  misc_feature (601)..(602): n is a, c, g, or t
  misc_feature (604)..(607): n is a, c, g, or t
  misc_feature (660)..(664): n is a, c, g, or t
  misc_feature (667)..(668): n is a, c, g, or t
  misc_feature (670)..(670): n is a, c, g, or t
  misc_feature (677)..(679): n is a, c, g, or t
  misc_feature (686)..(688): n is a, c, g, or t
  misc_feature (713)..(715): n is a, c, g, or t
  misc_feature (725)..(726): n is a, c, g, or t
  misc_feature (750)..(752): n is a, c, g, or t
  misc_feature (754)..(755): n is a, c, g, or t
  misc_feature (760)..(760): n is a, c, g, or t
  misc_feature (764)..(767): n is a, c, g, or t
  misc_feature (772)..(774): n is a, c, g, or t
  misc_feature (783)..(792): n is a, c, g, or t
  misc_feature (795)..(799): n is a, c, g, or t
  misc_feature (802)..(817): n is a, c, g, or t
  misc_feature (823)..(823): n is a, c, g, or t
  misc_feature (826)..(843): n is a, c, g, or t
  misc_feature (849)..(849): n is a, c, g, or t
  misc_feature (857)..(857): n is a, c, g, or t
  misc_feature (859)..(869): n is a, c, g, or t
  misc_feature (872)..(873): n is a, c, g, or t
  misc_feature (876)..(882): n is a, c, g, or t
  misc_feature (884)..(886): n is a, c, g, or t
  misc_feature (889)..(890): n is a, c, g, or t
  misc_feature (892)..(892): n is a, c, g, or t
  misc_feature (894)..(904): n is a, c, g, or t
  misc_feature (906)..(906): n is a, c, g, or t
  misc_feature (908)..(910): n is a, c, g, or t
  misc_feature (913)..(914): n is a, c, g, or t
  misc_feature (916)..(917): n is a, c, g, or t
  misc_feature (920)..(924): n is a, c, g, or t
  misc_feature (930)..(936): n is a, c, g, or t
  misc_feature (941)..(954): n is a, c, g, or t
  misc_feature (956)..(957): n is a, c, g, or t
  misc_feature (961)..(967): n is a, c, g, or t
  misc_feature (969)..(971): n is a, c, g, or t
  misc_feature (981)..(986): n is a, c, g, or t
  misc_feature (990)..(992): n is a, c, g, or t
  misc_feature (999)..(999): n is a, c, g, or t
  misc_feature (1001)..(1002): n is a, c, g, or t
  misc_feature (1009)..(1018): n is a, c, g, or t
  misc_feature (1023)..(1023): n is a, c, g, or t
  misc_feature (1026)..(1030): n is a, c, g, or t
  misc_feature (1034)..(1038): n is a, c, g, or t
  misc_feature (1043)..(1049): n is a, c, g, or t
  misc_feature (1051)..(1061): n is a, c, g, or t
  misc_feature (1065)..(1069): n is a, c, g, or t
  misc_feature (1075)..(1077): n is a, c, g, or t
  misc_feature (1079)..(1081): n is a, c, g, or t
  misc_feature (1093)..(1096): n is a, c, g, or t
  misc_feature (1099)..(1102): n is a, c, g, or t
  misc_feature (1109)..(1110): n is a, c, g, or t
  misc_feature (1112)..(1120): n is a, c, g, or t
gcgaactacttccgtgtaatggcgacctccgtcgcagtcgccggcgctttgacggcgcatgatcgccggattctgacagcggtgaacgtcggagcgtcgagcctgtcgttggccggttccagcttcattgtagtgtgctacctcctcttcaaggagctccgcaagttctccttcaagctcgtcttctacctcgctctctctgtacgcttcctttctctctctctctctctttccgtgttcctcttcgtcagatctaaaaccctgcgttttcatttttactttttaacgttccttcgaattcactcattcgatagtttaataacacttatcagttatcacgatttgccaaaacgacacggatagacgcgcttatgccttttcaattgaatttaccgatggttgatttcacactttgatatgtatgtgagtgagtgtgtgctttttttgaacctaattgcttatttttgtactcggtttctagttgcttcttttcattagcgtaatcaatcgttttggttatggaacgcatagcgatgaattaactatttccgaagatagatttaaacaaatttactgaacttgcaactctatgttggtctannannnngtgcttaatgaccgagaaccttaggttaagttaaacctactttgtaaaaaaannnnnaannangagtctnnntgtcctnnnagtatttttaagaatcttatttatnnntagagagctnnaaaatatatttggattaacttctnnntnnactcntatnnnnttaannnaaaaaaaannnnnnnnnnaannnnnttnnnnnnnnnnnnnnnnttgaantannnnnnnnnnnnnnnnnnttttancttatggnannnnnnnnnnnaanntannnnnnngnnntcnncncnnnnnnnnnnntngnnntanngnnaannnnnaaaagnnnnnnnaaaannnnnnnnnnnnnntnncatnnnnnnngnnntggaaaaaannnnnnaaannnttgccancnntgttttnnnnnnnnnnttggngannnnnaaannnnnttttnnnnnnntnnnnnnnnnnnaaannnnnaaaaannncnnnaaaaaatttttnnnnaannnnaaaaatnntnnnnnnnnnttttttttt

SEQ ID NO: 6983 - DNA, 402 bp, Glycine max
tcgtcattgcctgcatctgcaccctcctatcccacagtatttggcaatattccagtagctccttcaacctcaacctcacctcaactcacatcaacttttcaacttctcatcattggatttatgatatgtgcgcacttcgcttccttaatgtgaaattaaaatgtccatgtctttgttgccatcgagagcgtagatcaattgactcaagattattcaagcttaattggtaatgttgaggtggaattttggaaatgcatatatgtcaaagagaaaactttatcaagcatcatgatctacttgattcgaacaagatagatacactgtctttacctaaaaaaatgtccatgtcttttattttttcttgcattttttgtcaatgctcaatacgtctccatgttgatt

SEQ ID NO: 6984 - DNA, 941 bp, Glycine max
  misc_feature (841)..(843): n is a, c, g, or t
  misc_feature (879)..(883): n is a, c, g, or t
  misc_feature (885)..(887): n is a, c, g, or t
ctgattctgttcttatgttaaatactgtatctgtgggtcttgtaaaatgaattactctcccataactctggataatatgtgtaatatctgaactaagatttccaaattactttacttcatgcggctgcagctcatcaagaatggtattgctaaaaggcttggataaggacagatttgtgtggttagtaataatctgttatttttatgttagaactgctgaggcaatgctatttggcaaatgcttatttgtgttcgcctgctactattgctttgcgctggtacacaaactatgaaagtcaaaaggcatgtgaattatctgaaaatccacgtgcatctcttcttttttactgggatggtttaaaccggcaggtgactattgcttacattctcgctagccacatcttcagattgacttattcttattgagtatttctatgtagtttactaacatactctaactaaaacacaagtaggtgtactttagcaaatcccattgaagtattattattttgcatttgctgactcattttacattgatgaagtacaatggtttgtgtgccaatttaacaggaagcatctagtttgataatgcaaacttcatgtcactgtacattttggaggcatgccacataacttattgatagttgtgatattttacgactatactaaattggaaaatatgaagcagctgtgatttgtgattgactgattctgttttcccaggtccttttagttggaccaactgtaatcagtaatctatttgtatagtagggaaagaaatttttttcctttctattttaggctcctaaatttgtgtacagttttcattatttatttcctnnntgtaattcatatttgactaaggaaacagattgttgnnnnnannntttcttaggtacgggtggaagggcctgttcagaaagtctctgatgaggaatcag

SEQ ID NO: 6985 - DNA, 1414 bp, Glycine max
  misc_feature (529)..(529): n is a, c, g, or t
  misc_feature (544)..(550): n is a, c, g, or t
  misc_feature (557)..(560): n is a, c, g, or t
  misc_feature (562)..(574): n is a, c, g, or t
  misc_feature (577)..(592): n is a, c, g, or t
  misc_feature (594)..(602): n is a, c, g, or t
  misc_feature (604)..(614): n is a, c, g, or t
  misc_feature (617)..(618): n is a, c, g, or t
  misc_feature (620)..(632): n is a, c, g, or t
  misc_feature (634)..(646): n is a, c, g, or t
  misc_feature (648)..(657): n is a, c, g, or t
  misc_feature (659)..(660): n is a, c, g, or t
  misc_feature (663)..(663): n is a, c, g, or t
  misc_feature (665)..(677): n is a, c, g, or t
  misc_feature (682)..(689): n is a, c, g, or t
  misc_feature (692)..(692): n is a, c, g, or t
  misc_feature (694)..(697): n is a, c, g, or t
  misc_feature (699)..(707): n is a, c, g, or t
  misc_feature (713)..(717): n is a, c, g, or t
  misc_feature (719)..(723): n is a, c, g, or t
  misc_feature (725)..(727): n is a, c, g, or t
  misc_feature (729)..(745): n is a, c, g, or t
  misc_feature (747)..(761): n is a, c, g, or t
  misc_feature (763)..(769): n is a, c, g, or t
  misc_feature (771)..(783): n is a, c, g, or t
  misc_feature (786)..(792): n is a, c, g, or t
  misc_feature (794)..(797): n is a, c, g, or t
  misc_feature (799)..(802): n is a, c, g, or t
  misc_feature (804)..(805): n is a, c, g, or t
  misc_feature (809)..(811): n is a, c, g, or t
  misc_feature (813)..(816): n is a, c, g, or t
  misc_feature (822)..(838): n is a, c, g, or t
  misc_feature (841)..(842): n is a, c, g, or t
  misc_feature (847)..(870): n is a, c, g, or t
  misc_feature (872)..(872): n is a, c, g, or t
  misc_feature (874)..(874): n is a, c, g, or t
  misc_feature (877)..(884): n is a, c, g, or t
  misc_feature (887)..(895): n is a, c, g, or t
  misc_feature (898)..(913): n is a, c, g, or t
  misc_feature (916)..(924): n is a, c, g, or t
  misc_feature (931)..(942): n is a, c, g, or t
  misc_feature (946)..(952): n is a, c, g, or t
  misc_feature (957)..(961): n is a, c, g, or t
  misc_feature (963)..(969): n is a, c, g, or t
  misc_feature (971)..(977): n is a, c, g, or t
  misc_feature (982)..(988): n is a, c, g, or t
  misc_feature (991)..(996): n is a, c, g, or t
  misc_feature (999)..(1004): n is a, c, g, or t
  misc_feature (1008)..(1023): n is a, c, g, or t
  misc_feature (1029)..(1051): n is a, c, g, or t
  misc_feature (1053)..(1055): n is a, c, g, or t
  misc_feature (1057)..(1067): n is a, c, g, or t
  misc_feature (1075)..(1080): n is a, c, g, or t
  misc_feature (1082)..(1083): n is a, c, g, or t
  misc_feature (1085)..(1085): n is a, c, g, or t
  misc_feature (1087)..(1096): n is a, c, g, or t
  misc_feature (1098)..(1100): n is a, c, g, or t
  misc_feature (1103)..(1105): n is a, c, g, or t
  misc_feature (1107)..(1109): n is a, c, g, or t
  misc_feature (1111)..(1119): n is a, c, g, or t
  misc_feature (1125)..(1125): n is a, c, g, or t
  misc_feature (1129)..(1140): n is a, c, g, or t
  misc_feature (1142)..(1156): n is a, c, g, or t
  misc_feature (1162)..(1168): n is a, c, g, or t
  misc_feature (1170)..(1172): n is a, c, g, or t
  misc_feature (1175)..(1176): n is a, c, g, or t
  misc_feature (1179)..(1181): n is a, c, g, or t
  misc_feature (1185)..(1185): n is a, c, g, or t
  misc_feature (1187)..(1204): n is a, c, g, or t
  misc_feature (1207)..(1212): n is a, c, g, or t
  misc_feature (1214)..(1216): n is a, c, g, or t
  misc_feature (1218)..(1229): n is a, c, g, or t
  misc_feature (1233)..(1234): n is a, c, g, or t
  misc_feature (1237)..(1257): n is a, c, g, or t
  misc_feature (1259)..(1259): n is a, c, g, or t
  misc_feature (1262)..(1272): n is a, c, g, or t
  misc_feature (1275)..(1278): n is a, c, g, or t
  misc_feature (1280)..(1301): n is a, c, g, or t
  misc_feature (1304)..(1306): n is a, c, g, or t
  misc_feature (1309)..(1314): n is a, c, g, or t
  misc_feature (1317)..(1327): n is a, c, g, or t
  misc_feature (1335)..(1339): n is a, c, g, or t
  misc_feature (1342)..(1347): n is a, c, g, or t
  misc_feature (1352)..(1352): n is a, c, g, or t
  misc_feature (1355)..(1358): n is a, c, g, or t
  misc_feature (1360)..(1360): n is a, c, g, or t
  misc_feature (1362)..(1363): n is a, c, g, or t
  misc_feature (1367)..(1371): n is a, c, g, or t
  misc_feature (1374)..(1386): n is a, c, g, or t
  misc_feature (1390)..(1391): n is a, c, g, or t
  misc_feature (1393)..(1406): n is a, c, g, or t
  misc_feature (1409)..(1411): n is a, c, g, or t
cttttctcatcttctaagcaaatcctagtaaccttactaaatttctgtgttgaagctttgctataacctgaacctcgtttttaaactccactgctccttgccgggagcttccagtaagcctcttcactgctatttcttgcccatccaaaagaataccctgaaaaacatagaaattaataataaatatggtaaataagtagacaacattgatattctcttctcatacggtagtagctaatatatttaccctataaacctctccaaatccgcctttgcctatcatgttttccttagcaaatctgtttgtagcagcttcaattttggctaattcaaatcgcaaggtttccagagtggtactgtcattcccaactgcagcaaacaaatttgaattctctaagttatttggctaaaggaaatgctttttgagatagcgaaaaaacaagagtattttttttttttcccttaacgttttttttggaaaaaatcaggtggattcttggtggtttttcaaggaaaaaagcagaagcancccaaaaaaaaaacnnnnnnngaaaaannnngnnnnnnnnnnnnnggnnnnnnnnnnnnnnnnannnnnnnnnannnnnnnnnnnttnncnnnnnnnnnnnnncnnnnnnnnnnnnntnnnnnnnnnntnnccncnnnnnnnnnnnnntcccnnnnnnnntgnannnntnnnnnnnnncccccnnnnncnnnnntnnntnnnnnnnnnnnnnnnnntnnnnnnnnnnnnnnncnnnnnnncnnnnnnnnnnnnnttnnnnnnntnnnncnnnntnntttnnntnnnncccccnnnnnnnnnnnnnnnnntcnncctannnnnnnnnnnnnnnnnnnnnnnntnanacnnnnnnnnccnnnnnnnnnccnnnnnnnnnnnnnnnntcnnnnnnnnnaccctcnnnnnnnnnnnncacnnnnnnnccccnnnnncnnnnnnncnnnnnnnccccnnnnnnnccnnnnnnccnnnnnncctnnnnnnnnnnnnnnnnccatannnnnnnnnnnnnnnnnnnnnnncnnnannnnnnnnnnnctcctctnnnnnnanncncnnnnnnnnnntnnntcnnntnnncnnnnnnnnnctcaancccnnnnnnnnnnnncnnnnnnnnnnnnnnncccccnnnnnnncnnnccnncannntccnannnnnnnnnnnnnnnnnnccnnnnnncnnntnnnnnnnnnnnnaatnnccnnnnnnnnnnnnnnnnnnnnncnccnnnnnnnnnnnccnnnncnnnnnnnnnnnnnnnnnnnnnnctnnnccnnnnnnacnnnnnnnnnnnccaccccnnnnnacnnnnnnctccncannnncntnncgannnnnccnnnnnnnnnnnnnaccnntnnnnnnnnnnnnnnttnnnttt

SEQ ID NO: 6986 - DNA, 1372 bp, Glycine max
  misc_feature (460)..(573): n is a, c, g, or t
  misc_feature (575)..(575): n is a, c, g, or t
  misc_feature (577)..(577): n is a, c, g, or t
  misc_feature (579)..(591): n is a, c, g, or t
  misc_feature (594)..(595): n is a, c, g, or t
  misc_feature (597)..(601): n is a, c, g, or t
  misc_feature (604)..(611): n is a, c, g, or t
  misc_feature (614)..(616): n is a, c, g, or t
  misc_feature (622)..(626): n is a, c, g, or t
  misc_feature (628)..(629): n is a, c, g, or t
  misc_feature (632)..(638): n is a, c, g, or t
  misc_feature (640)..(642): n is a, c, g, or t
  misc_feature (646)..(669): n is a, c, g, or t
  misc_feature (671)..(675): n is a, c, g, or t
  misc_feature (680)..(684): n is a, c, g, or t
  misc_feature (686)..(689): n is a, c, g, or t
  misc_feature (692)..(693): n is a, c, g, or t
  misc_feature (695)..(695): n is a, c, g, or t
  misc_feature (697)..(697): n is a, c, g, or t
  misc_feature (709)..(716): n is a, c, g, or t
  misc_feature (718)..(723): n is a, c, g, or t
  misc_feature (729)..(729): n is a, c, g, or t
  misc_feature (734)..(741): n is a, c, g, or t
  misc_feature (744)..(744): n is a, c, g, or t
  misc_feature (746)..(747): n is a, c, g, or t
  misc_feature (749)..(752): n is a, c, g, or t
  misc_feature (754)..(761): n is a, c, g, or t
  misc_feature (767)..(767): n is a, c, g, or t
  misc_feature (773)..(775): n is a, c, g, or t
  misc_feature (781)..(781): n is a, c, g, or t
  misc_feature (783)..(794): n is a, c, g, or t
  misc_feature (796)..(800): n is a, c, g, or t
  misc_feature (803)..(819): n is a, c, g, or t
  misc_feature (821)..(823): n is a, c, g, or t
  misc_feature (827)..(828): n is a, c, g, or t
  misc_feature (833)..(835): n is a, c, g, or t
  misc_feature (837)..(837): n is a, c, g, or t
  misc_feature (839)..(839): n is a, c, g, or t
  misc_feature (841)..(842): n is a, c, g, or t
  misc_feature (844)..(847): n is a, c, g, or t
  misc_feature (849)..(851): n is a, c, g, or t
  misc_feature (853)..(857): n is a, c, g, or t
  misc_feature (859)..(868): n is a, c, g, or t
  misc_feature (872)..(882): n is a, c, g, or t
  misc_feature (884)..(885): n is a, c, g, or t
  misc_feature (888)..(888): n is a, c, g, or t
  misc_feature (890)..(891): n is a, c, g, or t
  misc_feature (893)..(907): n is a, c, g, or t
  misc_feature (909)..(912): n is a, c, g, or t
  misc_feature (915)..(921): n is a, c, g, or t
  misc_feature (924)..(928): n is a, c, g, or t
  misc_feature (933)..(940): n is a, c, g, or t
  misc_feature (944)..(944): n is a, c, g, or t
  misc_feature (946)..(946): n is a, c, g, or t
  misc_feature (948)..(949): n is a, c, g, or t
  misc_feature (952)..(952): n is a, c, g, or t
  misc_feature (960)..(968): n is a, c, g, or t
  misc_feature (971)..(972): n is a, c, g, or t
  misc_feature (974)..(989): n is a, c, g, or t
  misc_feature (991)..(991): n is a, c, g, or t
  misc_feature (994)..(996): n is a, c, g, or t
  misc_feature (998)..(999): n is a, c, g, or t
  misc_feature (1003)..(1010): n is a, c, g, or t
  misc_feature (1013)..(1016): n is a, c, g, or t
  misc_feature (1018)..(1020): n is a, c, g, or t
  misc_feature (1025)..(1027): n is a, c, g, or t
  misc_feature (1032)..(1034): n is a, c, g, or t
  misc_feature (1037)..(1056): n is a, c, g, or t
  misc_feature (1058)..(1058): n is a, c, g, or t
  misc_feature (1063)..(1067): n is a, c, g, or t
  misc_feature (1069)..(1073): n is a, c, g, or t
  misc_feature (1076)..(1087): n is a, c, g, or t
  misc_feature (1090)..(1094): n is a, c, g, or t
  misc_feature (1097)..(1103): n is a, c, g, or t
  misc_feature (1105)..(1110): n is a, c, g, or t
  misc_feature (1112)..(1115): n is a, c, g, or t
  misc_feature (1117)..(1124): n is a, c, g, or t
  misc_feature (1127)..(1139): n is a, c, g, or t
  misc_feature (1142)..(1158): n is a, c, g, or t
  misc_feature (1161)..(1163): n is a, c, g, or t
  misc_feature (1166)..(1189): n is a, c, g, or t
  misc_feature (1192)..(1200): n is a, c, g, or t
  misc_feature (1203)..(1208): n is a, c, g, or t
  misc_feature (1211)..(1225): n is a, c, g, or t
  misc_feature (1227)..(1233): n is a, c, g, or t
  misc_feature (1235)..(1243): n is a, c, g, or t
  misc_feature (1246)..(1247): n is a, c, g, or t
  misc_feature (1249)..(1251): n is a, c, g, or t
  misc_feature (1254)..(1260): n is a, c, g, or t
  misc_feature (1263)..(1265): n is a, c, g, or t
  misc_feature (1267)..(1275): n is a, c, g, or t
  misc_feature (1282)..(1284): n is a, c, g, or t
  misc_feature (1286)..(1292): n is a, c, g, or t
  misc_feature (1294)..(1296): n is a, c, g, or t
  misc_feature (1298)..(1308): n is a, c, g, or t
  misc_feature (1312)..(1321): n is a, c, g, or t
  misc_feature (1325)..(1325): n is a, c, g, or t
  misc_feature (1327)..(1334): n is a, c, g, or t
  misc_feature (1336)..(1340): n is a, c, g, or t
  misc_feature (1345)..(1369): n is a, c, g, or t
gcgtctttttaacttcaatgaagttccacaaatgtctatgcttaccagcaatcatgtacctcctgttgtaaattctgaggaatctgccccaaatagagagcttccccaccctcagcgtggtgcccgtgaaagagaacttctacaggtatcttcttactgtattattttgttgctttttgattaatgatgctcactttatctatctgtgatataggctgttaatcaacttggtgatgctaatgaggttctgaatgaacgtgctgtggttgtcatggctcgtatgagtaataagcttacaggacgggatttttcaacttgttcttcagtatcaaacaactcccttcagcatgctgtggaccatagcagcttaatttctggagacactcgtgaagttgatcatgctttatctgttaagttgcaagttcaaaagttaataatccaagcctcctcacatgaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncncnannnnnnnnnnnnnaanncnnnnnccnnnnnnnnccnnncccccnnnnncnnccnnnnnnncnnncacnnnnnnnnnnnnnnnnnnnnnnnnannnnnccaannnnncnnnnaanncncncccccccccccnnnnnnnncnnnnnnacaccnccccnnnnnnnncananncnnnncnnnnnnnncccaanccaccnnncacccncnnnnnnnnnnnncnnnnnccnnnnnnnnnnnnnnnnncnnnacannccccnnncncncnncnnnnannncnnnnnannnnnnnnnncccnnnnnnnnnnncnnccncnnannnnnnnnnnnnnnnannnnaannnnnnnacnnnnnacccnnnnnnnnaaanancnncanccccccannnnnnnnnccnncnnnnnnnnnnnnnnnnanccnnncnnaacnnnnnnnnccnnnncnnnaccannnccccnnnacnnnnnnnnnnnnnnnnnnnncnccaannnnncnnnnnacnnnnnnnnnnnncannnnnccnnnnnnncnnnnnncnnnncnnnnnnnnccnnnnnnnnnnnnncannnnnnnnnnnnnnnnnccnnntcnnnnnnnnnnnnnnnnnnnnnnnnccnnnnnnnnntcnnnnnntannnnnnnnnnnnnnnannnnnnnannnnnnnnnatnncnnnctnnnnnnnccnnncnnnnnnnnnaatactnnncnnnnnnnannncnnnnnnnnnnncttnnnnnnnnnntccncnnnnnnnncnnnnncttannnnnnnnnnnnnnnnnnnnnnnnnact

SEQ ID NO: 6987 - DNA, 407 bp, Glycine max
atcttagaaagcattagtgataataacatcaactataaagacttaatgtttcgtgaacttcgacctgtacagaaaaactgttagtattttgttgtgcgggaactttctgctgtccttccaaagtaacaaaatgttgtttcaaatcctgaagttctatagctgggtagcttgatgaccgaaggggtcaagtctgcaatttgaaggatttgtattcgccccgcaatggatgttgatatgaccatgttggataagttgaaggatttcaaatgtactgaccgttctttgctgtatatatggcataaattcttgacagtaggaatctaaagcagattttcgtcaaagtacatctttttatctttgatatttctttcgtgttctatattttggttaccattatctcagcagca

SEQ ID NO: 6988 - DNA, 400 bp, Glycine max
taaataaaagcctattatatctcttcttacatatttttatctgggtctgggtcctgcgtagtccatttttgtttttgttaagtattggttactactatgactatggcttgttcaagtggaacatcttcagggacgtcgtcggagctgcagggtatgatggatcagaggaagaggaagagaatgatatcgaaccgcgaatcggcaaggcgatctcgaatgaggaagcagaagcacttggatgatctagcatcgcagctgactcagctcaggagccagaatcagcagcttctcacgtctgtgaacctcaccagccacaagtacttggcggtggaggctgagaactctgttttgagagcacaagtgaacgagctcagccacaggttggactctctcaaccaga

SEQ ID NO: 6989 - DNA, 349 bp, Glycine max
aaggtgaagagaagcccagtgaagtccatcaaggacctccgcaacaacaacaaccgtcgctggcgacggaaaacccccataaaaaatgtggtggcggcttcctccgccgcgctggccaccatccgccgccgtatcacgaaactcttctcgaagatcgcgcgcctcagcaccagcgcccacaagaaaaaagcaacctcctacaaaatcctcaaaaagactacaacaaccgacggagaactcgacaacattcgccgaaccctcgtgttcgacgacaccaccgccaccaccaccaccccgctcctccctccgttgttctccgtccgaaaaacggtgttcctcgacctcaaaa

SEQ ID NO: 6990 - DNA, 687 bp, Glycine max
atatgatgacttttaaggtgagctatgatccttggtcattattcaagactgtatttggtttgcaactaataatctatttcaatcttctcggctaagtgcagacaatgacgacattcatgcctccgccacctgcagcaacttttcttgcttttcatcctcaggataacaatattattgctataggcatggatgattcttccattcaaatatataatgtccgtgtagatgaggtatcattgctgcccataaacatttcctgctcagtttttatttgagtaataaggtgtttatgcatttttttttcttctttgcaggttaaaagtaaactcaaaggccatactaaaagaataactggtcttgctttttctcatgtgttgaatgtgctagtttcatctggggctgatgctcaggtaataattgtccactggagatctttctccggaatcccttttctatgattaaattgcattaaaagacttagtttagtatcttataactacttttcatcaattatggccccctttgagcatgctgttggcaatgcattgccccttctatatcatatatatagagttatctgtctattgtgcagatttgtgtgtggaatactgacggatgggaaaagcagaagtctagattcttgcaacttcctgctgggaggactccaccagcacaggcagatacccg

SEQ ID NO: 6991 - DNA, 363 bp, Glycine max
tttcttactcatctgcgtgggaagaaattgttagacattttcccttttctgatttgcctctcagcatcagctttgcttccaaagatggaactttgattttaagggcatcaagcttcaagagaagagaatcagaaagtgctattactgttttgtcaaacgggtccagaagttcgaaccggttgagggataacagaccccaacatgtgatccttgaaagaaacttttcgtttgttcaagatgaggagaacaacaaaatgggttgggatactcttgcaagcaaaggtggtgaattgaaacataaaccagtgcctgtgctttctctgcctcaagcagcgattttctctcactctagacctgcctctg

SEQ ID NO: 6992 - DNA, 1104 bp, Glycine max
  misc_feature (371)..(371): n is a, c, g, or t
  misc_feature (373)..(379): n is a, c, g, or t
  misc_feature (381)..(383): n is a, c, g, or t
  misc_feature (386)..(403): n is a, c, g, or t
  misc_feature (408)..(413): n is a, c, g, or t
  misc_feature (415)..(415): n is a, c, g, or t
  misc_feature (418)..(418): n is a, c, g, or t
  misc_feature (420)..(425): n is a, c, g, or t
  misc_feature (427)..(438): n is a, c, g, or t
  misc_feature (440)..(443): n is a, c, g, or t
  misc_feature (449)..(453): n is a, c, g, or t
  misc_feature (455)..(458): n is a, c, g, or t
  misc_feature (465)..(465): n is a, c, g, or t
  misc_feature (467)..(481): n is a, c, g, or t
  misc_feature (489)..(494): n is a, c, g, or t
  misc_feature (500)..(501): n is a, c, g, or t
  misc_feature (503)..(506): n is a, c, g, or t
  misc_feature (517)..(525): n is a, c, g, or t
  misc_feature (527)..(542): n is a, c, g, or t
  misc_feature (545)..(575): n is a, c, g, or t
  misc_feature (585)..(594): n is a, c, g, or t
  misc_feature (599)..(600): n is a, c, g, or t
  misc_feature (603)..(607): n is a, c, g, or t
  misc_feature (609)..(615): n is a, c, g, or t
  misc_feature (618)..(618): n is a, c, g, or t
  misc_feature (620)..(628): n is a, c, g, or t
  misc_feature (632)..(632): n is a, c, g, or t
  misc_feature (641)..(649): n is a, c, g, or t
  misc_feature (661)..(671): n is a, c, g, or t
  misc_feature (673)..(685): n is a, c, g, or t
  misc_feature (693)..(705): n is a, c, g, or t
  misc_feature (708)..(708): n is a, c, g, or t
  misc_feature (710)..(710): n is a, c, g, or t
  misc_feature (719)..(719): n is a, c, g, or t
  misc_feature (730)..(731): n is a, c, g, or t
  misc_feature (733)..(737): n is a, c, g, or t
  misc_feature (743)..(755): n is a, c, g, or t
  misc_feature (758)..(758): n is a, c, g, or t
  misc_feature (760)..(769): n is a, c, g, or t
  misc_feature (774)..(777): n is a, c, g, or t
  misc_feature (781)..(784): n is a, c, g, or t
  misc_feature (787)..(789): n is a, c, g, or t
  misc_feature (791)..(791): n is a, c, g, or t
  misc_feature (794)..(794): n is a, c, g, or t
  misc_feature (796)..(800): n is a, c, g, or t
  misc_feature (802)..(806): n is a, c, g, or t
  misc_feature (825)..(828): n is a, c, g, or t
  misc_feature (830)..(830): n is a, c, g, or t
  misc_feature (834)..(834): n is a, c, g, or t
  misc_feature (836)..(851): n is a, c, g, or t
  misc_feature (856)..(866): n is a, c, g, or t
  misc_feature (873)..(877): n is a, c, g, or t
  misc_feature (881)..(891): n is a, c, g, or t
  misc_feature (893)..(893): n is a, c, g, or t
  misc_feature (895)..(899): n is a, c, g, or t
  misc_feature (904)..(909): n is a, c, g, or t
  misc_feature (914)..(914): n is a, c, g, or t
  misc_feature (916)..(920): n is a, c, g, or t
  misc_feature (923)..(925): n is a, c, g, or t
  misc_feature (927)..(928): n is a, c, g, or t
  misc_feature (930)..(935): n is a, c, g, or t
  misc_feature (937)..(937): n is a, c, g, or t
  misc_feature (939)..(939): n is a, c, g, or t
  misc_feature (943)..(948): n is a, c, g, or t
  misc_feature (966)..(972): n is a, c, g, or t
  misc_feature (977)..(979): n is a, c, g, or t
  misc_feature (982)..(984): n is a, c, g, or t
  misc_feature (986)..(992): n is a, c, g, or t
  misc_feature (994)..(995): n is a, c, g, or t
  misc_feature (999)..(999): n is a, c, g, or t
  misc_feature (1001)..(1001): n is a, c, g, or t
  misc_feature (1003)..(1012): n is a, c, g, or t
  misc_feature (1016)..(1017): n is a, c, g, or t
  misc_feature (1025)..(1029): n is a, c, g, or t
  misc_feature (1031)..(1032): n is a, c, g, or t
  misc_feature (1045)..(1059): n is a, c, g, or t
  misc_feature (1069)..(1076): n is a, c, g, or t
  misc_feature (1080)..(1090): n is a, c, g, or t
  misc_feature (1093)..(1100): n is a, c, g, or t
ggccttcattgataggataggaagattcgccatccaattgatgggattcttctttatgactatcttcatgtttgctcttgccattccctatgatcactggactcttagggagaacagaattggatttgtggtcatttactctctcacattcttctttgcaaactttgggcctaatgccaccacatttgttgtgccggcggagattttcccagctagatttagatccacttgccatggaatatcttcagcatctgggaagctcggggctatggttggtgcattcgggtttttatatttggcacagaatcaggacccgagcaaagcagatgcagggtaccctgcaggtattggtgtgaggaattcactgcaancnnnnnnnannngcnnnnnnnnnnnnnnnnnnaccgnnnnnncnccncnnnnnntnnnnnnnnnnnncnnnncttccnnnnncnnnntaaaccncnnnnnnnnnnnnnnncctacccnnnnnnccaccnntnnnnccctcccttannnnnnnnncnnnnnnnnnnnnnnnnctnnnnnnnnnnnnnnnnnnnnnnnnnnnnnnncccccatttnnnnnnnnnnccccnnccnnnnntnnnnnnnttncnnnnnnnnncccncgtacgatnnnnnnnnnaatatttataannnnnnnnnnncnnnnnnnnnnnnncgtctccnnnnnnnnnnnnnttncnttttactcncaaaccacccnncnnnnnccaccnnnnnnnnnnnnnacncnnnnnnnnnnccccnnnncaannnnttnnnanccncnnnnncnnnnnccgccctttttttcttttnnnncnctancnnnnnnnnnnnnnnnnaccannnnnnnnnnnccacccnnnnncctnnnnnnnnnnncncnnnnnccccnnnnnnctttncnnnnnccnnncnncnnnnnncncncaannnnnncacaccgattaatcttannnnnnntccannnaannncnnnnnnntnncttncncnnnnnnnnnntttnnctttatcnnnnncnncacccccaccaannnnnnnnnnnnnnncccttttccnnnnnnnntatnnnnnnnnnnnacnnnnnnnntccc

SEQ ID NO: 6993 - DNA, 394 bp, Glycine max
gtcgactgaacttgcaccagagccaccagctcatgtgggttagggctaaccatatggtttatgattattgcgccgacactgctaggttccccgttatacctgctgagtgtgttcaccaccgtcaccactgaaagggagaagagaagaggaagagaacgaactacttttgtttaacataacatgtgcttcatgtttcaccttgtaacatatttcgccttagctttatgtgaattcttttatttccttgtttaatcattagtaccatccaattttattctttttgttttttaatttggaccaagagagaaactagtgagattttctaagattaatagaccatcaattttaaaatatatcatgtgtaatttctaaaataaaccatcaaaacaaactc

SEQ ID NO: 6994 - DNA, 518 bp, Glycine max
  misc_feature (181)..(181): n is a, c, g, or t
tttacacttcacgaaagtgcaccaaaattatggtaagtattctctttaccgagtcatttactggtctgccatggtttgacccccaataaattggtaaattttctagttatttttactactgcattttgcatctctattaattggctaaatcatgtcaggttagcctaaaactggatcctanctctcaggaagaaataaaacaaacaaaaagtaccatatattgagcgatgggcaaaataagtagagttatgcattatctatagattattgcaatttgttttcattcattcattcttgttttgtcggattgctgacaggtacgtagaaaaggaatttggaggtagttaaatgcacaagcacaaagcataggcgtgaagaatagaaaaatatctagctaaatatatttgtggaaaaagggctttctcactagtggttttacttactctaaatgtgtcaatcatcatgcatgagagatagaattgcacgtcatgaccgggttgtaccaactggtaattttt

SEQ ID NO: 6995 - DNA, 331 bp, Glycine max
accccctcttccgataccctggcgccgcgaaggtgcagtcattgcggcgtgcagaaaacccctcagtggagaactgggccgctaggcccaaaaacactatgcaacgcgtgtggggtccgcttcaagtcgggccggctcttacccgaatacaggcctgcttgtagcccaacattttcaagtgaattacactcgaaccatcatcgtaaagtgctcgagatgcggcaaaagaaggagacagtttctgtggatgagactggttttgcccctgctcatgttgttcccagtttctgattctttttattacataagaaaagaaaagaagaaaaaaaaa

SEQ ID NO: 6996 - DNA, 353 bp, Glycine max
ttatctctcctcttgctagcacaccttcttcagccacacgtatttgttaaaggagatggcagtttgatagagaaaacctgcaagaacaccaagtactacaatctgtgtttctcctccctgaaatccaatccaagcagcgcaaacgcggacccaaagggcttggctgtgatcatggttgggattggaatggccaatgccacttccacttctctctatttgtcttctaagatgcttggcactgccaacaacaacgattccaccttcaaaagggtgctgaaggagtgtgcagaaaagtacaagtatgccagtgatgccctccaagcttctgctcaggatttggttaatgagaagat

SEQ ID NO: 6997 - DNA, 349 bp, Glycine max
gagtttgttccttttgccctcagatcatcgtcattatctggaactaccagctcggtagatgcaacagcaaagctttctgctgctggagctcttgggaaagcagtttttgatagatcagaatcatccatttcaaataattctgatgatgaggtacaccaatactggcgatgtcagctccctgatgatatcacccctgatttcaaggtcatgggagaagatgagtctcgagttcttgatgatctttctttagcaggcttatccatacatgatgacaatgaagcctccaggtttccttcttctaaaggaagtaaatatattataaatgagcaggaggaaatatctcaacagc

SEQ ID NO: 6998 - DNA, 829 bp, Glycine max
  misc_feature (15)..(16): n is a, c, g, or t
cttcctgtgtgaggnnactagaagaacttgctctcctcacttcaaaaaccttcttgctaaaatcaatgattcagatgctcctccagtgagttgcatagtttctgatggtgtcatgaccttcactcttgatgctgctgaagaattgggtgtccccgaggtgctgttttggaccactagtgcatgtggatttatgtgttacgtgcaataccaacaactcattgaaaaggacctaacacctctcaaaggtaattaaatttatttgattttattattagtactttggcagttaatttttcagggagctatattacctgggaacgatatttatatacataaatttgtgagaatatcttttttaacgataaatattaatttattagtttggttagaacaaaatattcaaactttagattttttttaataatttactttttacttctttttaaccatcagatgaatcttatatctttaaatttgtgagagcatgctcattataaaatatttttttatattacatttcaaattatggatagagtttgtgacatatattatcttaaaaaaagtttatggggacaatttggtagctcctaaagtcttcaaagcatattcgttcttgtacactttggtctacatgaaaaaattgtactctatatgtccctgttcgattatgtatttcatacgattttttatgtttggtaatagcatagtatgagtctaatttaattaattaactcttttgtgtttgacatgtagactctagttatatcacaaatggttatttggagactaccatcgattggataccaggcattaaggaaattcgatgaag

SEQ ID NO: 6999 - DNA, 401 bp, Glycine max
  misc_feature (301)..(303): n is a, c, g, or t
  misc_feature (305)..(307): n is a, c, g, or t
  misc_feature (348)..(352): n is a, c, g, or t
  misc_feature (356)..(359): n is a, c, g, or t
  misc_feature (368)..(369): n is a, c, g, or t
  misc_feature (374)..(375): n is a, c, g, or t
  misc_feature (379)..(380): n is a, c, g, or t
  misc_feature (384)..(391): n is a, c, g, or t
  misc_feature (394)..(394): n is a, c, g, or t
  misc_feature (397)..(398): n is a, c, g, or t
gaagcgaaaagcgctttctaacttaagtgatggcgaacgcagctgaagtttcagccttgaaccgcatcaaactgcatcttttgggtgaactctctccactggccactcccctaaactattttgatgaatcaaaccctagcccctctgaatcttccaattcccaatcttcttctgtttctcttaaccactacttcactgacctcttcgaattcgactccaaaccccaaataatcgacctccaaactcccaaaacactaacttcagctcagaagaaacctcaattgaagtttcttctgggctnnntnnntgttttgggcgtttggcggttaattatttggggtttggagnnnnntttnnnnaggttcgtnnagttnnggtnncgannnnnnnncgncgnntgg

SEQ ID NO: 7000 - DNA, 415 bp, Glycine max
atatgtcaagccaacagccaactgttggatatactaatttaattagttctctaatgtcgcaaggtgtgatctcattggctaaccagctgcctgcacaggtatctaatattaacatctatcagaagttgatttctttcagttttttcccattttgatttgattgtgacacccaagagttaattaaatatttgtttttaggattctgttggaactgagtttaatccagatattctgaaggttcgtcatgagtctgcagtcaatgccttatatggtgatctccctagacaatgcacaacttgtgggctgagattcaaatgccaagaggaacacagtagtcatatggattggcatgtgactaagaatcggatgtctaaaacccgtaagcagaaaccctctcggaagtggtttgttagtg

SEQ ID NO: 7001 - DNA, 627 bp, Glycine max
  misc_feature (525)..(526): n is a, c, g, or t
  misc_feature (590)..(591): n is a, c, g, or t
  misc_feature (620)..(620): n is a, c, g, or t
  misc_feature (622)..(622): n is a, c, g, or t
caatttgttgcagtaagtcactttgcaattttaacttacaatggtacatagtttcatattttttattggcagtgcagtggcatagacaataaaatgttacatagtttcatagtttcatattcatgtatggtttttcaggtacctaatggtgttggttctgctttggggacaacgcaactaatattatatttcatataccgagacaataaaggcgttacagggaaacaagccccaacagaggaggaatccatggagatcggggatgtaaagccccaacaagggaagcaatccaatgcaaatggaattcaaggatgatatgtcaaatcacaacacatgccaaagacaatagtcatgtttgtcatttttcagctacataatctgcaactgagagcaagaacctctatgatttgatctgctctttaaatggctgtaatttacttcttgctaagacactggcatcttcaattagacgaacagatcaaggatatttcaatcttttctgtttaagtgttgggtgcaccagcnntaatactgggtgcacctagcaaaaccctataaaaaaatatacatctgggccgatattgatctgnnatttttttttttttttaaaaaatttatcntnatttt

SEQ ID NO: 7002 - DNA, 407 bp, Glycine max
actgaggtagctctcgattttctcgatgagttcggagtctgaggagcttgcggatttgagctcctcggatatggacgccaagtagtccacattgagctggtttaggtctctgcagtcaccaagtgatgcagtctcagcatggttgagggaaggtgatttttggtggcgttggagaaagtcctcaaagactttggctagttttcttgcctgtttgaggctttgttttatggagaacttgccatagccataagggtctgaaggggatgaacgaatggctgagagaatggaacggcagagttttggatatagtgtgcctttgcaggcaacagaagaagaagaagaagaagaaggagaaggagaaggtggagattgagctaagagtaatggtgctaacaggaagacaaaga

SEQ ID NO: 7003 - DNA, 398 bp, Glycine max
cacgacactgggcgcgcgcggcgtgcgtctccacccgattctccaccctcattcgccacttctgctggaagaccaaatgctcccaaaccttcccctcatctctcatctcctccgattccccctccacctggtcctccctcctcaagctcgccgtttgctgccccggcctccgccacgccggcatccccgccgaccggaacgccgcgaaacggatgaacatctgccggaattcgcatttggccggcggctatcggcatctgaggagagaacagggatgcaaacttctcgcgagacagttccgcgacgataatttgttcctctgcgactggcccggctgcgtgcactcctatcagaggcgcgactacatgctcttccgagggttcttccataacttcaaa

SEQ ID NO: 7004 - DNA, 377 bp, Glycine max
ataaaaacctcgcacgaacaagaaatctgaaaccattaagaatgccatcataacttgaatggccgatatcagtttccttgatgagacagatttgaagtattgattatatatgatgccccataggagcattgttgcctggccaaacaccttggagatacccaatactgacgagtctattttcaaatactgtgtctggtaaaagaacatggtgcctgtaagtgcaggaataatggcataagatgctgtaaaccatgatattgaatatgcaatttcaggctttcttagagcaaccaatagctgtgaaagctgtttccttattccaccagatggactctttgggagcctgagagaactctcacgaaccgagatggttataa

SEQ ID NO: 7005 - DNA, 1011 bp, Glycine max
  misc_feature (942)..(944): n is a, c, g, or t
  misc_feature (975)..(976): n is a, c, g, or t
  misc_feature (987)..(989): n is a, c, g, or t
  misc_feature (1001)..(1006): n is a, c, g, or t
ttacttgtaagtcagctagatatcacatgcatgatgttaggtgtaattgaagcagatatcatgtgtcaaaaatcctgtgtcgtacttgttgtaattaactaaatggtttttgaacttcagaccagcaatctacaggtctggtttcatgtgtaagagatgtaagaagtcatattctagcaaagacaggtatctggatctaactgtaactgctggattgagagactacactgaaattcaacctgctcggactgagcttttcaggtatgattagtgttataactacactgaaattagaccgacatgtgttataaccccttgatactatgtaatataatggtgtcaggtacatatccttgctgagcaatttttatcttatgtttcacataccagtttatcaacaatattgtgttatatgtccctttttccatttgttttttattagaggatttgttttcttctttttgccatttttatgagttattgttttaacatgtgacataagttgcataattcagttttctgcatgccccaattgtttgggaaagttcttatgttttcctgtgtgtttaacctgttattaggagtcccctggtttcattcttatatgaaagaggttggcgtcagaatttcaggcaaagtggctttcctggtcccgatgaagaggtatgcatccacagcctgtcctgtagttgaaatgtgccaatacatgaaaaataatattcaggtttcttggtacttgtcaaagagtattttggtagacatagctgactttgtttaataataaatgtatcacaggatggaagttgaggctctatatctttttttcttttttgctctggcatttggcttaccgcattttagttcaatttcaatacattttgtttgtgatgcagttcaaaatggctcaagagtactttgaatctgctaaaggtggactaattnnngatgttagctgtggtagtggtttattttccnnggaaattcgcnnnaatctggagcannnnnngagtc

SEQ ID NO: 7006 - DNA, 627 bp, Glycine max
  misc_feature (476)..(476): n is a, c, g, or t
  misc_feature (478)..(478): n is a, c, g, or t
  misc_feature (620)..(623): n is a, c, g, or t
tgatgcagtacatgatgaggaaactccaataccattgcaacaagtttctgatgcagtacatgatgaggaaactccaataccagtgcaagtttctgatgctgtaaataatgaggaaactccaacagtatcattgcaacaagtttctgatgcagtagacgatgaggaagctcccacaacaccatcacaagtttctgatgaggctggatgtgatgatggtcagatgatagatgacatggaacctgataattgtgaggaacaagctgcaaagaggaggcggctaatgcctctacagtgcagaagtgaggcattgtgacagaatccgatttgtagataaataggtatagataaatatggcatcttgttttacctttgcttttgaattatttctaggctttactttaccaatatgtgaatagtgtcgttgcttggtagtagataattctgcaaccaatattgataaatatctgctgactttntncaccattactttactttaccaatatgtgaatagtgtcgttgcttggtagtagttaattctgcgaccaaaattgagaaatatctgcggactttagacacgattattctgcgaccaaaattgagaaatatctgcggactttatnnnngatt

SEQ ID NO: 7007 - DNA, 406 bp, Glycine max
atatatagctgtggatttttggtacagatatttcgaaaggtcgttattattttttggcagcacttggtgaaaggatacagctgaaaggattcttcacattttgcaatgtcttaacaataaccatcatacagttggagcatttgttagcttggatactaaattgactatacatataatggttatgtttggatatagctggtgggttgtgtagaatgttgtaggttgtatattgctatacaagagtggattactagcgaggcatagtttaaaggttaaggtgttatttctttcctcgcaatcccattctttctattcagtttgatcaattataatgtttgtccctgatgtcatgtgtgaattatgaggaacgtattttattaataatgtttgtccttgatgtcatgtg

SEQ ID NO: 7008 - DNA, 410 bp, Glycine max
cgcgtgcgtcccagacgccaatcaattaactctacgcgccaccgccctctgcggcttccggcgcgacggcgttcaagtcaaagccctcattgataattacctcaccaccctttttccttggcttgtcatcctcttcggcagcaacgacgtcgtggcggtggtccaccgtgagctccgccgtctcgagggccttccgccactccttgccaccactccctttgtcatcaaagtacttcaccgccaccctcatccttcttagtatggcaaaaaactcttccacctcctcctccgtgggaacaccaccatcactaccatcttcttcttctacaccctttagtctcttgttcttcactctttcactctcttcttcctctctcatgaccctcttgttcttcctcttctccatttcc

SEQ ID NO: 7009 - DNA, 471 bp, Glycine max
tcaccacattttcactaatgttacagtttctgttctttatactatgttcttcgtttggtcagctaagcttagctttcacgtcgcaagagtaccatgaggctcttgagaaatccattctcttcttcgagggacaacgatctgggaaattgccttccaaccagcaacaaacatggaggggagattctggattgtccgatggctcttcctaccatgtatatagatatatgtaaaattgaaaattaaactgattagttttgctcacatacagtttaatcatgattaatattcttgttattcaggtggacttagtaggcggttattatgatgctggagacaacgtcaagtttgggttgccaatggcctttaccactacattgttagcatggagtgtgattgaatttggaagctcaatgcaggaccaacttgaaaatgccagagctgctattcgttggagcacggattaccttctta

SEQ ID NO: 7010 - DNA, 440 bp, Glycine max
  misc_feature (419)..(420): n is a, c, g, or t
gcatacttaggtcaatgaagatgtttgagtacatagcaattttcttatccaagtgattcaaagtaaatagattaaaaattattattccccatttcaaaaacaaatacatcctaaactctattgatcaaactcaaattgaagagtaagtctctcaaagaattaaaggtctgatcacatggtaatagttacctgatagcccttaagcccaaccttctccagaattcttttgcaagcaatgacctcatcagaactaacaaaattaaaacgagaaataaatcagggtttttagaatattttaactaataggcctgataatgaagattaacaacttaaatacctcccatccaaagcttcaggtgcaagaagtccaaatcaatccgcaaattcatcaaaacagcttatcctaattgcctccaaannagttaaccgaagtggctcca

SEQ ID NO: 7011 - DNA, 380 bp, Glycine max
agtaggaggctctgaacaaggattccaagtcgagcacacttactatcagcttcaccattataatcacattgcccataaagctgcagtagatccccaatcagatcatgatctcttactgaaaagctcaactccgcaatgtgtatcatcaaatgcatttggagggccagcagaaagtaatgctgcaaactatggtgtggatggaaatgcagtggagagtgatcatgggagcaataatggacaggatggaagcaacaacttgacaatcagaacgataaatgtggaaaacggaaatgtggctgctgggagcattggaattggtggcattgataggaaaagcattgggaacgggacagatgaagtacggcttgcattgagagaga

SEQ ID NO: 7012 - DNA, 795 bp, Glycine max
aaattccgcaggtcctgccactgtcatttgaaaacaacataacaaacaaacaaagaaaagcccatgccctttgcttcaactctcacaacactatcaatcaaaatccccaaaccccaatttctcgtccccgtacgatattttccccgcaattttcatcgatccgtatccgctcgcattgctgtttcatccacattgcaatcttccaggacattggatttgatctctgctttccgaagcgtgagattcctctccctcacctttttcccacattgcttcctccagataggttcgcgccgatctgcttctcttttgcctctttcgttgcgtaaatattgctctataacgcgtgtcagctaatattgtagcttcgatttgtagtttagtgttttaatgctttctttacctcaaatcggttttctgcatttgcttctccttcattgtatttctcgagagacaccttttaatttcgttcttcatggaatgcgtaccgatattctgctggagtgacagtaaattgtttaatgcagcttattttaaccctaattccttatatttttttactgagaagaagcatattgttatgatcattctgtttctgtgttgttattggtcttcttttttttggatgaattgttgttaagtatattttggttaaatgtttctcctgcactggaagtattaacttgtttggattgagtttctgcttattaaaattcttagttgttgcagtgtaggtgttattgatcgagggggtgaggagtgtgaaaacgagcatgcagtggagcaggaggggcg

SEQ ID NO: 7013 - DNA, 687 bp, Glycine max
  misc_feature (6)..(6): n is a, c, g, or t
ttatcngaagtaagtttctaaatgcatattgatgttgatatcagttaatgtttacagaagctgttttgcattattccttattaatttgtaactttggttgggttttcatttcccagacagccaatttaaatgtttcaaatgttgatgaaaatttaaattctggtataataaaatctatacaatttacttttctgaaacagaaatactcaagtgcgatagccccccgcaccgagcaaaagcccacatttgtaagatgcctagatttttggcttcttctgttgaaaataatgactgaacacaattatagcttttcttttgctgcaattttatgcaggaatcacccacacctacaaaacttattccccatattacacgtggcggcttgtcagactctcatcgatcaaaattaacagcagataggcaccaggtattatttgcgcttgagcactgttgtgctcagacttcagataactgcataaagtgtaggaaatgtaagaatcaattgacttaggcatggatacaacactaataaaactgaaatgtggtgcaaaacaagaatgaaatgtatatattatcaattttatacctaaacatattcatcagaagctaggattgactgtgctttgcattttgccaaatattgtgccctataggcttattgataccatgtgttgtgcaggataacta

SEQ ID NO: 7014 - DNA, 924 bp, Glycine max
  misc_feature (55)..(55): n is a, c, g, or t
tgtgtctctgctgcgaagcccaacaggccaaagagagcgctacccagatcgcccnccttgtggcgactcctcgaagtgcgaacccatttggtgttaaggtcgaacctgcgaaaaagatggaacctttggaagaagaacaacaatgtcggacacccctcgccaaggttgtctcagattgctccaagcgctggttccaggacaccctcaaggaggctaaggctggggacactaccatgcaggttttggttggtcaaatgtattactctggatatggtgttgcgagggatccccaaaaggtcttttctttcttcttatttttatcattctatgtgcaatgtaataattgattgtacaccccttgtaaagggtatggtcatagactcatatatattagtgcttgattcttttaagttatccctcatttgatgccaaaattatgtgattttgttccctccttggaattggaactgagatagagtgcagggaagttgggcattttacttgctgttagattttaaatcccttttcttgtgttataatttttatcagattgttgttttttgatttagaagctctctcatattagcttctccaaaagctggtttttaagtcaattttagcttatcagattgttgtttttccttttattttcttctcctataagtgttcatggagaagtttatccaaatatgcctttaaattgctttggtggaaggggctgttagggcttctaaatcttgctcaattgtcaatcaagacccctcactgcagttaatttgaattgtgtaattggtatgctattagctgcttctcaacttgaggttactgactatactgtgacaaactttgtttataggggcatgcttggattagtaaagcatcaaggaaccgaaaagcagtttggaaattgtgcggtaaacggcc

SEQ ID NO: 7015 - DNA, 364 bp, Glycine max
  misc_feature (358)..(361): n is a, c, g, or t
tggcgtggggagtgtgacaccggtggcggcggccaccaggttgacgaggtcgggggcggcggtgccgaacggggtaggatcggggaatgggacggggaagaagaaacgggggcggccgaggaagtatccattgccgtcgtgagaaggagggggtgttttggattgttgttgtaggtactgttgtgttgtttaattgttgtttttgtagatatgattaactggttattttgtatgatctgtctcttgaatgtgggtatctttttggctctggtttttttgctatgggtttttgattgtatgccttgttgatgaggaggggaagagaaacaatgtggccggttatctatagttgaaagannnnaca

SEQ ID NO: 7016 - DNA, 385 bp, Glycine max
ccccaaagggtcttaagatgtcatccactttcattgggaattcaacatcaattcaggagatgttcaggagagttagtgagcagttcacggcgatgttcaggcgcaaggctttcttgcattggtacactggtgagggaatggacgaaatggagttcacggaggccgagagtaacatgaacgatctggtggcagagtaccagcaatatcaggatgctactgctgatgaggaagagtatgaggatgaagaggaggaggcttaaggcatctgagttgccaaggttgtatcgaattgtaacgtgggtggatggctttcagcgagtttaaaatgtggagcagtaaaaaaacattgacttgttcatgtgtttgctgtatgaattgatgaggg

SEQ ID NO: 7017 - DNA, 401 bp, Glycine max
tcctgatgctgctgaacagggtgaactcagcagattcactctccttcagcttcaacaacttcagtgaagaccaagaggacttgatcctccaaggtgatgccaccactggtgcatcaagtgagaacgataagaatgtgttacaacttaccaagttagacgatagtgggaagccagagttcggtagtgtggggcgagttttgtactttgccccagtgcacctctggaaaagctctcaactagtgtcaacctttgaaaccaccttcacctttaagatctcatcagcatcacctgactctgttccagctgatggtcttgctttcttcattgcttcacctgacactactcctggtgctggtggccaggaccttggtctctttcctcacctcacttctctcaaaaaa

SEQ ID NO: 7018 - DNA, 720 bp, Glycine max
actgaattattggaggagtgttgatggaactgttcgaacatttgacattcgtattggcaggtttcttgcaaacataacttcgagaccatcattttgtaattcatgtttaaaacagtctatcaagtaacgcagtagagtgctgttggacacttttgttgtggccataaaatttgtttgcattgtgaaatatttgctgacgatctattttatattcaccagagaaatatccgataatttagggcaatctgtcaactgtgtatcaatgtcaaatgatggtaactgcattctagccggttgcttagactctacattgcgtcttttggacaggtatgtttattgcatttttggaaaaattactatggtatgggtctttatccctctgcaagtttcatagttctttcttgtgacaggtccacaggtgaactgttacaagaatataaagggcacactaataaggttagtctgcagatgcctgaaactgattttagcacttcctactttttaatgttctgcatatagccttgtttaaagatacaggaccaggtgcaagctcccaaagaatttgggatacaagttgagattcactgtcacttatatatctttatttctggactattatttagcggttcctgcaattgttcattcttaaagcattttcttgtgtgatttaacttttaagtaactttacatgttacaaactttttaaatattcgtcgtctt

SEQ ID NO: 7019 - DNA, 345 bp, Glycine max
gaggcgggaatgggtggtggtggcggcggtttcaacccttttggtggtggggggtatacatatacttttgagggtggcttccctggtggtggatttggagggggctttcctggcggtggcggcggtggatttgagttccatttttgattgagaaagccgcatgcactccccatatatatatatatatatttaattttctgaagggaccacaacaattatatttgactaatcacttgctaacggttgttgagataaatacgtaggccatccccggatgcttgtaagataagaaacgtgctctagagaatttttgctttatgcagaagtgatggggttggatgttag

SEQ ID NO: 7020 - DNA, 1168 bp, Glycine max
ggaggagtccagtcaccaggtcttagtggtattgcttccacctcattaccgcagccacccaattctgtccattccccatctagccaacaatcattgctattagttgtttccaaagatgcaggtatattttgtgttactcttattcagctgtatgatttgttgaagattgttagagatgttataaaagcataaaatcattcttgtgtcttaatagttcatatttttggtaaaattgattcataatacattatttgggcctatctcagtcttgatgttggaattagaaatatataccatgataggtatttttgtgaaagatgagatacatcacagttttttatattctgcagatgttggaaattctaaggttgacgagccacaactacatatttttcctgatgattcggggactgaatctactgctagtactgggattggcaaaaatttcgtgaatgaagatgaattgaaatccacatatgccgtagattctcctgtatgctaactcatgggcttttatattctttaagatacattatcttatatacttgtgcaacttgctgaagcatatattcacacatgcacacacatacctacatgttatgttttctgtgtaaacaactaatagccagtgactcagccatcctagtttgactatatagattaggtgacaaagggaatggaccaaaaaataaaataaaactagcaatcctcaccattgtggcattgtctatccgaagaaggtaggatatgaaaactatataaatatacatatatttcaagtacatggagaccacacatgcagatgcaggtatagccagtttctgattctatctttgtttccttaattccttccatttgtctttataggaaaacaaattagttcgatagcatctgatttgaaacttgaaagctacaagactaactcaatagtaatagttctttaagcagtatgatgggtagggctgaactgaacttgttatgctttgtagacagcaaaaatacttatttatattttgattcatgtttaaacattgtgtggaagaatctattgggcatattgtataaaatatattcatgggttatttacgttgactgttgtcgtttatgctgcagacaggagtacctgcctctcttccagagcctgctcagacttctagagatattgatt

SEQ ID NO: 7021 - DNA, 549 bp, Glycine max
caatcagtgtctgaatggttgaacaatatcacccctacgggacccctgtaatccgcatcgatcacgcccgctcccacatcgatcgagtgcttccatgctaatccagatcgcggtgctgaaaagcaaaacaaaacggggagatttaaagttagcacttggctgggaaagaaagaagggaggggaagagattgcaaattcgaattcccccaagtcattctaacaaactaacatttgcacaaaacacgccaaaaaaaattaaaattagggaaaaaagagagaaaaattggatttgggaagggaaagttagttaccgatgcgagcgtaggttccttcggggatggagattgaaagatcggtggggaccagagccttcccacgagccggcacggtggtcgcggcggcgctggagaggtcgtagccggcggagagaggggaggccctagaaggcaaaacggccttgtcggagagcttcttcactcggaaaaaagtggcggaaacgacgccgtttgtctcggccatttctggagcgagtgggaatgtaaagaaaca

SEQ ID NO: 7022 - DNA, 530 bp, Glycine max
tgagatgtgagtgtcaatcacctcattagtaattagtagaaggtcgtgctagaggtaaacataagaaatgaatttaattattaagttcaaaaacttagtcaactataagcatgtatcatttcatctttttcattttaagatctaaagtcttattttcccagaaaagcttacttctttaattttttcagccaccaaggtttagcttttacgatgcagcaaaaccaatgtatacatcaaggagaaacttaccaccatcaaagattgacaatagcaaggtcagttcttcaaacttgctcctgtgagaaattttttaagtatttcacactagaagtaccaaagccttattgctttgggaagtgtgaacttacctcttttctactttcaaatctcaaactacaacattgttacttgtccttctttatgcagattgttgattcaatcatatctcatggaagcttcttgaataattccttcatagagcatagcgttgttggaatcagatccagaataaactcaaatgttcatttaaa

SEQ ID NO: 7023 - DNA, 355 bp, Glycine max
aaaccgagatgagaacatgaaacactatggacaacccactcctccagcatatgacatgaaaagacttccaaatgaccttcctctcttcctgagttatggaggggctgatgctctttctgatgttaaggatgtgcaacgtctgttagaaatcctcaaagatcacgatgcagataagcttgtagtgcagtacagaaatgattatgcacatgcagattatgttatgggtgaaaatgctcaccgagatgtatatgaacctcttatatctttctttaggcttcagtgatatctagtgaagaatactccttatagaatattgccattacctgtctctaaatcatagaattgaatagcacgg

SEQ ID NO: 7024 - DNA, 377 bp, Glycine max
tgtgaatgagagatgtgtattgctagcagtttgactgcacagttgaattagtatgctactaaggggattctgctggatgtcaaatgatgtttaagatttgatatacagtaaaaagaaattggagactatggaagaaatacagtctcaatcagataattatagatcttcgtcatcgtcggcaagcagcccggcaagtagggtgccatcaagtaactttttctacctgcgtaaacctggttcacttaggcagcccatctcttttgaggattcacctgagtgggaggatactgatattgatgttagagttgaggaaggaggtgactctattaatgtcgcaacaacaccagcttctccctctctttcaaagctcaacagtg

SEQ ID NO: 7025 - DNA, 358 bp, Glycine max
tgactcaggcatgcttctcctcaagggagatgtaaatgtaaatgaaataacatccttgctttctttcatgttaaatgcatcctgatcaaaacttccatcagtcgtaaaattgcatttaatggacttacttccaaaattatttacttcatcaggacctcttgcctcatgaacatctctgctaatctttttcttctgggaaatactcactgctttggatcttggaaactgcttttggttgtcagttgccctactgcttgaccttttaggttgaatatttgcagttttagcacccttgttcattgtcttccttattccagaagtttctggagatgaagctcgtgttgttggcttattatta

SEQ ID NO: 7026 - DNA, 1075 bp, Glycine max
  misc_feature (1067)..(1067): n is a, c, g, or t
aagatgcatgaactttgcattctgtaaatgtgggtttggttagatcaattatttaggagtggaagatgagtttcttttcatgttgcacgtcacaagagaagatcgacaagaactcattgaaaaagagcagtaagaactaccatcacgcaaaagctctgccgtcgttagccaacatgtgttttaaatctggtatttttcctagctccaatgctaattttctcattgtatcgattttcaggccaacattttttcaatttaatgtctcatatctagagtttaatgttgtttccacgacaaattattttcctctagcacaatcttatttatctcaacatgaaatccatgaaaggtttataccatcacaataggcttcatcaactttttcattattatgaagcctcaacgatgtgaaatgcagaagtacatgcatatcttgtgcatctctttaggctccctttctagtttaatgattagatgttcttagcttgttggtaacatgttttgaaacaatttgtgccatcaagttctcacagattatgtactattgaggtcttatcatttgacaaagggattcaaactcacatccttgtgagatatgagtcttatccttaccaattagggtaccataaacctaaggatctcttactctctacctcaatagttgtgttgtcaacctctagagttttgactttttacaatagattgctaagctaaaggtggaaagtggtcttatagtgccctatatagtggatttcagctttctcagacatttttttctcaatgatgaataccaatgcttaaaacttgaacaaatttatcttgtagataccagcaaacggaagtacatagaagaagaaatagcaaaaattgggaaagggaatattacctctcagactttttcttatcacgagctatgtgttgcaactcggaactttcaccctgacaatatgattggcgaaggaggctttggaagggtgtacaaaggacgcctcaaaagcataaatcaggtataatttcaactcgcatctatgtgaatattatgctaatatcatgctaagaaaaaactnctaaatgc

SEQ ID NO: 7027 - DNA, 360 bp, Glycine max
caggttggatgccatagtctttcctttttgtcgttctttcaacttttttgtctagacagggtttgatgtcaatgcccttcaaaacacaagcaaaccccatcttgataaatttcatgtaaagggaaagaaattgtcgaagttcacttgatatgctcttcctttttgtatcaattagtgggggttagtggaacgtgatggaagcgcttttatagtggggcttggttttttgtagtgggcagtgggaccttctaaaaggttagggtggtgtgtatattttattagtgatgtaactcttagggaatttgaattgcagagctgaaatggataatgattgctttaacaatgctgggtgttgctagt

SEQ ID NO: 7028 - DNA, 492 bp, Glycine max
attatccttgccaccattaccggtcttttcgaagcgttactctccatcatcatcttcacctatccccaaagccactccctctcacttattgtcactgttgggttccaaaactcagtcctcagccgtgaatcccgtggtagcacgcggcctcaaatcatgcttcaaattcctcgttcctttctctccagtgcagcctcgtcaccggaaattgggtttgggcctgcccaaactcactgtcccaagtcagagagaggagaacgagcttatttggtggccgccagagcccgttttggagctggcgcgtctcgccgtcgattctggcggcgaccccgccgctattcatcgccttcttgacccaaccattatcccggtcagtttttttttctctttttttctttagttagttatcattaccaatgcgttcagtgttaattgaacgcgtggggttgtgaattgtgatagcataggtacctgattgtgaaggatcaaagg

SEQ ID NO: 7029 - DNA, 519 bp, Glycine max
tttatcttagcagatttctgttactattatgtcaaaaggttagttgagtgcattatagcaactctttcctgttttgaaccttctttcgtgggctgataatgtctcaagaacttttcagcatgattctgttccttatgatatttattttattgcagtgttttcggcggacagcttgttctccgcctaccttctggagtggtgtaatagaagattcacttcactacatacttgcatttaaattaacttaatcaagcaatatggtcggttatcattgttggagtccatattgcattgaaaaagtatggttccttggaagaatctggttctttgtaaagttagagatgaagggaaaacaagatatttatgttgaaggtacagtatttgtagctggaaatgctttacacataacatgtctatttgcttaggctcttgaaattcagttcttgacataacttttccatgttatcgtattttaactgcttgacttgagccaatgagggagtcgtcataaagttgctt

SEQ ID NO: 7030 - DNA, 392 bp, Glycine max
gtctcatggcgacgaacctcatctcttcggtgatgccggtggtctctccgggatatagcttccggtacctctttcgcttcttcaacgtcgacttagggttcggctttggcttaggagtttgagagagagtagtagtaatttcggcgttggtgttggtgttggttgttgctgttatggataagctgcaattgcagaacttgtttgggactgagattgggagtgggaagcatagttgtcgaatgggtttcgctgttaaccacatcgctccttcctttctttttcttccctgctgattgattgatggataccgttttcagtgctctgcacttctatgctgcgtgtgtaatcaaatttcatttcttaaccaagaaatcctagtgtccatgccaaca

SEQ ID NO: 7031 - DNA, 349 bp, Glycine max
ctcgtcaacacaacacaagtcacccagaacaaaattccttatgtgatggacaccacaatgagggacactgctggggtaatcaagaaatttgagctcaagatgattggaacaaggttgcagaagacaaggcaataatgacatacctcaaatctctcattccttttctcttgaacaggaaatgggctttcctataaagaaatatataatttaacttgtggcaggataaaaaaaatctctgagagtttttatataatatctgtattatatataattttttttatttatctggtacagatgggggtatatgatcttgtttcatatttaataaattttttttgggggggtgggg

SEQ ID NO: 7032 - DNA, 407 bp, Glycine max
tttttgttaaactgtgcttcttagaagctcgctgaggtttttattttcaggggaaaatgtttctgagagatgaattcacttggtcatgtttggatataatcatataaaaaattgttcacttttaagaagagagagacacaattttcacatgagatgttcatgtgaaaatttatcataagaagcttctataccttttgtgtttgtgttatgtaaattttcactaaaacgtgttttctttttctacttgttctgcagctgcaagatgtacccagacttgagctacactgagtcaaccaccaccgagaccttggtcatgggagtggcacctgttaaggctcaatttgagggtgctgaaatgggtgtgcccgctgagaacgatggctgcaaatgtggaccaaactgctcct

SEQ ID NO: 7033 - DNA, 700 bp, Glycine max
ttttcaggatccttagtgttaataatgctaatttcttatgtagatggtatttatatttatctaagttatgggaattaggctgttaaagagttaaacattaagacaaaaaactggaaggagctcctcactgatgagccattcactaaggatgaccttataaccattcaagtaagttggatttgaacaagaacattttttccattccttcatctttcattggcttaatatctatcaagtgttggtgtttgtctgtgttctatgtgcagaatcctaatgcacttgacagcaaggttcttctggattttgatcatgttaaaaatagtttgaaagttgatgatgaaggtatgctagctcattcatcttttgacagctataaatctcatattggtcttgaatcttgatgttgctgcttttgttgttgttcttaatattaactatgacacattcagttttttctcccttcagaactacagaaaatgagttcagatccaacctataatataaacatgtcgggtgatataaagcaaatgcttaaggagcttggaactgagaaagggaaggaaactgcattgcatgggggaggcggtggcaaggcacaaaaagaaagggctgctgcacttgctgccatcttagctgcaaggtcacgtgttgaagaagattccaaatcaaatccaaataaagaggccaaagctcctcaggc

SEQ ID NO: 7034 - DNA, 382 bp, Glycine max
tttttgtagcagaatctacctcatctccggaagacgatactgggacagctgcagaaccagaaattgatgtaactggtaaagaacaactggtggtaattatttcagtttgatctttggatcccttcggaacctcacttggtaccatagttggtgattctgtttctgcagatatcaaaccctttgcaaccaatgagcttaaaaggtttgaaattggatttagtttattatttttggcagtatttaaggtcggagctgaggaactgctaatgttagaggaagcgggtggttgagtagaaagcctttgtggtggttgtccagcctttccttgagtgttttttggcagtgtagatgagtcattatgcagaggatctaatgtggtagg

SEQ ID NO: 7035 - DNA, 785 bp, Glycine max
  misc_feature (314)..(314): n is a, c, g, or t
  misc_feature (347)..(354): n is a, c, g, or t
  misc_feature (363)..(364): n is a, c, g, or t
  misc_feature (379)..(380): n is a, c, g, or t
  misc_feature (382)..(384): n is a, c, g, or t
  misc_feature (388)..(390): n is a, c, g, or t
  misc_feature (410)..(410): n is a, c, g, or t
  misc_feature (422)..(428): n is a, c, g, or t
  misc_feature (457)..(461): n is a, c, g, or t
  misc_feature (463)..(474): n is a, c, g, or t
  misc_feature (478)..(485): n is a, c, g, or t
  misc_feature (487)..(491): n is a, c, g, or t
  misc_feature (494)..(496): n is a, c, g, or t
  misc_feature (498)..(509): n is a, c, g, or t
  misc_feature (514)..(519): n is a, c, g, or t
  misc_feature (522)..(523): n is a, c, g, or t
  misc_feature (540)..(540): n is a, c, g, or t
  misc_feature (551)..(557): n is a, c, g, or t
  misc_feature (564)..(574): n is a, c, g, or t
  misc_feature (595)..(603): n is a, c, g, or t
  misc_feature (606)..(613): n is a, c, g, or t
  misc_feature (617)..(618): n is a, c, g, or t
  misc_feature (620)..(622): n is a, c, g, or t
  misc_feature (624)..(625): n is a, c, g, or t
  misc_feature (631)..(631): n is a, c, g, or t
  misc_feature (637)..(646): n is a, c, g, or t
  misc_feature (653)..(656): n is a, c, g, or t
  misc_feature (661)..(663): n is a, c, g, or t
  misc_feature (668)..(669): n is a, c, g, or t
  misc_feature (671)..(671): n is a, c, g, or t
  misc_feature (673)..(675): n is a, c, g, or t
  misc_feature (683)..(683): n is a, c, g, or t
  misc_feature (686)..(687): n is a, c, g, or t
  misc_feature (691)..(704): n is a, c, g, or t
  misc_feature (711)..(716): n is a, c, g, or t
  misc_feature (718)..(718): n is a, c, g, or t
  misc_feature (720)..(720): n is a, c, g, or t
  misc_feature (726)..(727): n is a, c, g, or t
  misc_feature (731)..(738): n is a, c, g, or t
  misc_feature (742)..(744): n is a, c, g, or t
  misc_feature (746)..(749): n is a, c, g, or t
  misc_feature (752)..(753): n is a, c, g, or t
  misc_feature (757)..(760): n is a, c, g, or t
  misc_feature (765)..(767): n is a, c, g, or t
  misc_feature (773)..(775): n is a, c, g, or t
  misc_feature (777)..(781): n is a, c, g, or t
ttctataacaattacaaggtaaaatgtttatctatcactggacgggattgatgccatctaatgttaaaagcaccttatatagatctggacgcctatcacggaataccccccaacaatgtctcatggatttgatcttgtccaaatcaaattgtgcaataagaacagcttcctctttatcgtcagcagttgaaatgatttctccagtaggtcctgcatgttgatagagaagacaaaaatagaaacacaactcatgcttgcagctaatatctttccaagtgtatatcaacaaatgaagagaaaaattcattaaaatnatataaaaaagaaatggaaggggaaaatgctannnnnnnngaaaaagannggttaaaggttgatnngnnnatcnnnggaatatggaaaaattattncttctttttttnnnnnnnagctttttccccttaccatttcccgcccnnnnnannnnnnnnnnnntccnnnnnnnnannnnnaannncnnnnnnnnnnnntattnnnnnnttnnttttatttttttttttntttacgtttgnnnnnnnctacctnnnnnnnnnnnattccctatattatataaccnnnnnnnnntcnnnnnnnntttnntnnntnnctcccncccccnnnnnnnnnnttttttnnnnccctnnnttttnntntnnnctttttcnccnnttcnnnnnnnnnnnnnnttttttnnnnnncnanaccccnncccnnnnnnnncaannntnnnnatnnttannnntttannnttttannntnnnnntccc

SEQ ID NO: 7036 - DNA, 467 bp, Glycine max
actgaatttaaataatgtatactactacaataacccatattcgtctccactgcagcggacactggcaaatggtcgtcattctgcctaaggaaaacctagttgtctggttttgttctttgcataacaggccagacaactaccttaagggaataattaacaggtcagtgttgttttcaatacatttgcattaacataactcaacaacatcaatattttaatgttcctcatattcaacactggttttaaaagacttgatgatgatcccccacctaaaacctagggtggtgctaggaggattgttgttaaggaacgacatttaaaaaaaaattcttcttattatatatattttaggggggggaccccaattggtaattaacgtttaataaaaatccaaatttctttaggaattaagggaaaaaaacaaaagggagccactgaatgtggttactacgtgtggccctggatgt

SEQ ID NO: 7037 - DNA, 631 bp, Glycine max
  misc_feature (222)..(222): n is a, c, g, or t
  misc_feature (228)..(228): n is a, c, g, or t
  misc_feature (248)..(248): n is a, c, g, or t
  misc_feature (270)..(270): n is a, c, g, or t
  misc_feature (273)..(273): n is a, c, g, or t
  misc_feature (275)..(275): n is a, c, g, or t
  misc_feature (324)..(324): n is a, c, g, or t
  misc_feature (330)..(330): n is a, c, g, or t
  misc_feature (344)..(344): n is a, c, g, or t
  misc_feature (361)..(361): n is a, c, g, or t
  misc_feature (415)..(415): n is a, c, g, or t
  misc_feature (417)..(417): n is a, c, g, or t
  misc_feature (439)..(439): n is a, c, g, or t
  misc_feature (530)..(530): n is a, c, g, or t
  misc_feature (533)..(533): n is a, c, g, or t
  misc_feature (538)..(538): n is a, c, g, or t
  misc_feature (571)..(571): n is a, c, g, or t
  misc_feature (574)..(574): n is a, c, g, or t
  misc_feature (576)..(582): n is a, c, g, or t
taagaagagaattcagcacttaatcaacatgacgatgaaattgaagtggacattgatacctgtggatgctgagactctctgggagcttgatagatttgttaccaactataagaaaagtttgagcaaaaacaaaaggaaggctgaacttgctcaagctagagcagaagctttgcagcagaatgccatccagaaggtaaagaataaattttttacatttaattnccatgnttagttgcttactttggggnacaattattgctaaatactttnttntntttatcttttgcagagtcaggcaccagctatggcagagattccaaaagnaacacnaacaggtgaacttntaagaatcagtattggngtttttggattgtttatctcaattatttatttaaatgaaatatttcatctgccngnatgtgtacagatgaaaggagtnttccccaacccttgcctgtgcaagggagaaatcaagcggataatgggagtaggtcaagcagttccagtagctccagcagtgattctggttnttnttcanagtggtacattgatcaatgatttagaatctatnttntnnnnnnnttgttcatatacgtgcttttgctgattgggaagtcaaatgtcctgtctt

SEQ ID NO: 7038 - DNA, 600 bp, Glycine max
cacacaaccaggtggctggcagatgaatcagaacattcctcttgttcctcccaacttttcttgtttttccaattccaattccaattccaattccaatgtcctccaaaacgccttcaataagaatgttgttcagccttcagcctcatatcctcaatgcttggctattgagtttgatcaacagagggagattgatcaccatatcagatcacatgttagtataccaattcttttcaaaccgcattttccgccgtggtcaaacacaaagtgaccgcttcggttgcatttgtctgcactttcgacaaattccactgttaattgctattttaaatcttcaatatttgttattaaaaaactgagcacttttttagttggtgtctattttaatctaattagtgtttccgcagaacgaaaaattgaggattttgttgcaagagcaaaggaaacagcatgtggcagagttattgaagaaggtggaatcgaatgctcttcatttgttgagacagaaagatgaagaaatagcgcaggcaacaaagaaaagcaccgagttgaaagaatttatgacaaggttggaggtggagaaccaatcatggcgtaaggtag

SEQ ID NO: 7039 - DNA, 722 bp, Glycine max
  misc_feature (602)..(604): n is a, c, g, or t
  misc_feature (614)..(616): n is a, c, g, or t
  misc_feature (618)..(618): n is a, c, g, or t
  misc_feature (633)..(635): n is a, c, g, or t
  misc_feature (643)..(644): n is a, c, g, or t
  misc_feature (660)..(662): n is a, c, g, or t
  misc_feature (670)..(672): n is a, c, g, or t
  misc_feature (678)..(679): n is a, c, g, or t
  misc_feature (682)..(687): n is a, c, g, or t
  misc_feature (696)..(699): n is a, c, g, or t
  misc_feature (701)..(703): n is a, c, g, or t
  misc_feature (706)..(708): n is a, c, g, or t
  misc_feature (710)..(711): n is a, c, g, or t
  misc_feature (715)..(715): n is a, c, g, or t
cttcctgatgaattgtaggggcgaagccggaggtatttttctatctcctggatgtctaaattcatgtgttgtgtttgtaattgaatggcagaattttgcagggaacccggttttgagttttgacacgaaaattgctaagtcttctctggtttctaatttgtacaatgctgcctccgtctattgtttaaatttttcactgtttataggtcattggagctgatatcacaagggcatacctcagtaatgtatgtgttgctaaagaactgcacagaaatgggttggcttatgcacttcttgaaaagtcaaagttagttgcttatgattggggtaagaaacaaaatagcacttaactactacgtgcatgttgctatagtttccactacctttataaaaaggtctattgaagttcatgtatgactcttaattagatgaagattgctaacaacatattctttaatacactacttttaacacactgtctactattatttaaaatttataagaaactacaaaattatgagaaagattcattaaataagactcatttttgtgatttgcccataaatttcaaaaagagtgagtgtgttgcatttccttgattnnntataggcacnnncnagtaggcaacccctnnntctaaatnntaatctttgttttgannntcttaaannngattcnngannnnnntactcttgnnnngnnnttnnnanncatntcaattt

SEQ ID NO: 7040 - DNA, 3055 bp, Glycine max
ccaactccttcaaacttattaacactttccttagttcaatatggggaagcccttcttcactctctctctttcttccctttgcttgctactcttgtcgagtgcatgctttgctattacctccagcaagttcaacgagtgccaactcaacaacctcaacgcgttggaacccgaccaccgcgttgagtccgaaggtggtcttattgaaacatggaactctcaacaccctgagctgcaatgcgccggtgtcactgtttccaaacgcaccctcaaccgcaacggcctccacttgccatcttactcaccttatccccaaatgatcattgtcgttcaaggtgcgtaatattagtaagaagtatttatcaccttaacgtgataacaataatagtaatatgaaatatttattaaattttttataattaatctctgctagaaaatttgattaatcatttttagtagaatttgtttttctcaactaggttttaaacaccacattatggcatagtatcatctaataaaactaataataataataataataataatactatatatctatatgtctaatcacaatttgatgactaactatcttacaagttatatgaatgaactcataacaattatgatgactaaagagtgttaattagttgataattaatgtgattgttttgcttgatgatgattgatgcacagggaagggagcaattggatttgcatttccgggatgtcctgagacgtttgagaagccacaacaacaatcaagcagaagaggctcaaggtcgcagcagcaactacaagacagtcaccagaagattcgtcacttcaatgaaggagacgtactagtgattcctcctggtgttccttactggacctataacactggcgatgaaccagttgttgccatcagtcttcttgacacctccaacttcaacaatcagcttgatcaaaaccccagagtacgtaattataatgagcagtgatacacatgtcactgcatagtatcatacacacttaaaaagacacctaacaaaatattttttattattattttcttttattaaatatactaagtaataaaataattaatatactttatatcacatcatttggatgttatgttttattatttatgaaaaatgtttgaagaacactatcttatatctagagggagaaatgaaaaagaaaaaaatacatataaataggatagaatttataatgtgataagaaaagagaaataagttatattaatggagtgtttaaaatagttggatatatacttgtatcatgattggatatcaattgaacttcatttactattaactattattttattattaaaaaaaacatgttctcctcacatgttaatttttttaattactttcaaggtattttaccttgctgggaacccagatatagagcacccagagaccatgcaacaacagcagcagcagaagagtcatggtggacgcaagcaggggcaacaccagcagcaggaggaagaaggtggcagtgtgctcagtggcttcagcaaacatttcttagcacaatccttcaacaccaacgaggacacagctgagaaacttcggtctccagatgacgaaaggaagcagatcgtgacagtggagggaggcctcagcgttatcagccccaagtggcaagaacaagaagacgaagacgaagatgaagacgaagaatatgaacaaactccctcttatcctccacgacgaccaagccatggaaagcatgaagatgacgaggacgaggacgaagaagaagatcaacctcgtcctgatcaccctccacagcgaccaagcaggcccgaacaacaagaaccacgtggaagaggatgtcagactagaaatggggttgaggaaaatatttgcaccatgaagcttcacgagaacattgctcgcccttcacgtgctgacttctacaacccaaaagctggtcgcattagcaccctcaacagtctcaccctcccagccctccgccaattcggactcagtgcccaatatgttgtcctctacagggtatgtaattcacttcattcatattacaagtaatcaacatgaaactaatatacgtgcatacttgcacatctaccatagtagtgtttttgtggattttcagtgttaattagtgtatcttcagagaaagaaataaaagaaagcactaaaagagggggaaaatcataattcataggtcatatacgatacaataagaagacataaaaatgttaacaagtatgttgtagggttgggttccttttaatgtcatttaaattaaatctcactttgatagataactgatttttagaggttatgtagaggtaattttatagttataatggagtaaaattgtttgtattctaaatttgtgcattgattttttaaagtgagtttcgacatataatttaaaatatatcattacctcttatttgataataattaaacatttatcatttatataataataataataatatgtaacatgtattattatatccatgcatgcagaatggaatttactctccacattggaacttgaacgcgaacagtgtgatctatgtgactcgagggaaggaagagttagagtggtgaactgccaagggaatgcagtgttcgacggtgagctaaggaggggacaattgctagtggtgccgcagaactttgtggtggctgagcaagggggagaacaaggattggaatacgtagtgttcaagacacaccacaacgccgtgagcagctacattaaggatgtgtttagggcaatcccttcggaggttctttccaattcttacaaccttggccagagtcaagtgcgtcagctcaagtatcaaggaaactccggccctttggtcaacccataaataacaacaagcatatatgaaggtgtggtgaggccatcttatatgaaataatatcaaaatatattttgtgtaataataaaactatggcctatgtatttaccaccctccgacccagcctatgttaatatctgagtggcgttgtacctttgaatcgccttaataaaatgtcagtcttaaaaaaaaaaaaaa

SEQ ID NO: 7041 - DNA, 1011 bp, Glycine max
gtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaaaaatgaagagcaccatcttctttgctctctttctcttttgtgccttcaccacctcatacctaccttcagccatcgctgatttcgtgctcgataatgaaggtaaccctcttgaaaatggtggcacatattatatcttgtcagacataacagcatttggtggaataagagcagccccaacgggaaatgaaagatgccctctcactgtggtgcaatctcgcaatgagctcgacaaagggattggaacaatcatctcgtccccatatcgaatccgttttatcgccgaaggccatcctttgagccttaagttcgattcatttgcagttataatgctgtgtgttggaattcctaccgagtggtctgttgtggaggatctaccagaaggacctgctgttaaaattggtgagaacaaagatgcaatggatggttggtttagacttgagagagtttctgatgatgaattcaataactataagcttgtgttctgtccacagcaagctgaggatgacaaatgtggggatattgggattagtattgatcatgatgatggaaccaggcgtttggtggtgtctaagaacaaaccgttagtggttcagtttcaaaaacttgataaagaatcactggccaagaaaaatcatggcctttctcgcagtgagtgagacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatca

SEQ ID NO: 7042 - DNA, 496 bp, Glycine max
  misc_feature (299)..(301): n is a, c, g, or t
  misc_feature (320)..(320): n is a, c, g, or t
  misc_feature (339)..(339): n is a, c, g, or t
accttgttttaactgaagttgaactgcctttaatgtctgggttcctcttgttatccactatcatggagcatgatgcatccaagaacatccctgttataagtatgtcactcttctcgcattttcactatcttgctaatctaatgccaccactaagcctaatggtttttcttgtcatccagtgatgtcttcacacgactctgtaagcatggttttcaaatgcatgctaaagggtgcagcagatttccttgttaagccgctaagaaagaacgaattaaggaacttgtggcagcacgtttggnnnaaacaactggtaagatganatatttgcatcttttcggnacagctgcatttctttccatgctttatccatttatacttagatttggtacctgtgacgagacataagttttcgctaaatttgtcttatcttgtctgcaggcaaacggtgggcccgatgtgcagcacatacaagaagagaatctcgcagaaagaatgg

SEQ ID NO: 7043 - DNA, 1011 bp, Glycine max
  misc_feature (627)..(628): n is a, c, g, or t
gtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaaaaatgaagagcaccatcttctttgctctctttctcttttgtgccttcaccacctcatacctaccttcagccatcgctgatttcgtgctcgataatgaaggtaaccctcttgaaaatggtggcacatattatatcttgtcagacataacagcatttggtggaataagagcagccccaacgggaaatgaaagatgccctctcactgtggtgcaatctcgcaatgagctcgacaaagggattggaacaatcatctcgtccccatatcgaatccgttttatcgccgaaggccatcctttgagccttaagttcgattcatttgcagttataatgctgtgtgttggaattcctaccgagtggtctgttgtggaggatctaccagaaggacctgctgttaaaattggtgagaacaaagatgcaatggatggttggtttagacttgagagnntttctgatgatgaattcaataactataagcttgtgttctgtccacagcaagctgaggatgacaaatgtggggatattgggattagtattgatcatgatgatggaaccaggcgtttggtggtgtctaagaacaaaccgttagtggttcagtttcaaaaacttgataaagaatcactggccaagaaaaatcatggcctttctcgcagtgagtgagacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatca

SEQ ID NO: 7044 - DNA, 86 bp, Glycine max
gaagagttctgttgtgccaccgtctttacgctcacgagtttgcctttttcatcgttttctcaccatgaactagttactactaaact

SEQ ID NO: 7045 - DNA, 383 bp, Glycine max
attccggcccttcccaaagaggaggctgcactgaaactgatcaaaggggggtcatagaatcttttggcaaaatgcaaaagtgctagcatgatttcgttttcttcccctaatgtttaaattttccgttggatttgcttgctataagtttaggagggaacttttgttttttctcctatgcactgttttcaggttttgccaaataacgctttctttcaaattttgagattagcgattgaatgaaaatttgaatcataagctcggcccatagttgcaacttaaacagctgaaattgtcttctgtctaactgttcaatttaagtttgcagcaaactgtttttgcaaccaatcatttgaagaagaaaatagaggagctaaagcccaacc

SEQ ID NO: 7046 - DNA, 424 bp, Glycine max
tgtttgaagatgaattagagaaggcaagcaatgcacttcttgctcgggcatggtcacctgggtggagcaatgctaacaaggcattgacaaccttcataaatggtccactgattgagtactcaaaaaaccgcaggaaagcagacagtgcaactacctcacttctgtccccccatttgcactttggtgagttgagtgttaagaaggtcttccatcttgtccgcatcaaacaagttttgtgggccaacgaaggaaacaaagccggcgaagagagcgtgaacttgttcctcaaatctataggtcttagagaatattcaaggtacattagtttcaaccacccctacagtcatgaaaggcctcttctaggccaccttaagttctttccttgggttgtaaacgaaggctactttaaggcttggagacaagg

SEQ ID NO: 7047 - DNA, 440 bp, Glycine max
  misc_feature (390)..(393): n is a, c, g, or t
  misc_feature (401)..(403): n is a, c, g, or t
  misc_feature (431)..(431): n is a, c, g, or t
  misc_feature (434)..(434): n is a, c, g, or t
aagcattctggctaatcttgcatttttctgcatagggttgtgagcagccacttattgtccggtttgctgatcctaaaaggcctcgccaaggagattccaggtttgtcatagctaatttataatccttaagcataaaagttccttctacagctaattaattaaataaagcatggagccatggactgtttaaacctgagccacaaattggcttatgaatatgaaatcaagcctaggcaagaagcattttttttagttggcagtttgtatttatacaatagttctggtatgtttgctttcttcagtctggttagcccacattttcaaagggaactgttcaaatggaagaggtctaaaacaaggctagtatttgctgtataagttgtcaaaagnnnnttttcttnnntcctggtcttttactccaacaagttgtntantcattg

SEQ ID NO: 7048 - DNA, 853 bp, Glycine max
ttgatcatatttggcgtggagttattgcaaaagggggaactcctgtttgccgtgctagatgtgtaccaattgggaaaggaattgggactgagctgtgagtatagttttatctgtctttaatctaaattgaaatttgcaaatgtgaaagaggaagaagaaagtaggaagattcctttaaatctatttctttctgttgacttcttttgcatttagttctttctcattgctagcaaggtccacatgtagcatgttctctttcttctgtgtgttgtttcttttctgcaagtaataattaggttttatgaatttctctggtttgtgctgcatgctagcttttcttgaatgtctttgttcttttactgcatcatcaggaagaatggtgtgtttatttttcttatatttcatttctgagaaaaaccattctgaaattttatgcttttttaattatatttttggtaaagatgctaactgactcactcatttttatcttaagcacaaagaaatgggctcttaatttttgtacactttttccttgaaagttctagtttcttgtcccaacggttgaaatgtatacctgtcttcacggtactgttttaatgttttaattgaagtttgttttgttcttttgctgcagtcctgatgttgttgattgctcagctaggacgggattggatatactcacaaaacattatgctgatgcaattggttttgatattgttttctttctgcctgatagtgaagacgattttgcttcatataccgagttccttcgctatcttagtgcgaaaaatcgtgctggtgttgccaaatttgttgataacaccaccttattcttggtgcctccttctgattt

SEQ ID NO: 7049 - DNA, 377 bp, Glycine max
tttgcaatatgtttacgaagctctcatacaggaaatgatgattatgtattagagttttttctgcctcctagaataacacacattcatgaacaaaagactttgttgggatccatattggcaataatgaaacagcatttccagagtcttcatattgcttctggtgtagaacctgaggatggttcaattgaaattattgaagcaacaatcgaaagagttcatacgaggcttgaatctattcctattgcttcatctattaaatcaccacctagacctgatacctcaccaaacatgggggaggaagtgccacaggatccatcggaacaacaaatattgatgtactgtaatgacatcaataatggagggagtcttggtgaaaa

SEQ ID NO: 7050 - DNA, 657 bp, Glycine max
  misc_feature (645)..(647): n is a, c, g, or t
gatgatcaacaacaatattctagtcaagaccacactgctctccaacttgtgtaagcattcatattcatcatcttatactattaattaagaattaatccttatattagaacctgtgggtggatggctttttcattttttatgagcccattgtatatatgggtattattgaagacaaaaacaagaggctcaatgagagtgtacattgtttgttctctttttttttctattataaaatggtcagtttaagtttattactggtttataatttatactacagttcatggctttacttatcaaaattaataaacattttgatatgcttctaacttcccatttttatttttatttttatatttgaatgcagctgatgatatgctggaaattagagctactggaagttctgccacagtcattatatatatatatatatcggttgatgtagctctagctatttgaatagttacgtgtagcacctatatagtgcagagcaaataatgccacacatgcatgcctgcgtttcctgaatcagtttgtgcctttagaattgacgttaatttgctaaaggtcattattagactgcgaacttataaatgatccattttggactcatatttcatacgatatatataatgttaatgtatcttnnntaagagctag

SEQ ID NO: 7051 - DNA, 739 bp, Glycine max
cgttaggttgattgacacagcaacagtgcctattttggccgttgatgttgatgggctggtcaatgggtggaacataaaaattgctgagttgacgggtcttccaattggtgaagctactggaaagcatttactcacacttgttgaggattcttcaactgatagagtcaagaagatgcttaacttagcactgctaggtatgtctttttttctttctctatcttatccttctatactcttttcttttcttttgttttttcaagccttatcattcataagcaaaagcttaaaaaatgagttagtatgtgcctgtgtctatctagctgtgagcaactgagcatattatgttccctaaagccacacatgaacattgcattggtgaagaattctgagaagaaaaggatgtcttgttgacagtttcattcaattttgtgcccttacaataacttgggaaggaatggaacaccctaggagttgtgatgtcatttttattttgggggcttggtgggaggaattgatgcaatttatctgacacagtgggcttgtattcttctaacctgctttccatatttcttaattgttgttttgttctgttaattaggtgaagaagagaagaatgtccaatttgagatcaaaacacatgggtctaagatggattctggtcctattagtttggtagtaaatgcttgcgcgagcagggatcttcgagataatgttgtcggggtttgttttgtggcccatg

SEQ ID NO: 7052 - DNA, 941 bp, Glycine max
  misc_feature (752)..(752): n is a, c, g, or t
  misc_feature (756)..(756): n is a, c, g, or t
  misc_feature (852)..(852): n is a, c, g, or t
gggatggccagagcaaatcctccagggtttgggcttcctggacaaggacatcccatgccaatgccgcgagctcctatgtttcctttttcaggaggacaaatgccaaatgttgacccacaagttaagcaaagcactggtggccgtgactcaactagtcagatgcctacccaggtatgttaactgacatatttcttgactttttatataaatgtatctcagtagcagcatataggttcagccctgacatgttatatatgtagttgcaaatattgttaaattattcaaaatattctgcttcgtcttattcactcgttgccctcgacagagttaaaaagtgaaaagtccattgttctctatttctgcctttgtgcattgtgttttactagtcattctaggtcacccaaaatcacgattctcaactactaaactattctagttatttaattgatattactcctagaaggtgtaccagtggtcaactttgataagtatagattttatggtttgattgaacattttcaattttagaaactgaaaggaacatgtaagaacataagataaaagttgaaatcaaaagtgattatgtgatcttttggcactagtattggtgcatgctggtccccacgatcaattttcatttcatattaatgagaacattttgtttccattccgctagtcataatcttgatgtatgtgttctccatttttttgttatgttagtgtgaagcagcagctgttggatttgagcaatntacnttggctcataataacggtcatgcaaccaaggctaatgacaatggatctgttaatcctggacctggcagataacattttgtgattggtaaatcttcngactatgtatctctaagcgcatgtatgtgcacaaagcctcataagactaattgttgagttctacttgcaggttacgatcgataaaaccg

SEQ ID NO: 7053 - DNA, 390 bp, Glycine max
atattctccgaccgatcagaccgtaactctatgcatacatattaatcatgccacaaactcatatacaaattacacaaattaatgtccccatcatttagacacagacacccaccccccacggccacaaatacaaaatcaaaccaacattacatgtagatataaaaatcagaagaaaaaattaagaaagaaaattgctctcccaagaattaaattttgtagggttgacacaaatcgagtgagacacatcatgaaggttatacataccctgcccaatttgggccatgcatagttttttccacaaatccttattacatatccctaacttcgaagtagttcttgttcttgacaactatgtcatacatgtgcatggacctgaacttgttgaaatcc

SEQ ID NO: 7054 - DNA, 1050 bp, Glycine max
tctgcacagcagctgttgtgtgtaagttgttttgaatgtctcaaaagcaatcaccctgcattaagtttcaagtagaagaaaattatagcctttctctcattttcctctcattttttttattttcttttctgtctattttaatgttggttcagtcatcatgtttctatggttagagatcatttatatgtgaaagttgtatttcttgaattaaaatttcttattttcaggtatataacatactctaaagaatctgaagcagttcaatgtattcaatcagtgcattgttttgtattagaaggtagacccttgaggtaaggatattcaattttgattgggttttggtgaggtcttattggccacaggatgatgggtggtctttgcatttgcagggcttgttttggaaccacaaagtattgccatgcatggttgagaaatgtggtaaaatataatagatttaagctgagtttatgaatgttttgttacacatatgtctttgtgctactatataagatatcttgctgattcagccttgcagcaatagagattgtttatatctacatgatcatggttctcacgaggatagctttaccaaagatgaactagttttagcatttgctaggtatgcttgtttctcatgtatcccatccctccatttttaacttttgaacttactatgtatatatcatgtatataagcatcagctagttgtcttttaactgtgtcttatggcttatacttctgtggctctgctaatagatgattgctttctgtttttgtatagtaaacctacagattgtttaagcatatacaccagacaggaaacatcatgcatatctcaatcatttagatttttccctagtttccagaaatatcttactctcaaatttcactattttctatttatgcttgaagttgtactgcctttgattatatttttgttgttttgctttttggatgttaaaggagtagagtccaacaaatcattggtgctacaaataatttgcatcggcgttcagggaatgttttacctccaccagtagataatcctaa

SEQ ID NO: 7055 - DNA, 602 bp, Glycine max
atcttgtttttccgcaatccaagcgctgatatgctccttcaagagtcagaacttgataaagatatcctaaagcaggtgtttggaatatctgtttgtattttatgaaatgctgctctgagacctttgatctaatcatgattttcataacattgattttaggctagaatattccattatggctccatcagcttgattgatgagccatgcaagtcagctcaccttgctgctatgagcattgccaaaaactctggttgcattctatcatatgatccaaatttgagattggctctatggccttctgcagactccgctcggaaaggcataatggatatatgggatcaagctgatgttataaaggtataacatatgtgagcaagatattcttcataaatgctaatatactaatccccaattaaatttactctctgctatactgtttaattttgaaaataagaattctgttatccctttctattttccttaatagagttgacttggtatcttcctatgtgtgtacagataagtgaggatgagattacatttttgactgggggtgatgatccttatgatgataatgttgttttgaagaaactttttcaccc

SEQ ID NO: 7056 - DNA, 787 bp, Glycine max
  misc_feature (719)..(719): n is a, c, g, or t
  misc_feature (722)..(722): n is a, c, g, or t
ctcaaggtactacagctttttaagtttattaccttttctggaagcctagaacataacgaattgcagggtgtgacagaataaaggaatttagttcttgaacttgttatattcttttgttgagtgatgggccatttgtaattgttagcaaatcaatagaataagcggattccctactctcaaagcttgcatttttctcgattgtacaaaacaattgatcattgcctatgtaggttagtgatgacgaagtacattttctaacacaaggtgatcctgagaaggaagatgttgtgatgtccctgtggcacgacaagttgaagatgcttcttgtgactgatggagagaagggttgcagatatttcaccaaggtactatccacccatgttttgaaaatagagcttgtttgactaaattgatttaatgaagattttatgaaggaaactgagataatacctttgatcattaactggttggttacgtttatgtaataactaatgatctttggcttgaggtttgttttaccattcaaggtggtttttatttttttatacacatttgagctggatgtctttttatggtgtggtactgtaatctaaactttacacctttggatgttttggtttactgtagaacttcaaaggaagggttactggattctcagccaaggtagttgacacaactggtgctggtgattcttttgttggtgcactcctcactgctgnggncagggaccctaacatatttgatgtatctctctctctctctctctctctcacacacacacacacac

SEQ ID NO: 7057 - DNA, 382 bp, Glycine max
attataattaaagggaacaactgaagctcacaggcaagagcacaaacagcagccagaacataagaatcaaatgctgctacaggaccttgcttcttcaatttcttattttttgatactttctggttttcagatgtttgtaagtcctcaatgatatcctcagatgaatagttatcttcacctcttggtctcttgcttccactgaattgagcttcatgactgacgcagacagttaagacaacaaaaagtaggcgtgaagcaagctctacagatgcacatgattctaagaagagtgaatgaaccatagtacgaagttctgccatggcaaggtttttcgaggcagagccaatgccagctaggtattttgattttctgttttggtctc

SEQ ID NO: 7058 - DNA, 426 bp, Glycine max
gaatatcccaactcctacgtgttcgagatcgacatgccgggtttgaaatctggggacataaaggttcaggttgaagacgacaacgtgcttctgattagtggggagagaaagagggatgaagaaaaagaaggggtgaagtatctgagaatggagagaagggttgggaagttcatgcgcaagtttgtgttacctgagaatgccaacactgatgcaatctctgcagtgtgtcaagatggggtgcttagtgtcactgtgcagaaattgcctcctcctgagcccaagaaacccagaaccattgaggttaaggttttctgaggtttcaatcgaatgctcacgaaccaattatctttgttcgaataaatgtaacgggaacaatattagctttagtgaggaccaactattggtgttcctctgtgtttgtattgc

SEQ ID NO: 7059 - DNA, 686 bp, Glycine max
acatctctcgagttgcaggttggtatagtacttgcattcggtactattgaattgtttttcgttacatcagagtttttttattaataaataaatttataattgtacaatagatctataaaaacaatattaaaataaatttattaaaaactaaagtcatatactttttttagtatataaactaatagtaaaggtgtaacttgagctgtggcttttgtaaatgaaatgaagttactatactccatattgcaatctgcgttcaaaaatagtaagaagtaaaattcaaatttaatgtcaatcattaatttcttaaatgtttactgcagctagttgaaaacagcaattgctctagattgagcaaggaagtggctgaaaagagccatcaactaaggtacaagtctcacgaatttcatataactgatttagtttgtttgttgaaatgtaaagtgtcataacaatgaaaaaaaatacaggcagctgagaggagaggatcttcaaggcttaaacatagaagaattgcaacaattggagaggtctcttgaaactggattgggccgtgtaatagaaaagaaggtcttcaataattgtattttctgtagtgtccgccatagcataatttacctcatgactttctatgatgaaaatctttttgcttttcagggtgagaagattatgagtgagatcactga

SEQ ID NO: 7060 - DNA, 409 bp, Glycine max
agctgaaatcatctaaacatggcaaaccaaaccgaaccaaaaaccaacattcctaatatcaacgccttcccccaataaggaaagtaaaaatcaacaagtacatccttactcacctctctctttcaacaacatcccaccacacaccaacaccaactccaactccaactccaactccaagtcttcccctaactaacaccactaacaacaatcactaaaaaaagaaagaaaatttaccctgatcgcaggatctccgaacaaagctttgatttcacaaaagctaaatttagataaacacctgcatattaaatttttctgctctatacatgcatcacatgtccctcacactaaacaaaagaaaaacaccaccaccctttgcttttgcttttctataagtagtcaacggctcagc

SEQ ID NO: 7061 - DNA, 376 bp, Glycine max
cttgccctccctgtggctgctgtctacttcaatgcacagagggaaacggctgcaagaagacgctagctatagctgctgattttgccactgcttcaaccaaactagtattgtattgtattgaataaagcgataaaaaaaggtacaagtacaaggagtttcagtagtggaattaagttgatcctcacatgtggcttcaaataacttgcaggaagggaagataattaatcattttctagtttgacccgtgtgtatgctacgttttattttactttccatctgttgtgtaaacattatactactacgtgtattattattacctcgtgggactactatgaggtgtgatcttatatatagaaataagaggtttggtacgcaa

SEQ ID NO: 7062 - DNA, 461 bp, Glycine max
gacagctctgacttcatttctgcagaagtctgaagaaacttggaagaaagccaaacaagacgcacgtgattttcctagtgcactggtatgttttagcttgttagccaatatatgttaacattgagtaatgtttttttcgttatgaatattagcattgctgatatttgttgatctttcacagaaggtagcacatgaaaaatatttggctgctttgcaatctgtagttaaatgtttggaaggtcacaagattgaccctgtaaaatttctgcctgggtggcaacttaagaataagattaccaacttggagaaagatattagtgataccaataaaaaaattgatgagaagtcaatgctcaagagaaaagtggataaaaacaattcatctaacaagatgaagattccagaggctaaacgagcaaggttcaccgggaaagatgcatctgtgctatcaccttcactta

SEQ ID NO: 7063 - DNA, 670 bp, Glycine max
tgtgggtccacaatttcttcccatccaaccttaccctcgctttccatgactgcctaatcataaccagaaaaatgctgtgtcaatcctaagtatttgcttacatatattttcaaacgcatcaagatacactcatgcaccacagcacaagcacaaacatagaaaccaacaagcagatactgttcttactagttttacatattccatgagcccttgctgtggattcctgccagtgataagttcaaacagtagcacaccaaaactataaacatcgcttttcttagtgaaggttcttgtagacaaatactcgggatcaacatatccaaaagttcctctgacatttgatgtgcgaggtttgatcatctctggtctggaaagcccaaaatcagtgacctgctcagtaaaatatagatgttaaacatatatagaagaaaaaaaggttttaagcttgaatatggacagagacaagtgaagggatatgatgaaaacggaaaactgcagcaccatctttacaaaaataaggtatcattttcagaaaagcttcctttgagtcaagaaaactaggcagattaattcttcctaacaacattttcaagaaagtagagttaagatagtattattttgttgaatatatagaaaaggagaatttgcaaaatacaatgcataaatgaaa

SEQ ID NO: 7064 - DNA, 380 bp, Glycine max
tggcggaggaaactgaagaagaaggggtggatgcaaaggctgatgatttcatcaacaggtttaggcagcaactgaggttgcaaaggcttgactctattatacgttacagggatatgctcaaacgatactaagaactagagaagagaagagaagaaactcttggatccaatattttccccaatagttcattccttcaccatcagctgcatgaacacgagaattctgctagctagggtgttgtttgtttgtttgtaatggtatggtgttccgcaaggcttgataaaccgttgctagttctttttttcttgtatactgatttgtttgaactgattatagttcataaagtacaattaattacaattcccatactgaaaattttg

SEQ ID NO: 7065 - DNA, 416 bp, Glycine max
aaccctgaagaacaggaactggaacaggaacagaaacaggagcaggaagaaacccccctcctcgaggacgagggcgagggatctgaatacaccatcgatgcggccaagcgtatgaagtacgaacaactgttccctgtcgaagccaagaagttcggttatcaacccaaaaccaacttcaagtcagttgaggatgccctcgatgatcgcgtcaagaagaaggctgatcgctattgtaaatagtaagtctatacttggttctatcaaatgtgtgctttcagatattcattcttacggatgccatgaaccatgctgccgtaattgtaatggatcaatattatgcttcacctgtctcagtaacactcattcgtcctcttaactttttctctgctattgtattgcttccaactagtgtccga

SEQ ID NO: 7066 - DNA, 863 bp, Glycine max
gcgtagcagctcgcactaatgcgcttttgaaacccgtgttcatctgtatccaacgatttactagaaggaggtcgcaatttctccatcttcacatttcgctagcacgtgaaatcaaaagttatcgacactttcgcgcgacacggtaaagtgttttgctcattcctatcgggatttgaaacactaggttttctttcttgatactttccgactaaatattttgatgtcgaattttcaattgtttggttttatgagctcttgaaatgttttagatgccgcatacgcgtcttttaagttgaaaccgtaattaaacttaactgaatcctatagctttatacgcgcgcgtgcacactacacatacaattgaacttggagctgctactttcctgtcgttaaactcttgatttgattttatatgcgttactttaactagagctggaaaaacgtgagtcaagtaatgtgtatgaaattggttaattaagatggagttccaagttcaagggattttattgttaatgattacatttaattaatgctggtgtggtgatttagtagtattttctgtttggtgtactaataattgtaattctattttctcattattttttgaattatggttatgtttgttcttctaacgatttgattaatatgctgattttgccagaaatattgggaaccaagcaaaatatctatggctgacgaaccattatatccaatagcggtgcttatagatgagttgaaaaatgatgacatccagctgcggttaaactcaattcgtaggctatcaacaattgcacgtgctcttggggaggagcgaacccgtcgagaattaattccatttttaagtgaaaataatgatgatgatg

SEQ ID NO: 7067 - DNA, 355 bp, Glycine max
acgcaggaacctcaagctgcggttattcaagcggaaaatcgaatctttgggaggaagaaggaggcatggacgagcttcttgcagtggtgggttacaaggtgaggtcatcggacatggcggaagtggcgcagaagctggagcgtcttgaggaagccatgggaaatgtccaagatgacctcacggacctttcaaacgacgccgttcattacaacccttccgacatctccaactggctccaaaccatgctttccaattttgaccctctcccctccgaggagcccgagaaggactccgcctcgtcggactacgatctcaaggctattccggggaaagcaatctatggaggtggtagtga

SEQ ID NO: 7068 - DNA, 434 bp, Glycine max
gtgagttgggtaattgttggagggtctattttttctgtccataaatacctgtctgctaggccaacccacttccatattttgcatcctttgtacctcagttccaggttaacaccaaacaacacatatagtgcagattcataaggtatagactttgttaatttgcaccctctcttaccctaaatcttgtgtctattgtattttatctctttccatatggttagtgaccagcttatagcatgccaaaatacagatcacaccaaaccattaggcacatacataattattattcacaccttttgttttgttttctttccctttctcttgagtttatttggtttgatgatttgcttttttttttttgtaaaaaaatttttgaaaaaaaaccccaattaattttttgggaaaaaaaatatttaaaacttcccacccggggg

SEQ ID NO: 7069 - DNA, 1131 bp, Glycine max
gatgatgttcataaagaagcccaatggtgttaagacttctagtgatggtcataaagagatgatgctttctcggaggcaagcttgcattttatctcttttctgtgcacaatttgttgggacctcctttctcaattattgtgatttatatttttgcagtattggtcaacttatgggctctgaatcatggcattcaaatattgatgttcctgtaagtgttttcttttatatgtttccagctagcaatgcattttcagtttgcatgtttcttagtggtcctttcgtgttctcaggaagacattcttgctctctcaagtgaatgttcgaataatttcaggtatgtgtaggttgtggctgattgtttttggtcatctgttttcttctagttgaataaatctttctgccaatatttttgtgccatacttgagttaatcggctttgcttttgctagttgtgaaaatgctccattttgtttcttctctgttcaggaaaataggatctccacaaggtgtgaaattgttgcctcccagcttggatgattctaataaaaagtccactcttggtgtatcttcatctcgtatcctttgtatacttgaaactagctgactaactaattcaattggaataaatccccagtttaatcctcaaaagaatttggggacctcaatggacttgtaaatctaattgctcttcaaattataattttgatcatataatgatatcaatttggtccaagtgaactataacttttggactatattgatgtcaaaatattattgaaggaccacattgatatcataatgtttcaaggaccgaagtggtgggttacttgagagaaatgctaacaacatatcctccaacacttttttgaatacactattaatggctaaaattttgagacttgtgaaatgatgcgggctctattccatatttgctgtgattctctataaattttaatcaataataatgtgtcagagagaatgttgttagcagtctcttactcaaaattgccaatggttcatgtcagttgttgtgttatgccaatgtaggctatatctctttgatattccttaacaccttatcagaatctagagaacgcagaaaagtgcaattggtggaacagccgggccaaaa

SEQ ID NO: 7070 - DNA, 447 bp, Glycine max
ccatcatatgatgacgatgacgacaatgatgaagtcagtgatagtggcagtgaattatcagatgatgattttattgacaggaacgccaaggatatgattgacgatgatatgatggtgagcgttgaaggcgctgattttaaccctgacttgaacaaaatgtctattactcccagaaaatcttttaaacatgggtttgagacaccgttgaatcaatgtacgcgaatgccagcaagaatcagaccgtccactagtccggagtctctgtgatacctatctgcttgtgatgatctctttacataaaataggaaatctgtcgatcttgcagtgttcatgccaggaactaatcagcatagtggtgtcctataaaatagggcattgatatttttgggatttgagtcctatacaacgaggggagttacttaaaaggaaagtgtggaattatagccg

SEQ ID NO: 7071 - DNA, 377 bp, Glycine max
ttctctccttcttttctcactcacttttcactcccaagtcccaaccacaacccctcctctcctctcctcgatcagtgccataaatcaattctttctttctatctatctctgtccacaattctctttatgtctacaaacctaaaactaaaacctgcttgagagagtagggaattaattaattaattttctttcatttcatcttttaagttgatctgtgaaaatggcttcatcttcctccaacggcagttccagcggaagcaagagttgggacatcgacggcgacctcgccggtttcggctacaaagtccgttcatcggagctgcaacacgtggcagaaaacatggagcgtttagagaacgtgatggacattgtgaact

SEQ ID NO: 7072 - DNA, 568 bp, Glycine max
  misc_feature (53)..(56): n is a, c, g, or t
ctgagctttatatacaggaccaaatgcaccttgccctatgagtgttgtaaaannnntttttgccttttgcaaatccctgaagcacagaaaaaagtattaaacagaaagaaagaaaaaagaaagagataaatgacatgaaacaagatgttctgttttcaaactattgtaaacttgatttctcttttagaaataagcattagtcactaaaattgcaaaatttcaaacatatggaaggatgagacatgatgagtcaaatgcctagagataatcaaacatttatcttataaagtatcatggtatcatgaagttatggtggtttaaagtcatcctttccttagtttttttccttttagtaatttcctttccttagtttcatgaagaaactttcatcatccaatagttaaatgctccgaccaaatcacgccgttactccagtgagtttctcttcaaagaacaaaaactatgaagcatttaagtttaatttagagccaaccatttcatattttatacaagaaaaaaaaatacagctaattattactcattattcatatagtctcagcacatgtgc

SEQ ID NO: 7073 - DNA, 1385 bp, Glycine max
  misc_feature (770)..(770): n is a, c, g, or t
  misc_feature (772)..(796): n is a, c, g, or t
  misc_feature (799)..(806): n is a, c, g, or t
  misc_feature (809)..(811): n is a, c, g, or t
  misc_feature (817)..(824): n is a, c, g, or t
  misc_feature (826)..(833): n is a, c, g, or t
  misc_feature (838)..(853): n is a, c, g, or t
  misc_feature (857)..(872): n is a, c, g, or t
  misc_feature (875)..(880): n is a, c, g, or t
  misc_feature (884)..(892): n is a, c, g, or t
  misc_feature (896)..(896): n is a, c, g, or t
  misc_feature (898)..(904): n is a, c, g, or t
  misc_feature (907)..(911): n is a, c, g, or t
  misc_feature (913)..(941): n is a, c, g, or t
  misc_feature (943)..(958): n is a, c, g, or t
  misc_feature (960)..(978): n is a, c, g, or t
  misc_feature (982)..(989): n is a, c, g, or t
  misc_feature (992)..(992): n is a, c, g, or t
  misc_feature (998)..(1016): n is a, c, g, or t
  misc_feature (1018)..(1019): n is a, c, g, or t
  misc_feature (1021)..(1029): n is a, c, g, or t
  misc_feature (1035)..(1039): n is a, c, g, or t
  misc_feature (1042)..(1050): n is a, c, g, or t
  misc_feature (1055)..(1061): n is a, c, g, or t
  misc_feature (1064)..(1065): n is a, c, g, or t
  misc_feature (1067)..(1067): n is a, c, g, or t
  misc_feature (1073)..(1073): n is a, c, g, or t
  misc_feature (1075)..(1093): n is a, c, g, or t
  misc_feature (1095)..(1125): n is a, c, g, or t
  misc_feature (1127)..(1133): n is a, c, g, or t
  misc_feature (1137)..(1142): n is a, c, g, or t
  misc_feature (1144)..(1148): n is a, c, g, or t
  misc_feature (1151)..(1153): n is a, c, g, or t
  misc_feature (1155)..(1162): n is a, c, g, or t
  misc_feature (1164)..(1175): n is a, c, g, or t
  misc_feature (1179)..(1196): n is a, c, g, or t
  misc_feature (1199)..(1212): n is a, c, g, or t
  misc_feature (1214)..(1223): n is a, c, g, or t
  misc_feature (1226)..(1243): n is a, c, g, or t
  misc_feature (1245)..(1249): n is a, c, g, or t
  misc_feature (1254)..(1256): n is a, c, g, or t
  misc_feature (1258)..(1285): n is a, c, g, or t
  misc_feature (1287)..(1289): n is a, c, g, or t
  misc_feature (1291)..(1291): n is a, c, g, or t
  misc_feature (1293)..(1295): n is a, c, g, or t
  misc_feature (1297)..(1305): n is a, c, g, or t
  misc_feature (1309)..(1311): n is a, c, g, or t
  misc_feature (1317)..(1324): n is a, c, g, or t
  misc_feature (1327)..(1358): n is a, c, g, or t
  misc_feature (1360)..(1368): n is a, c, g, or t
  misc_feature (1372)..(1379): n is a, c, g, or t
  misc_feature (1381)..(1381): n is a, c, g, or t
ggagatttcccatcacaattctgattttgctgtttcaactagtaggctcaacgattgtgaagctgttgttcacatttcctcttatgaggctcacaaggctccactatccgacatcttgcaatgtttagaaaataatggcctttatttgctaaatgcttcttcctctgaaacttttggaggaagggtcttctacaacttgcatttccaggtatcttttatggtattccttttatcctttttgcttattgtagtagtcaaatttttactctctagcttgttcttgcatagccttttataagaaaaagtttcatttcaattaatctattattttaaaagtttaagataacattaattattaggtttttaattatatacttttattcttatcggaaaaaatgatgtgtatgaaatgttattgaagtaataagacagcaaaaggacatttaacaaaaggataatgctaatgctaattaatgtgctatggcattggttaatgattaaaaatacataaaaaaaattataagaaaatatagcatttagtgttataagtactttataatttgagaactaatgatgtactgctgtttctgcaggtggaaaaaactcatagattagagtccgaaattctaactgagaagcttttgtcaatatatgagaagcaaaggattttctaatcaaacgatcttaagtgctctgatgttaaatttgacacctaaaagagtcttcacatatttgtcatgcatgaatggcaagttcggaaattagaatgnannnnnnnnnnnnnnnnnnnnnnnnnccnnnnnnnnccnnnccactnnnnnnnnannnnnnnnccccnnnnnnnnnnnnnnnnctcnnnnnnnnnnnnnnnntannnnnnattnnnnnnnnncttntnnnnnnnttnnnnnannnnnnnnnnnnnnnnnnnnnnnnnnnnncnnnnnnnnnnnnnnnncnnnnnnnnnnnnnnnnnnncccnnnnnnnncancccccnnnnnnnnnnnnnnnnnnnanncnnnnnnnnncccatnnnnnaannnnnnnnnaattnnnnnnnaanncnaactcnannnnnnnnnnnnnnnnnnntnnnnnnnnnnnnnnnnnnnnnnnnnnnnnnntnnnnnnntctnnnnnntnnnnnttnnncnnnnnnnntnnnnnnnnnnnncctnnnnnnnnnnnnnnnnnntcnnnnnnnnnnnnnncnnnnnnnnnnctnnnnnnnnnnnnnnnnnntnnnnnaactnnntnnnnnnnnnnnnnnnnnnnnnnnnnnnncnnncnannncnnnnnnnnnctcnnntctttnnnnnnnnccnnnnnnnnnnnnnnnnnnnnnnnnnnnnnnnngnnnnnnnnnctgnnnnnnnncnaaat

SEQ ID NO: 7074 - DNA, 388 bp, Glycine max
  misc_feature (369)..(369): n is a, c, g, or t
aggaggtagagccaagttaagccaggggtggtttgaattttcattagagaacaatttaggggaaggtgatgtctgtgtgtttgagctgcttagaatgaaagaagtagtgctgcaagttaccatctttcatgttaccgaggatgtgggactgttgagccctcctttgcagcataaccaaaacatgacctcagctaaactgttaagcactcccttgcagcaacacctcacttcaactaaaatggttagaaattagcagcaggttcattctcgatagctcaactgtatcaaaataaccccttgcttctgtgtggaacttagatgctttttctgtccaaaatttcagggtgacttgagtggaacatagaaccntcatggtcctcctttgtag

SEQ ID NO: 7075 - DNA, 475 bp, Glycine max
gaccaatgggttacccagatgatgagagagaggagtctgagtatgaaactgaggaggaggaagatgagaggcctccttcacgtaagagggatgaggatactgagccagagtatgaggatgaggaagaagaggaagaacactatgaagaagccgaacaagttaatgatgcatcagatgatggggaagaggaggtactgcttattttatttaaaaaattagtcagctttatctttggtgggtaggtccatatagttatttctgaatagtttcagattgcttcttatcagcacttccttactgttaagtgttaataaggtatgttacatgtgattagttcatgcagtttgctagattttttaatcttccccatttataatgtttccattctgtgttctggtttgtactgtgaagctttttttttttttttttataggactactgtacatgtgtcctctttgtgcttgtacatcttgta

SEQ ID NO: 7076 - DNA, 562 bp, Glycine max
cagtggtaccaggagagaaagggatggaggtgtagttccagtatggtctcccccagcttctagttactcagaacaatttgtaggagaggaaaatggtataacaaacagttcatctttcttgcaaaggcatcctcagtctcaccaaatgctgaattggaggcagctacctcagactgggtaagatttcccaaaccaatgaaattatgaaagcattgatgtcttatatatactgcctgttctgaacatttgaggaacatcaaaccaattgtcaaagttctgcttgaagtttatgttctatatttaatttaaagattgtgatcccttttaatttttgttgactccttgttatcttatcagtgttaaattttgatcacaggtaattcatatctaaagcaattagactagaagcaaggaggtggaaattacactaccacttttctgttgagagaaagtgaggtgttgaagccccattgaacatacatgtgttaatttccttctcctttaccaccacctgacctccaatgtgtatggaaatttcaattcatacggaagttccatctgc

SEQ ID NO: 7077 - DNA, 246 bp, Glycine max
tctgattctctccctctcatttgcaagcctgcagtgtgttgtttccttagggtgatggcctttggtgctgccctcattggaagcttccgggttgcttttccggcgccgctcgttgtgtccggccaaccggcggcggcagcttctcttggattcatcaaactctgccaggtcatggaacctgcacacactcatcataggaagaagttcttaagcttacactatttgacacttcttgtaaaaaaaaaa

SEQ ID NO: 7078 - DNA, 398 bp, Glycine max
cctttgcctccgtgctcatggtggaggttccacttttggaattaccattaaccaaactcttgctctgtctctccctggcgcttgtgaagtacaaactccccctgttagccagtgccaaggtatgaataataatacaagtactattaactaaagtccaagtgttacgatgctaaaactacagttactctaatttacaatctacacaataaaacagttgaatcttcaatttgcttaccatgtgacacgtgttggcacatcattttttaaaatattttattgttttgtacttttctttctctcgcatggatccacactccactatttcgattattttttctgcacaagaattactctagtttaaaataaaaactatagtttataatataaatctttttttt

SEQ ID NO: 7079 - DNA, 376 bp, Glycine max
acagttatatctacctgtgaagagattgagaatttgtcctgcgagttttcttctgtttacattgatagaaatgcccaaaataaacactacagcctatccatacctagcagctcacctgataatgtgttggttaaatctatgcaatctcaagaattgcagtataatactgacaaattgaaagatttaatgattaaaaatgcagacagtaaagctgctgcattatataatgaggtttgtaatttaaaggaacagtgtgatttgtcattggattctcaatctcaagtagtatcagctaatactgaagtggaagatgatgtaacaacttttgataatcagagacttaaggatccagaagttattggttcttatttgcccg

SEQ ID NO: 7080 - DNA, 529 bp, Glycine max
aattttctctatgttaaggtgaattttaactccacaaaagtatgaaataaggttcctgcagaataattggataactaaccatcccattgtcttttgctttttattcacaatatcttgtttaggaggacatgctcatagtacaagatgaaatatttggccctgtgatggctttgatgaagtttaagtaagttattataaatctatttatttattcttactattgacttaatgtcatcctagaaaatgttttgagagtttggtcatgaattgtataaatgaacaacaggactattgaggatgcaattaagattgccaacaatacaagatatggcctagcatcaggcattgtgacaaagagtttggacacagccaacactgtgtcaaggtccattcgtgctggcattgtttggatcaactgttactttgcctttgggaatgacattccttatggagggtacaagatgagtggatttggaagagattttggaatggaagccctacacaagtatcttcaagttaaatctgtgta

SEQ ID NO: 7081 - DNA, 375 bp, Glycine max
tgatcgtactttaatgattgaagaagttggagcagagattgagaagcaaaacatgcaggaatcagatgtagacagaaataatgatttaacactccgtcattctaagatgcattgcaattccagtgtctcagaaatatgtggcaaggagggccaagattgtctggacaaaaaatgttctagctcacttacaaacacaacagatagacatattgaaatgattagaaattctgaaattacagaagcagttatcattgatagcaagtgtgatagcttaactttgaatggtgaagggcatcaagaatatcagtctacctgcaaaagcaacaatgtggaagcggctttatcacctgcttcattggtaaatcaatctaccct

SEQ ID NO: 7082 - DNA, 815 bp, Glycine max
  misc_feature (677)..(678): n is a, c, g, or t
  misc_feature (681)..(681): n is a, c, g, or t
  misc_feature (690)..(690): n is a, c, g, or t
  misc_feature (692)..(694): n is a, c, g, or t
  misc_feature (696)..(698): n is a, c, g, or t
  misc_feature (700)..(700): n is a, c, g, or t
  misc_feature (702)..(703): n is a, c, g, or t
  misc_feature (707)..(710): n is a, c, g, or t
  misc_feature (746)..(746): n is a, c, g, or t
  misc_feature (748)..(751): n is a, c, g, or t
  misc_feature (775)..(780): n is a, c, g, or t
  misc_feature (783)..(786): n is a, c, g, or t
  misc_feature (789)..(793): n is a, c, g, or t
  misc_feature (795)..(796): n is a, c, g, or t
  misc_feature (799)..(806): n is a, c, g, or t
  misc_feature (808)..(808): n is a, c, g, or t
  misc_feature (812)..(812): n is a, c, g, or t
tgctgttaagcagcacgtcatgcatttgacaacggtccatggcctcgccttcccggctctgtacgttattttttcccttctcttatttaatttatatgtaccaggtgattcatatatgataatcataaatataaacaatagatctgtattccccctaatagaaaaataaaaataaaccatagatcatgtgtataaatataattaagattacggcggagtgcagtaacttcccttggctgaatgattttccaaagatatggggaatggattgactttttcgatctttttatatttaactttaatgaattattaacgtaaaaaaattaacatttgtattttaaatagtatattttcacaatatttcacaaaactgatatgttttttaattggtaatatgattaaaattattaaataccatgttcgtgttgatatatataattatatgtattgtaaaagaattgacattaaagatacatagaaaattacgtaaatcttttaataaatattattattactcaagcatgcaaaacccatgtgatccagattgttatatgaataattaatatcaacgttcttatgtgatttctgattatttaatgctaaacccatgtgatccagatttgtaatggcgattctataaatttcaattttatttaaaacacgactatgcataagtnncangtcactccnannnannngnanntatnnnnttaaatatgacttacattttttacatttaattttantnnnngaaaaaaattaaacccttattttnnnnnntannnnccnnnnnanntcnnnnnnnngntacnaat

SEQ ID NO: 7083 - DNA, 366 bp, Glycine max
catgcagatgcggcgattacttctctgtagactcttggaattgaagaaaatgggatattccttattgagggtgggaagtgggatatctgtactcaatgctgataccttacctggatcagtgattcttccatgtggatcttgttcgttaaaagctcgtctgctaatcaatatggatgccaattgaaattaaattatcactgatttttggcatgaataatgatgactggtatttctaacattttttgtatgaagatagttacaactgcctgtcattgggaaaattcctggggcagaaatctggagtgtcattttgattttggaaaatggaatgcagtgatattagtttcagctatgtgcctcacttga

SEQ ID NO: 7084 - DNA, 404 bp, Glycine max
gaagggcaaggaggtgatagaagtggatgctgatagttccaaggatatggtttcggaggaggattcgagtgtggaagaggttcgttttgtggaagaagatggacgagaagtgcgctccgtggtgacggagcacaagtggcaagagggtgatttggttgtgactgaggttaaggatttggatgctaaggatatgtgtggtggccctcagcagcagtcaacttcatccgtggtttctgagttgactaatggtgatctgaatgtggttaatgctgagaagatgttggacattctttctttgactccggatcatgatctttcctccgttcaagcctacaagaagttgctcgatgctcttggccagcgaacggatacccttaacaggctggaggctgaaattaaagtta

SEQ ID NO: 7085 - DNA, 380 bp, Glycine max
agctttaattgggaccatgtcaggtcatgctagttgggtactgtgtgtggacgtgagcccagatggggcagccattgctacaggttcaagtgatagatctgtaaggctatgggatcttaacatgagggcatctgtgcagacaatgagcaatcattcagaccaggtatggggagtcgcatttagaccacctggagggagtgatgtgcgaggtggtcgacttgctagtgtatcagatgacaagagcatatcactgtatgattattcctgatttagatattgtgtgctgtatttgtactctttgtggaatgttatttactcttttgtctacaaattgattttgaattgaagaaaatgcatggttgtacatgctgtatccgtga

SEQ ID NO: 7086 - DNA, 380 bp, Glycine max
tgatctgagaaaagatgtgaggaatgggaatgaggctaatccacatgtaagctcaagtagacggaaaccaaaaatgtcggtcaaaaacaattcaagtggagaaattatcgacagtctaatgatgcaagccaaggtgattccaaatctagaggatcaagattattctgtgccaaatataagcaggttacatcaggatgatacttgcctacagaaggagtgtgtggctgggtcccaatccaatgacgttgagcatggtgatgatctcctgaactctacaagggatattgataatggaaatgcccttgtaccaagaggctgttttcattctgcagcaaaccaaacacgtccacttgaggctaccaatgacgctgaatatcaca

SEQ ID NO: 7087 - DNA, 412 bp, Glycine max
ctcttgggctgaggaggaggcagcttattgacagtgacagtgagcacaccgtcttggcagacagcagagatagcatcggtgttggcattctcagggagagtaaacttcctcatcaacttgccaagccttctctccatcctcaaatactttcccccttctttctctttttcctcctccctcttcctctcgccgcttatcagaagcacgttgtcgtcctccacctgcactttaatgtccccagatttcaggccaggcatgtcgatcacgaaaacgtacgagttagggtactccttcacgtcagcaggagtcgcagccatcgccttggcgtcgcgcacgtatgtccgagtcggagcgttcaagttcttctcggcgtcctccgtcagatccatgattctgtgcagagtgttgaaga

SEQ ID NO: 7088 - DNA, 676 bp, Glycine max
  misc_feature (623)..(625): n is a, c, g, or t
ttcttcgaccccatcttcaggatgctgctcacagcttgccagtgtggtgcgctcacaaccacaatgcctatgtcaggttcttagcggcggtggatcatcactggggctcaacatcaaccaaactcaggctctggctttgcctggtgcttgcgaggtgcagaccccacccaccagtcagtgtaacaatggtaaatatgacaacaagtttctatttcattacattgaatacaaaaataacaaaaagaacattctcccattaaacatgtgtatccaaccttagtaagaatattgagacaccagagatactatgtaaacatcaatcagccttggcacactatggtgtatggaggcaatagatagaacaaaaaaaacaaaactatataatcaatatccttctgctaacttaacattttttgttcgtcaccagctgctgcttcaccaccaacaggaacagttgcggaatctccaaattcagctccatcaggtattggatgttaattcaccacattttgagggagtattttggtttgatgctttacggtttgattatccaatttgtcccttgtccgagttaaccattcaagttgacattcacttgcaggaactggaggatccaaaaacannnccacaactgataatggctcatccagcggaaattccattaagttatcgatcc

SEQ ID NO: 7089 - DNA, 372 bp, Glycine max
actgttttaccaatgcagatgtggtgattacttctctgtagactcgttggaattgaagaatatgggatattccttattgagggagggaagtgggatatctataatgaatgttgatacatcaccaggatcagtgattcttccttgtggatcttgttcgttgaaagctcgtttgctaatcaatatggatgtcaattgaaattaaattgtcaccatttttttatatgaataatgacgacagagatttctaacattttttttatatgaaactgcattttgcagcggtctgtcaccgggaaaattcctggggcagaaatctggagtgtcgttttgaattttgattttggaaaatggaatgcagtgatagtttcaggt

SEQ ID NO: 7090 - DNA, 1410 bp, Glycine max
  misc_feature (337)..(338): n is a, c, g, or t
  misc_feature (373)..(373): n is a, c, g, or t
  misc_feature (375)..(377): n is a, c, g, or t
  misc_feature (382)..(387): n is a, c, g, or t
  misc_feature (390)..(408): n is a, c, g, or t
  misc_feature (414)..(416): n is a, c, g, or t
  misc_feature (418)..(431): n is a, c, g, or t
  misc_feature (439)..(439): n is a, c, g, or t
  misc_feature (442)..(453): n is a, c, g, or t
  misc_feature (455)..(457): n is a, c, g, or t
  misc_feature (460)..(468): n is a, c, g, or t
  misc_feature (473)..(479): n is a, c, g, or t
  misc_feature (481)..(483): n is a, c, g, or t
  misc_feature (485)..(486): n is a, c, g, or t
  misc_feature (492)..(497): n is a, c, g, or t
  misc_feature (500)..(501): n is a, c, g, or t
  misc_feature (504)..(509): n is a, c, g, or t
  misc_feature (519)..(519): n is a, c, g, or t
  misc_feature (521)..(528): n is a, c, g, or t
  misc_feature (530)..(532): n is a, c, g, or t
  misc_feature (534)..(545): n is a, c, g, or t
  misc_feature (547)..(547): n is a, c, g, or t
  misc_feature (549)..(549): n is a, c, g, or t
  misc_feature (559)..(561): n is a, c, g, or t
  misc_feature (563)..(573): n is a, c, g, or t
  misc_feature (578)..(578): n is a, c, g, or t
  misc_feature (580)..(580): n is a, c, g, or t
  misc_feature (583)..(590): n is a, c, g, or t
  misc_feature (594)..(595): n is a, c, g, or t
  misc_feature (605)..(613): n is a, c, g, or t
  misc_feature (616)..(619): n is a, c, g, or t
  misc_feature (622)..(633): n is a, c, g, or t
  misc_feature (635)..(639): n is a, c, g, or t
  misc_feature (646)..(646): n is a, c, g, or t
  misc_feature (648)..(653): n is a, c, g, or t
  misc_feature (656)..(677): n is a, c, g, or t
  misc_feature (682)..(694): n is a, c, g, or t
  misc_feature (697)..(698): n is a, c, g, or t
  misc_feature (700)..(701): n is a, c, g, or t
  misc_feature (704)..(708): n is a, c, g, or t
  misc_feature (710)..(711): n is a, c, g, or t
  misc_feature (713)..(713): n is a, c, g, or t
  misc_feature (716)..(717): n is a, c, g, or t
  misc_feature (721)..(727): n is a, c, g, or t
  misc_feature (729)..(729): n is a, c, g, or t
  misc_feature (731)..(734): n is a, c, g, or t
  misc_feature (736)..(738): n is a, c, g, or t
  misc_feature (742)..(745): n is a, c, g, or t
  misc_feature (747)..(764): n is a, c, g, or t
  misc_feature (766)..(770): n is a, c, g, or t
  misc_feature (772)..(776): n is a, c, g, or t
  misc_feature (778)..(779): n is a, c, g, or t
  misc_feature (781)..(781): n is a, c, g, or t
  misc_feature (785)..(789): n is a, c, g, or t
  misc_feature (791)..(796): n is a, c, g, or t
  misc_feature (800)..(809): n is a, c, g, or t
  misc_feature (812)..(814): n is a, c, g, or t
  misc_feature (816)..(825): n is a, c, g, or t
  misc_feature (827)..(829): n is a, c, g, or t
  misc_feature (831)..(839): n is a, c, g, or t
  misc_feature (841)..(841): n is a, c, g, or t
  misc_feature (843)..(843): n is a, c, g, or t
  misc_feature (845)..(864): n is a, c, g, or t
  misc_feature (866)..(866): n is a, c, g, or t
  misc_feature (868)..(875): n is a, c, g, or t
  misc_feature (879)..(884): n is a, c, g, or t
  misc_feature (901)..(901): n is a, c, g, or t
  misc_feature (903)..(903): n is a, c, g, or t
  misc_feature (907)..(910): n is a, c, g, or t
  misc_feature (914)..(914): n is a, c, g, or t
  misc_feature (916)..(919): n is a, c, g, or t
  misc_feature (921)..(924): n is a, c, g, or t
  misc_feature (928)..(930): n is a, c, g, or t
  misc_feature (932)..(932): n is a, c, g, or t
  misc_feature (934)..(940): n is a, c, g, or t
  misc_feature (942)..(950): n is a, c, g, or t
  misc_feature (959)..(968): n is a, c, g, or t
  misc_feature (970)..(974): n is a, c, g, or t
  misc_feature (978)..(978): n is a, c, g, or t
  misc_feature (984)..(995): n is a, c, g, or t
  misc_feature (998)..(999): n is a, c, g, or t
  misc_feature (1001)..(1003): n is a, c, g, or t
  misc_feature (1005)..(1007): n is a, c, g, or t
  misc_feature (1009)..(1023): n is a, c, g, or t
  misc_feature (1031)..(1037): n is a, c, g, or t
  misc_feature (1045)..(1058): n is a, c, g, or t
  misc_feature (1065)..(1089): n is a, c, g, or t
  misc_feature (1091)..(1095): n is a, c, g, or t
  misc_feature (1100)..(1114): n is a, c, g, or t
  misc_feature (1125)..(1130): n is a, c, g, or t
  misc_feature (1133)..(1146): n is a, c, g, or t
  misc_feature (1150)..(1159): n is a, c, g, or t
  misc_feature (1161)..(1168): n is a, c, g, or t
  misc_feature (1170)..(1181): n is a, c, g, or t
  misc_feature (1186)..(1197): n is a, c, g, or t
  misc_feature (1199)..(1214): n is a, c, g, or t
  misc_feature (1220)..(1237): n is a, c, g, or t
  misc_feature (1239)..(1241): n is a, c, g, or t
  misc_feature (1249)..(1249): n is a, c, g, or t
  misc_feature (1252)..(1255): n is a, c, g, or t
  misc_feature (1257)..(1257): n is a, c, g, or t
  misc_feature (1266)..(1267): n is a, c, g, or t
  misc_feature (1270)..(1270): n is a, c, g, or t
  misc_feature (1274)..(1286): n is a, c, g, or t
  misc_feature (1291)..(1301): n is a, c, g, or t
  misc_feature (1306)..(1350): n is a, c, g, or t
  misc_feature (1353)..(1359): n is a, c, g, or t
  misc_feature (1364)..(1380): n is a, c, g, or t
  misc_feature (1383)..(1383): n is a, c, g, or t
  misc_feature (1386)..(1389): n is a, c, g, or t
  misc_feature (1391)..(1391): n is a, c, g, or t
  misc_feature (1396)..(1403): n is a, c, g, or t
ttctattccttcttcaggtgttcattgaattcgtgatgaagagggatcaccgagatagctgcggcggcggcggcggagggagtgtgaagggtgagtgttcctcaatgccgtcgaacgggaaggcaaatatgtgggaggaacaacaacaacaacaacaggggatggacgagttgctggcggcgttggggtacaaggttcgtgcttccgacatggccgacgtggcacagaagctggagcagttggagatggtcatgggttgtgcccaggaagagggaatttcccacctcgcctccgacaccgtccactacgatcccacggatctttattcctgggtccnnaccatgttaaccgaactcaaccctgaacccaacancnnnaacannnnnnaannnnnnnnnnnnnnnnnnnggttgnnngnnnnnnnnnnnnnntttgtganttnnnnnnnnnnnngnnntgnnnnnnnnntacannnnnnncnnnanntggtgnnnnnngcnnatnnnnnnttggtgtttnannnnnnnntnnntnnnnnnnnnnnntncnggtttacctnnntnnnnnnnnnnnacttncnccnnnnnnnncccnnccccttttannnnnnnnnttnnnnccnnnnnnnnnnnncnnnnntccctcncnnnnnntcnnnnnnnnnnnnnnnnnnnnnnttacnnnnnnnnnnnnntanntnnctnnnnntnntnctnnctcnnnnnnncntnnnncnnncccnnnncnnnnnnnnnnnnnnnnnntnnnnnannnnnanntnaacnnnnncnnnnnncttnnnnnnnnnnacnnncnnnnnnnnnncnnntnnnnnnnnntncncnnnnnnnnnnnnnnnnnnnnantnnnnnnnntctnnnnnnttttttttttctttctntncctnnnntttntnnnncnnnnttcnnnantnnnnnnntnnnnnnnnnactccctcnnnnnnnnnncnnnnntccntcttcnnnnnnnnnnnnctnncnnntnnntnnnnnnnnnnnnnnnttctcccnnnnnnnccaattannnnnnnnnnnnnnatctttnnnnnnnnnnnnnnnnnnnnnnnnntnnnnntcacnnnnnnnnnnnnnnnttcattttttnnnnnntcnnnnnnnnnnnnnntttnnnnnnnnnntnnnnnnnncnnnnnnnnnnnntattnnnnnnnnnnnncnnnnnnnnnnnnnnnntccttnnnnnnnnnnnnnnnnnntnnnccttcccnttnnnntncccatctcnntcnccannnnnnnnnnnnnctttnnnnnnnnnnnccccnnnnnnnnnnnnnnnnnnnnnnnnnnnnnnnnnnnnnnnnnnnnnctnnnnnnntaccnnnnnnnnnnnnnnnnntcnctnnnncncactnnnnnnnnatcaatc

SEQ ID NO: 7091 - DNA, 1001 bp, Glycine max
cgctctgctgctgctaggtaaaactttttggacatattttaaatattctttatcgtagttttattttatttttttaccaattaaacctgttacctgtccttcgtttgattggtatcttccttaattgacttggaaatttcaaatttagggcctatgatcgagctgctattaaattcaggggacttgatgctgacatcaattttaatctcgttgattatgaggaggatctaaaacaggttggaacacgaataagcttttggtgaatttgaatctagatggagcttgtgattggttttttactggtttgttaatgatgggcagatgaagaatctttccaaggaggagttcgtgcacatactccgccgccacagttccggtttctcaagggggagttcgaaataccggggagtgacacttcacaaatgtggccgttgggaagctcgaatgggacaattccttgggaaaaagtgaggacctacttttttttatgttaactataactgatgttatggtttgtcatgtttataggattagatattagtacgaattattagagatattagatattagtacgaattcaagtacctattgatttcagttgtaccaatacctattggtacaactgaagtacgaattcaaagcgaattgttttcggtttggtagtcaaatgggtctttactcttctggctttttccatgtttggaggaacatgtctaggatgcctgtttcacagaaacagttggcagaggtgtttttgttgttatagagattgcaatgctttcgtgcaggtatatatatcttgggctattcgacagcgaagtagaagctgcaaggtcctaattatacatgaatttcattctacctgcactgaattttttaccctgaattatcaaagctctttacggttccaaccaacatatgtctcccttttgattttctggaaatcagggcttatgacaaggcagctatcaagtgcaatggaagagaggctgtgactaact

SEQ ID NO: 7092 - DNA, 367 bp, Glycine max
tacgttcgagacgcgaaagcaatggctgcaacacctgcggatgtgaaggagtatccgaattcttacgtgttcgagatcgacatgccgggtttgaaatctggggacataaaggttcaagttgaagacgacaacctgcttctgatatgtggggaacgaaagagggacgaagagaaagaaggggcgaagtatttgagaatggagagaagggttgggaagttaatgcgcaagtttgtgctgcctgagaatgccaacactgatgcaatctctgctgtgtgccaagatggtgtgcttagtgtaaccgtgcagaaattgcctccacctgagcctaagaaacctaggactattcaggttaaggttgcttgaacaa

SEQ ID NO: 7093 - DNA, 1152 bp, Glycine max
tcgcaaccttcttcttctggttggttgtgcatattttatttaaagaagtcactaactaattcatttaattctgagcaagattaccaactttaaattattcattaacaacaacctgtacagttcaagacctcgaaaacgtagaagaaaggactctgttcaaattgaaaaacgcaccaatgtaaaattcctggagttggactcaccagaaggcatacataatggatttctacaaaaagatgatggtaggaatcgtatgttgatgcctgctgtgactataagttgaaacaatatttaggaacattttctcctaaagcacctaaaattcccttaaatgcattgaagatttatttgtctttaaaacatgctagtagaagtgactctttttttcttctgtaaataaattgtaaaaatgaaaagaaaagtgagagattcaataatatttggtcctaaactgtaaaacagagaaagactatgtggacactgttggtggattttttgcaaagaaaataaatgtggcagaggcaaatggcctctttatcagttttaacaaaatcattaacagctatagtttttcttcaatcttcatgggttgaaagggtaatatgtaattctgatacatgatggtggaaaactttaatttcttgatatactaaaattaattaggacaaaaactttaaggaggtaaagtgtatttcacccttttttctgttgctgttaggatacctcctgatccttgtgtttgtttctgctcttatgatatgttttcatttatcaaacacacacacaaacacgcttggaatggatgactaagttgatgccttaatataatcttttatttagatgcacaaagggcttcatgccctggaaaactcctagaatctccctttcaaaataaaagggtgcaaattgatggattatttttactgcagtaaatagggggaggggcaaatacatactttttccagtttgttaattacgagtaatgtctatataattctttggtttatatattctgtgggatggactgaaattctaaagttatttgtagatatcttatcctgcaaaggagagaatgtgtctagaacatctcgtagtgagaagattttccctagtggaagaaatgacggaggaaaatttggtcctgatcatcct

SEQ ID NO: 7094 - DNA, 619 bp, Glycine max
ctaggcaagtgaatgacaaagtcattctgtctaaccaaggggaagacatgccagtgagtgcagatcagctggatataacactggagtttgcaaaagaggatagcgacgtcctatcttcatttccatctgttataaatttatcaatacatgggactgaaccaacaccatctttaaataagctaacaggagaagatgatcttaaagttggtttgttcattgctgagaatcgtttcaggtatggctgaatataggttttagttcatggtttgacttgtgaatgaaatttctggtaatttgttttttattttgtttttttgtgtctgcttaaataagggggcaagcgtttgatataactgttacaatcactatacgaacatttttttcttggttactgttggaaagctgcttatgatgttttctcctttttcccacacccctcagggaggctgcaagagtttgtggagaagacagctctggatgggcatcatctgcattcccaaccaacgatacaaggtctcgacctggatccaggttacaatcctccggaaagcggaagtcttctgtatctgactcttctaagccttctaggtcaaagtccaaaaaagcttcaatggatcgt

SEQ ID NO: 7095 - DNA, 798 bp, Glycine max
ctctgggtggtcttacatcaaaggttcttttacttggaataacttactttctagcatcggagttactgaatattactgaatatgtggggaccatcaatgatgtgtcaggaagggcaaggcttcttctagttcttcctgatgctttcttagatgcatttttgatattatggatttttacatctctttcaagaacactggagcagttacaggtatcttttcctcaaattcctattactttgcagcatacctataaattctctgttttgaatctcttactatcttgttttttcaatattttttattttgtgtgtgtggttctcaggcaaaacgaagttctgtcaagttggatatatataggaagttctcaaatgcattagcagtaactgtgatctcctcagttgcttggattggatatgaggtaaggcttatatttagtttattttatcttgcacaaaaagtagcatgtacttcttgtaatgaataactgaaattgatgttttatccaccaaaaaaaactgattcatatttcactgtttggacactgcactgttgcaaaaccagtgaagaaaaagaaaaattcctggttttaattgtgtttggcactttggcttccatttagttgttgtagaaattttttaacactatttaactataaattgttacgaaatgttgttttctcatggaaatttactgtcatattgctttcatctttcaatttgttatctgggttgcaatcactgctaatttttattttacaggtatacttcaaggctacagatcctttcaatgagcgctggc

SEQ ID NO: 7096 - DNA, 389 bp, Glycine max
tactcgctgaaaacgtggggaatagattgttctttgctggtgaggccacgagtaggcaatacccagctactatgcatggtgctttcttgagtggcttaagggaagcatcacacatttaccgatcagctcggattcaaaacaatcctaggaagtgcatgcctaagaatatcgtaagcaatgacatcctgggtgatttattcaagtggcctgatttggaatttgggaagtttgctttcattttttatccgtctccagaaaatctgcagtcaacggggcttctgcaagtcactattggtgatgctgaagaaatttatgaggagctgtttagcagctacccaaatgcagcaaaatggcccttgcagctgtacactataatatcccgtgaacaa

SEQ ID NO: 7097 - DNA, 1054 bp, Glycine max
ctcagaggagcattgccacgactcaagaagcccatcatatcgattatgaatttatcataccgattatgaatttttcagattaaaagcttctcaatagcatcctgcaaacaaaccaaatgctcagaatacatgttcaataatatatatatatatatatagacataaagagagagatgtgatagtaaataatatagctggcatttggtagctactgcctacaggcaaatcataaatgaaacaacaaagtgcatacctttagttgctgaatttgagatttcaattgactcccttcattagttgtcacagaacaagcaatcactggcctggtgaccccacatgcacgtccaagtgcttgttttgaagggacaaacacgtagggcacattctaaaaaattcatatgattaataggctaacacaattaatagacaaaaaaaaaatccgagtaacatccaattaaaacaaataagctagattggttaagatttacaaagctaactaagttttaccaatattatatctctgcagagcattcataccgatagatatggttcattatcattacactaatttttggtttgtgggtgggttacaaatttacagtggacattgtgagagttgagacctagtgagagtgagagatcacggggaaaataggttatatgtgagcactgaatctcacgtgagagaccaatcgtgatattaggtgccactacactagactaaaaatatgcaagtgggtagaatagtatattatattatactctgttattattatcaagaatcttggcaaagctactacttacggggtacaaaacataaagttcaatgtataagcaatgggaagttaactcagaggaatgaatgcacgtgataagaagaaaattagcataccttatcctcagcaagtagaggaagatgtagaagaatctcaaggggctcagtatcagcagccatcacaacaaattcagagatacccctgttcagggttttagtggctgcaacacagcaagtacactattttacttagcacacacagtgagaagtgataataaa

SEQ ID NO: 7098 - DNA, 709 bp, Glycine max
ttttgtgaggattgtgaggatttggtgaccttgaagtggctatggaactggtgagagaagcactgaagtcaatgctagtttctaatccatttgttcgtatagggatagttgttaagctaggctcgttcgcagatcggctaagacgatgagctcgcttcttgtaccaccttatgccaaaatatatgaggcaagcaatcaaaactccaagggccaccccaacagagacacaaacgataactaaatcagcttgatcaaccatcacttgacctctcttgatattcaagcaactcaatcatcttgcataactctctcactagacaggttcactgccacaaaagtaacaaaatttcaactttttaagctaattcaacactctatcctgctagaactgacaccaattcaacagttcatccaccaccaacttcaaagatgaatctaaacaaaaaatacaaataccaatcaatacacaatattgaaacatctaattattcaacaatcattaacataccaataataagtcactttactctcataaacaacggaaataaaattgtccaccaaataaaccccatcatccataaaactcaaaacccaccaaccaaaattcaaaaacaacaataaaaaaaacttttcttttcaactcagacagcaaaatcaggcgagaaattaagaaccttgtgattcagaaaacagcccccacttttggtaa

SEQ ID NO: 7099 - DNA, 200 bp, Glycine max
ttctcttctcactttccttttcaaactccaaccctccgttttcagaaatctccattgtcacgccccatcagagctctatcttcctccgccctcgtccaaacatctactaccaaggccactgaagaccaaggtcaccacacacttttctcgtttttctctttcactttccttcccacttctcagcaaccaaactgattttt

SEQ ID NO: 7100 - DNA, 381 bp, Glycine max
aatattaaaaggaatgaggaaaatgattatgatcctgtgcttagtgagcttaaagctatgacttctaatgggaatgatgcagacaggcttgcaatacggattccagaagctaagggttctgggccttctggcagtaatggtcaaatggatgctaaatcaaagggggcttgcatggaaacaagtgaaagtgaccgctgccggggatccaaaaggagaaaatgtggttccgtaaagaggttcaagaaagaactatatgctaatgagcctgctaatgcggaaaatccagttagcatgcctgttggtacagctgagccagaacgaacaagagatgctggtagtggtggcaatactaatcatgccagacctgctagcaatattgta

SEQ ID NO: 7101 - DNA, 813 bp, Glycine max
cccccttcttctgggtgctgcacacagctttccagtgttgtcaggtcacaaccacagtgcctgtgccaggttcttaacgggggaggatcttcattgggagttacaatcaaccaaacccaggccctggctttgcctggggcttgcaatgtgcggaccccacccatcactcagtgcaatggtaagataacaaagtttattcttagatcatcatatgagccaaatatcaaatgagtctctaatcaattaaaatcactaaggtaaagttcaaattaatctaaatctaattcatatgagtaatctttacatatcatgtatcatatataaaaacaaaagtgtcattaacatttttcattagatattatatctatatttttctatctttttgctcgagatgtcgcctagcatctggagttcacaaataatttttcaattcatatatatatcttggtgataattaatttgcatcatgtgtttgtgtacagctgcttcaccagtgggatctccttctcctaattcggatccatcaggtatgtacatgaatgttaattcaacaagttcaggaagtgtgattgaagggagaaagaaaactctttgacattataacaaataaaaaaataagactaggaaagtgatatttacgatccaagttgtccacgtacaacgttaattacccatacaatttcacattaaattgcaggaaccggatccacaaacgtgccaaccacagataatggctcctctagtgcaacttccgtcaagttatcgattcctctgatgttttttgttcttgcagcaacatatgctccaacgtcg

SEQ ID NO: 7102 - DNA, 375 bp, Glycine max
aagtgtgtctttacctacctgtgccaaaacaaattttatataaaaaaaagttttctttattcattttgtactggatttcgtattttccatgtcaagaatgacattggtgttttgtttttttggtaattgtgcactcatttccctctcttttctttgtagttctggattagcagaagtgagctgttctgggattataagatatcaactgtcagtgctgacgtgatcaaactggcaggtagatcttagtgtttccctcatagtacagagcatggaaacaacaagatcggtgttatttattgtttgtaacttaccttttagattaactacccttgtgggtagaagtagaggtttgattcgactggtaaagggaaattg

SEQ ID NO: 7103 - DNA, 453 bp, Glycine max
ttctgatcgaactatcctcttcccattgtgggaatagatgcagcagaagtaagactgcaagaagcacttattcaaatgtggcgacaagaagcagcttcaagagctgcaatggaaaatggaaccgaggaagggcttggagactcatctgaatcagcccctattgcctttcctcaagacatacaaatggaggaaaggcctgaacctgttaggaacaacccacctcacggtactcggcgctaccaggatcagatggtcccaagtattacttcttcccatgtgagagtggaagaggaagaaacatcttcagaccttcgaaactcggctgcagacagcagagccgaagtgcctataaatgtaaccacacaacaaaatgcaagagagacagtgaatcaaggggtgttactgaatacaaatagaaacactcgagtacagaataatcctacaacgtggctg

SEQ ID NO: 7104 - DNA, 586 bp, Glycine max
gtgatcttttgcatcacccctggatttgtaattatggagccaatggtgaattttttgttaagtttgctgccaatatatttttctgcaggctgtttccaatggaaaatatatcgattggtgtttggagatgcttgtgaaaaattttgtgccgcctttttacctcttagattctctgagacaggagaacggaattgaaagaaaaaataaagttctgtcacgggtacatgcagcattgaaagaaatagctgatttggtgcctcttgcacccttgcgactatctccaatagttatccagaaaatgccgagtgtcttcagtaaggaaactgtgagttcatacaactttctctggatactttaaatgagtttgatgtatcaatcagcttgatgccaattgtcattatacattttttgcttgtcattttacattcagtatcttagctgttcagtatttccacttgttttttatatatatgtaatgtatgggcattgtttacttttatgttatgcattatgcaggatctgttaagactccatttccttggccttgaattattttatataacagacaatagataccatttttttt

SEQ ID NO: 7105 - DNA, 666 bp, Glycine max
tctggatcagcaacagtaccctcggaatctataactgctactgcacttacagatcaggagcagcgaaatactttgaagtttgggttttcttctaaaggcagtgcttccaaggtatgtccacctggtgtctagggttggaaaagaaactagcaattgccctttgtagtactcaggagtttggaatgcttacagattttatccactcgagttcttgatgctgttttgttccacaattcaagtcttaaaaacattttcaaccctgccaatccatttagtgttgcttttgcataaaacatttttatatgttatcaccactttcttttcccgaatgccacgcagattacgtttggagccaagaagcaaaatgttgcaaagaagcaaaatgttccgatctcttctatattcagtaatgatagcgatgaagaataatggaacattactcgtgaactgacataccggcatgatggcgtatttcctgtgtggtttggcttgtgttaactgttttatttaatatttgtcgccatcctcagttcaagaggaagaaaacatttgggattacatgatagtttggagtttggtagaccaaaaatgttacctgcttatctgtgagatcatgttatgtgtgcaaggattttatgtttacgtgagtaccgtggttatgttagc

SEQ ID NO: 7106 - DNA, 423 bp, Glycine max
cccctcagacgaagaagtgattctagcgtcagcgcggccaaagaagcgagcgggaagaagagtcttcaaggagacaaggcaccccgtctaccgaggagtgcgtcgcaggaacaagaacaagtgggtctgcgagatgcgagtccccaacaacaactcacggatttggctcgggacatacccaacgcccgaaatggccgcacgtgcgcacgacgttgcggcgctcgcgctcaggggaaagtccgcgtgcctcaacttcgcggactccaggtggcggctgacggtgccggcgaccaccaacgcggaggagatacggcgagcggcgggggaggctgctgaggcatttgcagttgcagatggggacgacgttaatattgaacaacagcagagtgtgatggccacgaatgatgatgaagttcaagagca

SEQ ID NO: 7107 - DNA, 401 bp, Glycine max
aaatttattgacaatgatgtttcaaacgatacagtggactgtgattctgactggcagcagagggaagaacttagcagcaagaaagttgaagatacagagagagatgcaatttcagaggattctttggatgttggttctcttcagttgcttaggaagaattccagagccaagcatgccaaaaacataagtcaagaagatataatttctgatgaccaaatggagagtcctttgcaaaagcggcaaaggagaattcctaaaagcaggcagggcaaataccttactggaaaagatataatatctgatgaccaactagagcataaaaagaagaagcagcaacggaagaatcctaaaagcaggcaagccaaatacctcaatgaagaggatattgcatcagatgacca

SEQ ID NO: 7108 - DNA, 340 bp, Glycine max
cttagtttttcccttgggtggtgaatgaaggatactttaaggcttggagacaaggcagaacagggtaccctttggtggatgctggaatgagagagttgtgggcaactggttggttgcatgatcggatacgcgttgtggtttcaagtttcttcgtgaaggtgctgcagcttccttggagatggggaatgaagtatttctgggacacccttttggatgcagatcttgagagtgatgctcttggttggcagtacatatctggcactctccctgatggtcgtgaacttgaccgaatagataatccacaggtgcatttgcttctgtgtataaactacacaatctt

SEQ ID NO: 7109 - DNA, 684 bp, Glycine max
gagttctggttacctcccttagtcaagtcatgacaaaaagtaatggaaagagtatccgaatagtcaatgatgttgcagggcatattatgatggaaactttatatggtgatagtcttaggcttcagcaggtcttggctgactttttacttatttccatcaatttcactccaaatggaggtcaggttgttgtagcaggctctctaaccaaagaacagttaggcaaatctgtccatcttgttaagttagagctcaggtaactcttccacgctcgcattcccactgtgtatgtgatttaaatgcctggcggaaacactgtgccataaattgttgcatgatcaacacattgttctcttgtgctaggcaaagaaacttgcattgtttatgcggtcttgctaaccattaaggacactgattaaggaatcaacaagtggttgagattatacgttttctaataaaaaacttttcacttttgattccttaaccagtgtcctgattaacattttccttgttttcaaccaaaacataaagaaggaagttacactataaccttgatttacttctaagtaagtgttacttttggtatttatgtagcataacacatggtgggagtggggtaccagaagtgttactgaatcagatgttcggaaacaatgggctagaatccgaggagggtattagcctact

SEQ ID NO: 7110 - DNA, 390 bp, Glycine max
  misc_feature (59)..(61): n is a, c, g, or t
taaactcaaagcactgacacatacaaacaaaaagatctggctttcataaaattgagatnnnagtgcaccgtctccgaatcatgtttataatattatcttcattagatcttgatctcatttttcatctgaaactaaaagaatatatatgtgcctttaccctatttagctatatgcacacacaacttgtcacatatcatattttgttcatcaagtttataattccttatctttgaacttacttacatccaagtaaggtctaagctagctggagttgattagatctagctagctagttttcgatctgcttaatttgttttccatgatctcttatatatagtaattttatttccctttaattaattaagaaagagttgaagaagaatgggaagg

SEQ ID NO: 7111 - DNA, 1069 bp, Glycine max
agaaaaccaaaagctactagcattaaatttctatgcctctttgatcaggttgagggcatcagcctctgtgggaagagcaggaattgctccctttttagtagttgtaattgctccacacgcatttgcaaacttgagtacttcccttaaccttgcttcatcctgcagttaacatgtgaaaaatgattagaaaaaaaaggctttacaaaacaatacacttaaaaattcataacaataacttcatttccaaactcctcattttaaacggggcgggcgtagttaaagcactcacttcaagtacggattgatcatcgacaatcttgcttaatagagcaccaacaaaggaatcaccagcgccagttgtgtcgaccgtgctgacatgaaaagcctccactgatccatggaaattctggtttgtgcaaaaaaaggagaacaattattgcaaatagaaaaagagtgatcagccatttgacatactctacagaacataaccttttaatttgggtaaaatgtaaatatcataatgagaacatgacagtaagaaaatccaaatgcagaaaggaaagtttattcataaatgaagcaagtcatgttatttgctaacagaagttgtttggggccacaaggcacagcaaatagatggatatatcatataggctcatacagatgaaaaacatgatatgttgtagcagtactacagaatattaaaaccacatatataactttgattgagtcattgagttggtacaaggaatttgtaccctttaaaaataatttttttaaaaaaaggaaaatgtgggaaacaggatgacacatgggaccaaggaggttgcacgcatttatacgagtgcctaccatccattgatagctaaccaaacatctgtgatagagtactactatgaactggacagaactaggacttaaaaatttgaagaatggacaaaatatacaacaaagattggaaagtaaaaaacaaaaaaggataggtaaattgaaagagtagagtgtttttaccttggtatagtatctagagccatgttcgccaagagtgacaaggagcaactcaaaatgg

SEQ ID NO: 7112 - DNA, 670 bp, Glycine max
cacaccagcattttcagcttgggttggagtttgacaactccaaacctgccttcagttacaatggttctgttagtcaaagtgtaagccttccaaattccattttactctctctcttttctatcttttcaaaacactgggaactctaaatgagaacatttttctcactacactcaactctaattggatgtttttacaataaaataaaatcagtataaattttggatccaacaacggcagaagttatttaaactttttcaagtttctaacccaatcaattttaaattattttttaacatgaaatcaaacatatcaaaatatattcaaaactaattttgaattcatcagtattatgtaaccaaacacgcatcaagctcttaggtggggaaattggaggttttcattttatttcggtttgactcgggatgtggaaaatattatatactatgaactacatgtttcttcttttggggtggtggttttcttgcttttggtcttcccatgacatgtttttgccaaagatggattcacaattaagtagtttccattcatggcatgttcaatgccaacttgaactttctatttaccttgtttttggccgggtttatctacataatctgtctttattggattgttttccattaatttgacttgttccgagctcgtgtttcat

SEQ ID NO: 7113 - DNA, 410 bp, Glycine max
cctcctcctcttcctcaagacaaccacctcgacgaaatcgaaacggctaacaacaacatcaacaagcgcctcaagccatctccagcggaatcagcagactccgccgcgtctgagcccacgcgccatgtcgtcctcgttgaccatcaggaagccggcgtgcgtctcgtccacactctcctggcgtgcgcggaggccgttcagcaggagaatctcaagctcgcggacgcgctcgtcaagcacgtgggcatactcgcggcttcccaagccggcgccatgaggaaggttgcttcctacttcgcccaagccctggcgcgtagaatctacggaatcttccccgaagaaaccctcgattcctccttctccgacgttctccacatgcacttttacgagtcttgcccttatctcaaatt

SEQ ID NO: 7114 - DNA, 456 bp, Glycine max
  misc_feature (388)..(389): n is a, c, g, or t
  misc_feature (391)..(391): n is a, c, g, or t
  misc_feature (393)..(395): n is a, c, g, or t
  misc_feature (398)..(400): n is a, c, g, or t
  misc_feature (414)..(414): n is a, c, g, or t
  misc_feature (416)..(416): n is a, c, g, or t
gggagacagatttgcaacgtggtggcttacgagggcccggaccgggtcgagcggcacgagactttgactcagtggagggggagattggactcggccgggttcgacccggttcatctcgggtccaacgcattcaagcaagcgagtatgctacttgctctattcgcaggcggtgatgggtatagggttgaggagaataacggctgcctcatgcttggctggcacactaggccactcatcgctacctccgcttggaagcttccctcctccagcgagtctagtggcttgactcagtgaatgtaaaactatagattaattggacttgttccagtgaactgagtcagtgaccgagtcagtgagccttccaggcagcaagaggataaataaaagnncnannncgnnntcactaattcattnangcccgatttcccccatctcactctttgtagtatttctgcg

SEQ ID NO: 7115 - DNA, 757 bp, Glycine max
ttgaagttccatgcttgttcgcctgattcgatactatgctggtatgtgggacacaaagtgtggaactttgaatattcttctttgttttgcaaaattttagtgacacctgtgttttcatgttccccaggttgggcagataagatccatggtctaacagttccagctgatggaccatatcatgtgcaaacattacatgaaccaattggtgttgccggtcagatcattccttggaacttccctcttctcatgtttgcctggaaggttggaccggcattggcctgtggcaacaccattgttctcaaaacagctgagcagacaccgttatctgctttatatgcagcaaaactatttcatgaggtgtgtgatagtggtatagaccaatcttcattttgttagaagcatggtttttgtggagtttaatttactcatgaatatcttcaatcctcatcattcccaatttgtaatctgtctggcaggctggacttcctgctggtgttttaaatgtagtatctggctttggtccaactgctggtgctgctcttgctagccacatggaagttgacaaggtactaaaatatttagcatctgcagtagtggagaagtgtagtgattttattgttggcatgcaatagtttctgtaaattctatggcaattaatttcagtttccttatcttgtgaagaagtttgaatgtttgatatgatcattttcattctaatggattattagacatctagacttgatagtgtcttaacagc

SEQ ID NO: 7116 - DNA, 642 bp, Glycine max
aaggattatcaataattcaagttatatgcttgtattgtctcttgggtaccattatttaatttctctatatttttaataggctgaaagtcaaaatatccgtgctaatgtgcttcttaaccgaaagcgtgagaaggtgaatcggaagtatactccagctgtggagaggaggcgtcaactttctcctgggtttttagaggatgctttggatgaggtatggttttaggatttgtttcctccctagatgtctgtttcttttttgcttatgtatctactgtagttttctgtaagtatgtgtacttcacactatgtcagttccattatttatccgggtttctttccttcaggaggatgaagcagactattatgataatcatcgttctcagcgccgctttgaggatgatttggaagtggaagcccgagcagagaaacgaattatgaatgctaaaaaggtactatttctgtctccagaaatttgtacatacgttgattgtttttacatttacattgacgagggttattttctggaattttagtcacggggacctaaagatatccctcgtaagtcttccttcccacctgctaaatcctctcggaacccaatgggttacccagatgatgagagagaggagtctgagtagaaac

SEQ ID NO: 7117 - DNA, 580 bp, Glycine max
actgctcaagtaacctagccaagttaaatagtacagtgactttatcccaaggtacttccacatggtgaccattgctttcaaggtcatgaaataattgcatgtccttgaattgaagagtagaagtagcagcatcaatggaagacttattttcctcattgatgaaagatagccaaacaccatcacctagtgcctccttaaatgtttgtcgagcaagctaaaaatttgaagaaaatagagcttagcagtaagtgtgcaggggaaggagccataacatgagctttgcttcattttaaacaggagtacaaacctcaaattcccccctttcaaactgaagcacgccaatattattgagtaattcaattggtacttcttgacctcccttcttaaatagagtatgagcctgcaccagattacaatatctagattataacagattatggaacttcaaaaatgaagtctttcattaaatttcacaaagataacatttccaaaccacaaaagaacagcataagataagctcttagtcccttacagttttgaatgcatccagtgcagctcctgtgtcagaaagaattaacaa

SEQ ID NO: 7118 - DNA, 167 bp, Glycine max
tggcctccaccctccgctccggttccaagttagtcccactctcagatccccccctaattaacactttctcttctttctttaaacaaaaatcacgcattcacaacttttcaattcgattctcaactccacttaccactttgatctacccttttgcgattttattatta

SEQ ID NO: 7119 - DNA, 229 bp, Glycine max
gggtttcatgttatcaattctgctgttcactctttcatattttttgaaagaaaaaaatattgcatgtctgtgtcattctataatgttcaacggttttgcaatccatgtcgaaattctaaattagtccacctgaattttgctcacgttttgtggaacttgttatttctggtttattgtttgatgttggcacatattctctaaattttgactttatttgttgggattcttc

SEQ ID NO: 7120 - DNA, 176 bp, Glycine max
ggccaaagcttatgtggtcgtaaatgactcttgctatcatcaactcatgagccattggttaaatactcaagcggtgattgagccattcatcatagcaacaaaccgacaccttagtgctcttcacccaatttataagcttctaactcctcactaccgtgacaccatgaacatcaacg

SEQ ID NO: 7121 - DNA, 3463 bp, Glycine max
  misc_feature (188)..(188): n is a, c, g, or t
cgtgtcgacggcccgggctggtaaaaatctattatatattgatcaactaaaatatttttatatctacacttattttgcatttttatcaattttcttgcgttttttggcatatttaataatgactattctttaataatcaatcattattcttacatggtacatattgttggaaccatatgaagtgtccnttgcatttgactatgtggatagtgttttgatccaggcctccatttgccgcttattaattaatttggtaacagtccgtactaatcagttacttatccttcctccatcataattaatcttggtagtctcgaatgccacaacactgactagtctcttggatcataagaaaaagccaaggaacaaaagaagacaaaacacaataagagtatcctttgcataacaatgtctaagttcataaaattcaaacaaaaacgcaatcacacacagtggacatcacttatccactagctgatcaggatcgccgcgtcaagaaaaaaaaaactggaccccaaaagccatgcacaacaacacgtactcacaaaggtgtcaatcgagcagcccaaaacattcaccaactcaacccatcatgagcccacacatttgttgtttctaacccaacctcaaactcgtattctcttccgccacctcatttttgtttatttcaacacccgtcaaactgcatgccaccccgtggccaaatgtccatgcatgttaacaagacctatgactataaatatctgcaatctcggcccaggttttcatcatcaagaaccagttcaatatcctagtacaccgtattaaagaatttaagatatactatgatgagagcgcggttcccattactgttgctgggagttgttttcctggcatcagtttctgtctcatttggcattgcgtattgggaaaagcagaaccccagtcacaacaagtgcctccgaagttgcaatagcgagaaagactcctacaggaaccaagcatgccacgctcgttgcaacctccttaaggtggaggaagaagaagaatgcgaagaaggtcaaattccacgaccacgaccacgaccacaacacccggagagggaacgtcagcaacacggtgagaaggaggaagacgaaggtgagcagccacgtccattcccattcccacgcccacgccaacctcatcaagaggaagagcacgagcagaaggaggaacacgaatggcatcgcaaggaggaaaaacacggaggaaagggaagtgaagaggaacaagatgaacgtgaacacccacgcccacaccaacctcatcaaaaggaagagcagaagcatgaggaaaagcacgaatggcaacacaagcaggaaaagcaccaaggaaaggaaagtgaagaagaagaagaagaccaagacgaggatgaggagcaagacaaagagagccaagaaagtgaaggttctgagtctcaaagagaaccacgaagacataagaataagaacccttttcacttcaactctaaaaggttccaaactctcttcaaaaaccaatatggccacgttcgcgtcctccagaggttcaacaaacgctcccaacagcttcagaatctccgagactaccgcattttggagttcaactccaaacccaacacccttcttctcccccaccatgctgacgctgattacctcatcgttatccttaacggttagtattcctttcctctcaaaataaaataaatgtcattattttatgcggattaagaaaaattattaaataaataaaaacaaaaccaacaattttataaaaactaatcttactatgacacttatttaattaattaataaacatcatcacatgcttttacttctcataaaattatgttattgaatttgttttgttaattacagggactgccattcttaccttggtgaacaacgacgaccgagactcttacaaccttcaatctggcgatgccctaagagtccctgcaggaaccacatactatgtggttaaccctgacaacgacgagaatctcagaatgataacactcgccatacccgttaacaaacccggtagatttgaggtactacttattctttataactaattaattaattattattctaatttgtttccaaatcttaagatcaatctttttcttttctctgcagagtttcttcctatctagcactcaagctcaacagtcctacttgcaagggttcagcaagaatattctagaggcctcatacgacgtaagcaaccaacacaccatctaatacgctagcaaattcaatattatcattatccttatatttgtttccgcgcttgattttatagaccaaattcgaggagataaacaaggttctgtttggtagagaggaggggcagcaacaaggcgaggagaggctgcaagagagtgtgattgtggaaatctcaaagaaacaaattcgggaactgagcaaacatgccaaatctagttcaaggaaaaccatttcttctgaagataaacctttcaacttgagaagccacgaccccatctattccaacaagcttggcaagttgtttgagattaccccagagaaaaaccctcagcttcgggacttggatgtcttcctcagtgttgtggatatgaacgaggtaagcagaaaaactgaacatgacaattgagttctattcactttcttcttagttagagaaacctattcttgagactttaaataatgatttacttttttctttgttcacaaatatagggagctctttttctgccacacttcaattcaaaggccatagtggtactagtgattaatgaaggagaagcaaacattgaacttgttggcattaaagaacaacaacagaggcagcaacaggaagagcaacctttggaagtgcggaaatatagagctgaattgtctgaacaagatatatttgtaatcccagcaggttatccagttgtggtcaacgctacctcagatctgaatttctttgcttttggtatcaatgccgagaacaaccagaggaacttccttgcaggtacatattttgtatatcacgatcaaatagaacatgctgttgaagtgttgttactttttttgttttattaattacatgtgaaacatagctgactgagctatttctaatcctttggtgattgaaaatttgaaggttcgaaagacaatgtgataagccagatacctagtcaagtgcaggagcttgcgttccctgggtctgcaaaagatattgagaacctaataaagagccaaagtgagtcctactttgtggatgctcagcctcagcagaaagaggaggggaacaagggaagaaagggtcctttgtcttcaattttgagggctttttactgaataagtatgtagtactaaaatgtatgctgtaatagctcatagtgagcgaggaaagtatcgggctatttaactatgacttgagctccatctatgaataaataaatcagcatatgatgcttttgttttgtgta

SEQ ID NO: 7122 - DNA, 175 bp, Glycine max
ggccaaagcttatgtggtcgtaaatgactcttgctatcatcaactcatgagccattggttaaatactcaagcggtgattgagccattcatcatagcaacaaaccgacaccttagtgctcttcacccaatttataagcttctaactcctcactaccgtgacaccatgaacatcaac

SEQ ID NO: 7123 - DNA, 3462 bp, Glycine max
  misc_feature (188)..(188): n is a, c, g, or t
cgtgtcgacggcccgggctggtaaaaatctattatatattgatcaactaaaatatttttatatctacacttattttgcatttttatcaattttcttgcgttttttggcatatttaataatgactattctttaataatcaatcattattcttacatggtacatattgttggaaccatatgaagtgtccnttgcatttgactatgtggatagtgttttgatccaggcctccatttgccgcttattaattaatttggtaacagtccgtactaatcagttacttatccttcctccatcataattaatcttggtagtctcgaatgccacaacactgactagtctcttggatcataagaaaaagccaaggaacaaaagaagacaaaacacaataagagtatcctttgcataacaatgtctaagttcataaaattcaaacaaaaacgcaatcacacacagtggacatcacttatccactagctgatcaggatcgccgcgtcaagaaaaaaaaaactggaccccaaaagccatgcacaacaacacgtactcacaaaggtgtcaatcgagcagcccaaaacattcaccaactcaacccatcatgagcccacacatttgttgtttctaacccaacctcaaactcgtattctcttccgccacctcatttttgtttatttcaacacccgtcaaactgcatgccaccccgtggccaaatgtccatgcatgttaacaagacctatgactataaatatctgcaatctcggcccaggttttcatcatcaagaaccagttcaatatcctagtacaccgtattaaagaatttaagatatactatgatgagagcgcggttcccattactgttgctgggagttgttttcctggcatcagtttctgtctcatttggcattgcgtattgggaaaagcagaaccccagtcacaacaagtgcctccgaagttgcaatagcgagaaagactcctacaggaaccaagcatgccacgctcgttgcaacctccttaaggtggaggaagaagaagaatgcgaagaaggtcaaattccacgaccacgaccacgaccacaacacccggagagggaacgtcagcaacacggtgagaaggaggaagacgaaggtgagcagccacgtccattcccattcccacgcccacgccaacctcatcaagaggaagagcacgagcagaaggaggaacacgaatggcatcgcaaggaggaaaaacacggaggaaagggaagtgaagaggaacaagatgaacgtgaacacccacgcccacaccaacctcatcaaaaggaagagcagaagcatgaggaaaagcacgaatggcaacacaagcaggaaaagcaccaaggaaaggaaagtgaagaagaagaagaagaccaagacgaggatgaggagcaagacaaagagagccaagaaagtgaaggttctgagtctcaaagagaaccacgaagacataagaataagaacccttttcacttcaactctaaaaggttccaaactctcttcaaaaaccaatatggccacgttcgcgtcctccagaggttcaacaaacgctcccaacagcttcagaatctccgagactaccgcattttggagttcaactccaaacccaacacccttcttctcccccaccatgctgacgctgattacctcatcgttatccttaacggttagtattcctttcctctcaaaataaaataaatgtcattattttatgcggattaagaaaaattattaaataaataaaaacaaaaccaacaattttataaaaactaatcttactatgacacttatttaattaattaataaacatcatcacatgcttttacttctcataaaattatgttattgaatttgttttgttaattacagggactgccattcttaccttggtgaacaacgacgaccgagactcttacaaccttcaatctggcgatgccctaagagtccctgcaggaaccacatactatgtggttaaccctgacaacgacgagaatctcagaatgataacactcgccatacccgttaacaaacccggtagatttgaggtactacttattctttataactaattaattaattattattctaatttgtttccaaatcttaagatcaatctttttcttttctctgcagagtttcttcctatctagcactcaagctcaacagtcctacttgcaagggttcagcaagaatattctagaggcctcatacgacgtaagcaaccaacacaccatctaatacgctagcaaattcaatattatcattatccttatatttgtttccgcgcttgattttatagaccaaattcgaggagataaacaaggttctgtttggtagagaggaggggcagcaacaaggcgaggagaggctgcaagagagtgtgattgtggaaatctcaaagaaacaaattcgggaactgagcaaacatgccaaatctagttcaaggaaaaccatttcttctgaagataaacctttcaacttgagaagccacgaccccatctattccaacaagcttggcaagttgtttgagattaccccagagaaaaaccctcagcttcgggacttggatgtcttcctcagtgttgtggatatgaacgaggtaagcagaaaaactgaacatgacaattgagttctattcactttcttcttagttagagaaacctattcttgagactttaaataatgatttacttttttctttgttcacaaatatagggagctctttttctgccacacttcaattcaaaggccatagtggtactagtgattaatgaaggagaagcaaacattgaacttgttggcattaaagaacaacaacagaggcagcaacaggaagagcaacctttggaagtgcggaaatatagagctgaattgtctgaacaagatatatttgtaatcccagcaggttatccagttgtggtcaacgctacctcagatctgaatttctttgcttttggtatcaatgccgagaacaaccagaggaacttccttgcaggtacatattttgtatatcacgatcaaatagaacatgctgttgaagtgttgttactttttttgttttattaattacatgtgaaacatagctgactgagctatttctaatcctttggtgattgaaaatttgaaggttcgaaagacaatgtgataagccagatacctagtcaagtgcaggagcttgcgttccctgggtctgcaaaagatattgagaacctaataaagagccaaagtgagtcctactttgtggatgctcagcctcagcagaaagaggaggggaacaagggaagaaagggtcctttgtcttcaattttgagggctttttactgaataagtatgtagtactaaaatgtatgctgtaatagctcatagtgagcgaggaaagtatcgggctatttaactatgacttgagctccatctatgaataaataaatcagcatatgatgcttttgttttgtgt

SEQ ID NO: 7124 - DNA, 1019 bp, Glycine max
ttgaagctgaaggcaagaaatgttgtggtcaggcctttcaaaccaacaccttggggcctctttaaggccagggctttatggagtcttcataccaaagatttatcagcagctttgtagtggtatccaatcccgtggaacaggtctagagttatcattcttttttaattaaaaaaaggcaacactacacaaaaaagctttggcattgtgctcagtttgcagccctttggtgtatatggttggaaagaaatgctagaattttcactggttgatggtcttcttttgagctcatttgggattgagtatatattttcgctttcttgtggtgttctgctaatggtcttttcagaggagtgtctttgtttgatcgttagagagatcgacatgttttgttacatgtctttgctttttctttttttcttttctttttccttttaccttctcttttatctactttccccttgagggtttcttatccttcaattttgtgtcctgctcttaataaattctgtttataaaaaaaaaaaagtcaatactatgtcctgtcaaatgagccaacataaaataaattggtgaataaaataaagataggaatttgttcttgtgttggcatctagtctttgaaagttattaagagatgccaaatggaaagcatgttggcattgtggttatgtttacaaatgatgattcaataataatcttgtagatttaactgtttattcttgactgatttttaagtgagttatgcatctctatattattacatatgcctgtattgtccattatttagcattgggttgttaattgtatatattaaattcctttttatttacaggtacgtgtcaatggacctgatacagcacctgtctacaaattccttaaagcaaataaaacaggatttctggtagtaggataaagtggaatttcactaagtttttggttgacaaggaagggcatgtcctcgctcgttatggtccaaccacctcaccgttgtccattgaagtacaatctctctctatttc

SEQ ID NO: 7125 - DNA, 2875 bp, Glycine max
  misc_feature (192)..(192): n is a, c, g, or t
  misc_feature (322)..(322): n is a, c, g, or t
  misc_feature (1573)..(1573): n is a, c, g, or t
tttttttctatttttaattgttgtttttttcatgttgatataatagtttgtttctatcttaagtaaaatattgtattagccttaaattcattcattgtattttaaggtggaaattgaatgggttggatcaagtgttacttaaatatgattctatttttaggctccagtctcgacctttgtaaaaaccaatcncgtcatcaatccatttaaaaatctatttcatatcaaaagtgcaaaaaaaaaaattaaacaagatcaaaggttttcattaaaaaataataagataattttaaactaaaagatagggataaattttgcctanggacatgctaccaaagtcttttaagtctcaccacagaaaaaggctatattattgatactcatttgtattacactaactaaaatgattcaaatcgtcaaactattaaaataattttataatttaaataaaataattataaaattatatattatatcaataatgttttattataacatattattgttaaacaaaccaactcactagacttaataagtttttattaagtttatggtttgatctattcaactaaatagacttttaaaaagcttgaacttattatatttgttaaatgagttgagttaggccaagccttaaactagtcgagtcataggctcttgacaagtcgtccgcctacttccacccctaattgtattaatcaaatattattataatttgatctatttgaaagacctaatcaatttgttattcaccaattctaaataattatacgctctacaaaataaaaataaaaatataaatgttttaaatatgaatgatccaacttaatcaaatctttattatgaatgagttggttcaaaatgagattaacaatgaaagtatataaatctaactcaactcagtaaaaaattttatgggtcgggcaataagtttagccaaacttagaccaacccaaatagcaaacatccctatatttgaaaaaaaaaatgttacagttaagaaaattgactattaaaactaatttataaaaaaataacatttcttagtgtgttttgaaagtaattttttaaaatgttaaattacaacttcaaaacttgtttttgcaacatcattgctcttgcctaatctatttagtatcaagtatagcctatatcaattatcaattattaaaaaaaaaaacataggtttgtatcttctcttgtaaacaaaatggcatagcaatcataaaattatgctatataaggttgaaggtttgtatcaactcactcatgagtagaaaataagaatagttgttaaattatgatatattttagtgaccaaaattagggtggatcactttaataagtggtccattttagaccatatatttttaacattcgattaattttattatcacatgaacactatactagattcctcctacctccttccaacaaattcgtcaggcacttttctattgtcggaggcaattttaaaggtgatgtttcttttttctttttcactcctttctcttggacgatctttctaatgtcaatgaattgaccaacgagtatcatattcaccagttgcacnaaatatagtgcccatcatctccaagcaacttcttcgttgcttctgctttcgttccaaatccacaccatcccctccatggattcaaaaattcaaatccaacatgatgcatcatttatagtttcaatcaccaccgtcattctctgctccgatgggtcaaaactcaaaaggctttatccgcgacacaacaaatatgatttgattatacttcagtcagtcatatgccgtgtcgctcctttcaccaatgctaccaaatgataaatgatcttcatttctccctcattcacttttaattcccaagtgtctctccccttttgaatctcacatttaatatcacaattatattatcatggttagataaatatatgttttaatctaaccatcatatactcacgaatgatgataaatttgttataagaaatatacggtaaataataacattaattgttataagaaaaaaaatatcatgtaagcatgatcttttctttgtatccatcattaacttttttattttagttatctacaaattatttttttcataagttatagagagtaattcgaaatttctaataaatctatgtatctgggaaaaaaaaaaaactagtttcagcacctacattcaccaacaaatacattgggacgggacaaaggcaaatggagtgtgaagatgggagacgaggttctgatgtgaaggtaattttattgggcctgttagttaatcgacaactaattaattgggcctgttatttgaccgacccttaacctaaacaacaaaagcccagtcacaaaacccattagggttttccacgatataatagaaactgaaagcctcttacagttgcagcaacagcagcattcactgaaagcactcagtagggtttgcggtttcagagtttgtgacgcacgcatccatggccaccaccaccaacgccgccgcagccccgccgcgccagctctcccagaaggaagccgacatccagatgatgttagccgccgacgtccacctcggcaccaaaaactgcgacttccaaatggaacgttacatcttcaagcgccgcaacgacggtaactgaacttttctcgttctctcttttatcatctcgttaaaaaaattaaatttcaatggatgtttgaatctgcaatagctgtaatagaggaattgaattttgatttgatttggtgtggtttggatttgggaattagggatttacattattaaccttgggaagacatgggagaagcttcagttagcagctagggttatgtgcaattgagaaccctcaggatatcattgttcaatccgca

SEQ ID NO: 7126 - DNA, 2081 bp, Glycine max
  misc_feature (201)..(201): n is a, c, g, or t
catcaaaaagtaggactaatttaggaaagcaagctaattcaagaaagtgaaggcacgcttagtgtgagacacgtgttgagcgcgattactgccagactcactaaccacacaagtgcactcagtgcgaaggttgcttaaaaattaagttgattcgcacttataaaagaaggatagagatgaaggaaaaaacacagaaaatanaattccttatagaagacaaaggctagaagaagcaaacgcaaacattagaagtcattccttccctcaattccctttttcaatttccccttttactaaatattctcctcttgcaattataaagcctcctatgacaatgacaagctaaactctcctttgttgggaacttatcagtcaactgctcttaatataatttctcttcctatctattatgaatattcactacaagaaatatgcccatttgccagggatttttgacagggacattaacccctggcaaatttcccagggactaagccaaggaaacccctggcaaaatgacatttgagaaggctgggaccacttacatttacacaggggtttgtccctcgcaaaaatacaaaagccttggcaaaaaaaagagcgggaaatgaattttaaaacagcatgttgttttcacacggccaaacacacgggtatgccctcgttttctgtaaagctgacggaatcttcccataagtcaacacgacatgaccatgcactgcaaaaagctgtgcggcccagacgtgacaggggtgttacccctcggaaatggcttgcagcccctggcaaaaaggaatccctgctttcctagctgcaccgttctgctcatatagctgaagctaggaggttagcctttgactctgttgttttgcgaggggcattccgtgagttattccctgggtttttttacactatatagccaaaccgcgtgtttatcctcatgctcagtgttgtgtttttgaaacttagaaaaattttcggtttccatttccatcctcaccagttcattttcagtccattatcattcagttcatacacttgttctataatttggtaacactcttttcacttattatatttttctgtttttatttgttactacttattaacataaatattttttattgtatcagtgtccaaatttgcctcctcctgctgctccttgctctctgaatttgttctcttaagcttcaacaagttagtaatttttctacttataattttagatatatgatgtttatatatatgatgttataattttgcatgatctgtcaaagaaaatatgatgtttctacttgcatgatgtgttataatatatgatgtttatatatatttcgaattttgttgttaataaaactgtttaattagaaactgtataatttttttgtttaataaaactgtttaattttgcatgatctgtttaataaaactgtttatataaaactgtttatatataatatatgatgttaacatttttaaaactgtttataaaacagtttagttagaaaaaatgttaaaactagagaaaaaaatgtataataaaactgtgtcagtacagcagcgcgtcagaaaagtgtgcagatgcgtcagtgagaagacaggggctaagacagggattttgacagggattttgccagggattttgccagggtcagcccctcgtttttttgccaggggtgaaatccctggcaaactgatttgcgatgggcgtttttcccagggattcagcccctggcaaaatccctggcaaacgtccatttcccagggctttttgttcttttcccagggaatccgcccctggcaaacgagcttgtttcttgtagtgattacttttgcattagtttttcctgtatttaattttattgtttatggcttgattacccatttgcattataagttttaggggtagcgttgaaaagtgttattctctaatagaactggaaaagagtatttaaataacttcatcactagggatacattgattttatttagcttattatatatctctattattaatgtaatttaactattttatctctgcaaagtgatttgggagagaagatagataagttagactcttt

SEQ ID NO: 7127 - DNA, 423 bp, Glycine max
ttttggaagattgttttgttatgaaaggggagcagaacatggaacactatgcagcaccagaacaatatacaaaatcgaaagatgaagaggcagcaaaaacagagcatgcagtggaaccaaacaaggaagaacgtagaaggtcaaaaaggaaaatgaacaagcctcagtacctgaaggactatgcaatgaagtatggatgcgctggcagtagtcttctagaaacagaatcccaaatctttgtgtcgttagatgttgtctcctggtagcagtcttctagaaacagaatcccaaatctttgtgtcgttagatgttgtctcctggtagcgttttgattttcctccaaggcacatgctgccaaaatctgttaaagaattttcatccagaattgtttaagaacatctataaatatgagaggggatgaaa

SEQ ID NO: 7128 - DNA, 1049 bp, Glycine max
  misc_feature (63)..(67): n is a, c, g, or t
  misc_feature (994)..(996): n is a, c, g, or t
cactctttagctagcattagcatggcacaacaccaattacgttgtgcaatcaactctgtttcnnnnnttctcttcaattctctaactaataactaaaagtagttttttttttcttcgggctgaggcccctccccctgcttctttgaattccaacacaggaacccttcttgttgattacgttacggccgttggccatttttcaaggcgtttaaaaattatgactatcggttcgttttgttggggtagggccgtttcgtttatcatcccccccccgcacttactatttgctctgaaaaaagtttctatttttgaattgattgagtgtgaattcttgaaacgccatcggtctctgtttaaatgaaggttgagctgaactaatttgcatcaccctgtttctaaattgagggaatatgcaattctgggagatctgtgtgttacgtttcttagttattgatattgggtctttgcaactgtctaatttttgttaataattatcttgcctgtcattgcattggataaattattaatcgagcagtgatgatcagaggggttttgacttcatttgattcacaattgattcagttctggcagtttcattattgtaattaacttctgacacgattggtttttgtttctattcgagttgctgatgcttttctggcgttggttgaagataatataatagtataaaaagaatttaattttcatgcactgtcagatgtcaaccaattagaaatcattataagtataacttttaaagtagttcttataaaaatcaacaaagtaccatatgatcaggcaatgtaaaagacctttatactatcagtgcattttaatttaattcaataccgcacatttatgttgaaattattcaatcttgcaattattgtaagtttctcagcgctaccttaaccttgtgttctttgtgacaacagattagtgggtatatgatggctgcgagctgggatggagctaatgaccctggcagccagtnnnacgatagctttcattttgagaggttgcacattgagcctctttatgatgccttt

SEQ ID NO: 7129 - DNA, 262 bp, Glycine max
ggagacagcatcaatgtttgttttctgtttgctaggaagttcgcccctggttctgtgtcgaagctcaccaagattgcacccatggttatgcatttctaatacttccataggcacaaaaacactagttacgagtataaccaattatttcattcattcttttttaccttttaagctttttatttatccggtgtagacttatttcatcaatacagtatgagctatttcattggcttaacggatcttcgtggatggttttacttct

SEQ ID NO: 7130 - DNA, 195 bp, Glycine max
tgaaaaacacacacactctaactgatcgcttttcctttatccgtattccacaaataactgccacttgtcgaaaacaactgcctatgtctgctgatactaaacaataactaccacttgtagaaaataactgtctatttctgatgatactagcaataactgtcttaattgccttttatttttgacataaacctgtag

SEQ ID NO: 7131 - DNA, 407 bp, Glycine max
cttctctcaaagaataagaccgtgtcacatcactggttacagatgatgcttgaaatatatacagcaccataacacgaccaaaattaagcaactcttttccattgcttacaacaacaaaaattctatatatgcttgcatccggggttaggtaaataaaaaatgacactgaagaagaatcggaatagactcactttgacttcacctcagtatacaaattctatgtccttggagttgccttcaccagcaagtgtaatagtcaataatccatcttcacggttgtagaagaactcttcctccttcatgtccactacacaaagtttcggtctaacgttggagtaggctccaaaacgaccacatcctctgcctttgattttgattatgcattgtgcaacatccatggtgccaga

SEQ ID NO: 7132 - DNA, 502 bp, Glycine max
cctatttctcctctcacaagcagtagaaatttgatatcttgatccaattagtcatttccttcctttctatttgcttctactccatttccacacaaggatttttccacacaaggttagaagcttctttcttcatgagcattcatttgcctgctgctcccatgcctaaaagtctaacaaatttagcagagctaactttcctgtttgtaatgataagtggctttaaaagattatcacacatagctcatcaagttacgagcctttccccaccataccttgtaacaggaaaatcagccatgttcagttgtctgttcataaattttctcttgcactgcccattgatcggaatccttacctgtttttcaaatataagtttctttacaagatttatcacacaatgcatcaaactatttaagaacctccaccataccttgtaacaacaaaatcatccatgtttgacctgttcataaattttctctgttgcaccagcatgattgagatcatc

SEQ ID NO: 7133 - DNA, 406 bp, Glycine max
atgtagagatcataaggtgcccaaagaaaatccactgagcaaggcatcttggcatcaagcctagtccatggtttccctttaccactccaatgtagcaaactaactggaccaggatgcagagtcctacaactatttcttacattatcccctccaagaccatgttggttccatctatgttcaatggcctcaacattaccaccgaaagccagcaaaaagggagggagtgaccccaacttgtagatccttctctccttttgaatctccatccacttctcaatcttccttgtgtagtcgcccgctctccatctcaccaaatccatcaccatcaccccagtgttgaaataacaaggccttttcccttggaagacctcagaaaactcagcacttgaccaaaactcataggaga

SEQ ID NO: 7134 - DNA, 312 bp, Glycine max
caaaggaaaaaaaaaatattgatatcttacaagagaacaaaagtccaaaagagcatcaaacacggtaaaagcaaatttgcttgaaagtgtaatcaacagacaaaacataaagcctacaagcaacatgtaaaaacaaatacaattcaatttaacatatacaggaattctccctgcttataaatagaaagggattgttaaattagcaatttgatttttcttatgttcgttgctctgagcaatttcctttaaactagtccaagattttcttcgtcttttgctggatgtacttgtggattttgcctcatgcaaaaa

SEQ ID NO: 7135 - DNA, 555 bp, Glycine max
attgtctcggtatatgaaatataatattagttgcgttgtccccaaagcagaaccaacaccattaggtacctgaaaaaccatacatgaatatgaaactatgaaactatgtaacattttattgtctatgccactgcactgccaataataaatatgaaactatgtaccattgtaagttaaaattgcaaagtgacttactgcaacaaatgggtcacggcctagcagaccaaagataaaccaggaagtgccgcagagaaaaacaaacagagacaagaagaagggcatgaactccacactcttggttttgatcactagtctctgcacatagtttcaaatccacaattaacacacagccactaagaatgttgaactactagtattaccaacaactagcacggtttccttggtagtgttcctgaatttgtatatcatttttcacgttgaccaatttgctatgtatatcaatttgtatagaaattaatcaatttctacccttgttaagcaataattaagacaatattacacggtatgaaatttttggtaaataaataactcctt

SEQ ID NO: 7136 - DNA, 438 bp, Glycine max
tttccctcccacccatttcccccaaaacaaaaaagggatctgtatagttcttatacaattagatatgtcaaaatgtcagcttcttgtcacttaggctgtaaaaggagtgtctttctgatcttctgatctactgcactactattctcccttccaagaaacctgtgttggaacgtgctgcatggcagattttgtgcaacagtaaattgaggagcttccatcctttggatccccaacactaccttccttattcttgttttcttccatttgggtgggtggtgtgggatggggatccgtaagttgagtatgattgaaggtaatgaactgattttatcaatttatggttggagatgttaactctagctttgagtgaggaaaaagctgaaaggttttggcacaattttgtcctacactttttcggagtagcgtaagtgagatgca

SEQ ID NO: 7137 - DNA, 384 bp, Glycine max
ctgcattacaaacgttgttgcccgaaattggacttcttacaagtagataattgtgcacaaagccggcaatacaaatgatccatcttatttggagaaaagtagccgtgtttgccaaatcaaataaaaaaagaagggcacaatatagttgatacaatgataacagtacatcttcacaatttctatcaaaaaagacttagtgccaatattatgcaaaaagatgtgacagaacacaggtaatatgaagacacttacaattaaatgcgttggctcgatttatttttgatgtgtagcgttcaatatctgatgttagattcatggttatattatcattaaaaaccaaaatcgttttacctttcagaatattgatgaacaccacctagcacg

SEQ ID NO: 7138 - DNA, 1150 bp, Glycine max
  misc_feature (1069)..(1074): n is a, c, g, or t
  misc_feature (1129)..(1133): n is a, c, g, or t
  misc_feature (1137)..(1145): n is a, c, g, or t
ggaaaataataagccatccatccatccccaaaaggaacactaaatcgttagcctccccttttgtccatgttaggccactcgaactccaaggccagttcaactcttgcactcaatatatgtggctggcaggcgatcaagccgcaataatgctgcaatttacaactctcatgccatatgagaaaccaagatcggggccgaaactaacattactttccgaccaaagaattagatcaaaatagcaagctcaactctcaaggtcctgaataattggccagtagacgcaacaaactatccagtgtttcaggagtgaatttcctagcaaataggtaacatggcttctgaatcccattccataagcaaggccagctttgcacttctttctgtggaaacacaagattattcatcaagctggttaatacattctcaataaaacagatcaataaagctctcatacaccataccttctcatcactggttacgtgcatgctaacatcaatggactgcaaatataacaattatcgtgaatatccaagtactaaacttgaaaacaaatcagaaggacaacgctaagttgaaatagactaccacagttgcagcacgcttactaaacaacaccactgtagaaaaagaagaagtgtcacacctaaaacaaaattgcattttttttcctttaccagcattgcaagtgtttcttctaatagctaagaatgcacgtgttgccaacacgcttggaactcaatcatactcttactattttggatttgagaacaagtggaatggaatgacattagttgccataacatggattgtgtaaattaggatggaatctaattccatcccatttcatccaatatctgtatttcttttaccctaatttgaggttattggataacttattatttactcaccatccaaacaatggaagggaaacttcaatttcattgtaaaataatctaacccattccatttcacccatatccttagatatccaaacagattaagactgggatgtgatgatgatgccagaggtttaccctcgacaaggctatccctctcctctgcatagatnnnnnncgaaaagaatgaatatgcattgttgtaaaaattagagtttagcagaactataccnnnnntttnnnnnnnnnttttt

SEQ ID NO: 7139 - DNA, 294 bp, Glycine max
ttgattacaccggcaatgtgagccgttcgctgtggcaacctgttcccgggacaaaggcacacaagttgaagtttgggtcgagggtgcagattgtgttgcaggatactagcattgtcactcctgagaaccaccctatccatcttcatgggtacgatttctacattgttgcagagggtttcgggaacttcgacccaaagaaagatacggcgaaattcaaccttgttgatccacctttgagaaacacagtggctgtgcctgtaaatggatgggcagttattcgatttgtggctgata

SEQ ID NO: 7140 - DNA, 451 bp, Glycine max
acccatctctatcaagatttactcatatatatttttaaataaatcataggttaaattattaactacgttttaatgctaataatataaaaaaaataataaataacgagaatattaaaagaaaagaaacttagaaactaaactatagttttggtaaattttgttatgtcaagtttagtatttaattattattattattataacttcaattatttcactattatgtctggggtgaatccggggtaggtcttgtgttcatatccttgacctcgcatttgtaaagcgggaaaacccaaacgcaatcaaatcagttttccccccatcaaaatcatgttagaggttagaaaaactgggaaaactcgaacccattaaagttgggttggggttagacggtacctactggttctgatttaattgttatgcctactttcacataaaaattagtagtaggcta

SEQ ID NO: 7141 - DNA, 476 bp, Glycine max
tgttcagtagctgtttacaggggaatgctgttttttactgttatgctgctaattacaatacacgatcattgatgttactggttgcaaatgttgaataggaatatagaaacatattgctacagtttgtctatgacgattagatgaatggaaattctaggaccttgaatttgagagttaatagctaatcttagtctgtagttgtctatacaagaagttgcacggcaaaggctggttatgaatgcaagttagaaatgatatgctattgtgggaaaaaaaaacttcggcaaagaggctgtttccggattcgaacccatgaccaacaagtcaccaaggcacaactttaccgctgcaccagggctcatcctctattgtgggaaaaaaaaatatatatattctgttaaggtttaaaaaaacttgtttacttgggcataacttgcttttctcaccgttggggtatcgtttggcaaagcccttaa

SEQ ID NO: 7142 - DNA, 801 bp, Glycine max
acgaaagacacatgatactgcaacattatattagataaggtatggtacaagtacaaccatattatttaataatagtccataatacatgcacagattaaaacattagccattattaattaagaggcatgcatagaatagaacctctctatgcgttggcttgaacataggcatcgacctctaggaaattcttgactgcaaaatctttgacaagggttggatcagaaatatcatggctaaccttttcgtacacagcactccacttcacctcgcatccatcgccaattggagtcactgaaatgtctcccttgaatgttttgtagtgctggaggagttccccatcaatgatagtgtacgacactaccttcttttcctcatcaacagcctcaatcttctcaaaggatgatttcacaagtggtgaacctggatcaatacatacatgaggttatatcatggttttaagaagctaaagggggttcataattctaggcatagcttagttcatcagtgaaagttggactgtatgtaaaaagtattataattagtgtgaacgtaaaattgactgcattgaatccaatctcgttataaaactagagaaaagtaggcatgttaaattactagtacatgcattagagaagaagaaagtaatccaatgagatcggcctagtggtgagagttaggatagatgcatgtgacatgctagggtttgatccatattagtactatctttgggaagcatgcatgtttctaccttcaccataacttatgtggcggatagaaccaggagacttgccatcaccctca

SEQ ID NO: 7143 - DNA, 347 bp, Glycine max
  misc_feature (50)..(51): n is a, c, g, or t
  misc_feature (55)..(57): n is a, c, g, or t
ttcctttccaatacgctttcttcagcttccttccctgaattttctcgggnncttnnnatttgtgagcacccgtgtggactggaaggagaccccagaggcgcacgtgttcaaggcagatattccaggactgaagaaggaggaagtgaaggtgcagattgaagacgataaggttcttcatataagcggagagaggaacgttgagaaggaagataagaacgacacgtggcatcgagtggagcgtagcagtggcaagttcttgagaaggttcagattgccggagaacgctaaagtggagcaagtgaaggcttctatggaaaatggggttcttactgtcactgttcccaagg

SEQ ID NO: 7144 - DNA, 520 bp, Glycine max
gtgagttattggggcattcaaccctccaagatcacaaaaaaagatggcacagaatggaagtggaattgctttagggtatgtaaaccatatgtgtaagttttttttttttcaggtataaaaaataatatgatgtttctatcttatcataaactaatcttatttgcggtgtgtgtgactagcactgaaccctttccacacaaagaaaattgaatatttttcctatcaaataaattgtttttccccacatgagaaaataacttggtcttatgttattctgtcaacccctacggattgcgtccttaatttgttctctcttgaaatttttaatttatataattttgttttggggattaattatatatttgataatggtattgttttgatttgttgatgatgttaattgacgcgaagccatgggagacatacaaagcaaatctttccattgatctggagaagcaccatgctccaaccacgtttctggacaaaatggctttttggactgtcaaggttctcaaatacc

SEQ ID NO: 7145 - DNA, 623 bp, Glycine max
  misc_feature (34)..(34): n is a, c, g, or t
tttacttattattagtttttacattttattgttntttcttggttcacaggctagcctataaaatcgtggactaaataaggcaggtaggcacaaaagaaaatgaaacccatttatgtcacaaacaactttttacaacaataatctgagtaccctttagatggtacaagtggaatctcagtaccccattaatcagaatccttcatgtattaagctcaagagcttgctgtaaaatatttttttaaaacaactacatgtagacaaaggttaaatgtgtctgtatgccttcagatcccaactaccttgcagcccctattccctaaataaaatgcaagcagcccgtcagcacataaagtaaataatcactcatcagtatttctgaattcagctggcactacaataagtagacaaataagtagacaaatgcaaagtacatgacacaattgaaaaagtaaagcaaaagtgaacatttattatttcacaagcctcaagtgttggaaaataacagaatgcataacctatccttagatcccttagatccaataaactttctgaaccattattagagtgccaaatttggttcacattttgatttatcagttagatatggacacctttgcatgcat

SEQ ID NO: 7146 - DNA, 313 bp, Glycine max
  misc_feature (285)..(285): n is a, c, g, or t
  misc_feature (288)..(288): n is a, c, g, or t
tcagctccaaaccatagccacggatttccaacgcatttccaagattcacgacaagctcttcatcgctctctctggcctcgccaccgatgctcaaacattgtatgtagcgctaccctttactctttttcttttgtttttttctttttctttttctaccattttttaaattgtttttgttctctctttgtttactttttttttttaagggaaccaccgttttgtttcccggcaaaaatggtttcactttcggaaaaaagggaaaataaaaccaaaaacttttgccanttnatccccggctcggtttaaaaaaaaa

SEQ ID NO: 7147 - DNA, 623 bp, Glycine max
ccttctacctgtacacactcttggtacaatttacaagcatgagcagaagcatagatatcattacactcagaaaagtcatatgaaccaataaaacttttcattattgataaatcatatgaacaatttgcagcttactatctgtataggaaatattaaaagaagggggaagaatttgaaaaatatgatgacatgattttattttttctcttcctgtttctcttctggcttcccttctggtttctcttccatcttttccgctttcttttcttcttttttctcttccttggcaggtccaactgatattatatccactttccctactttcttcagcttcttcaccactgccactgcatccatttcaccaatcactgtcaacttctgttccgtcacatctgcggcaatcgaatcaacccctgttcaaagttaaacaaattagtatgcatccaaagcacaaaaagaaaaggttttctatgaccaagaaatatggtttctgtggcagaatgaaaatgaaatcataagtaaactaaacaccaaccatagatatctgcagctgcttcaattgctttcttttttgttttgtcatctgtcatagtaaggacctttaacaccaccttctggggatc

SEQ ID NO: 7148 - DNA, 327 bp, Glycine max
ctagttttgaggttttactcgcagaatgacgaatatacaaatcacacattcccaaccttacaagctgaaaacatatggaaaaacaaataaaagaatccaggctaattaacatagttggattttgtagaaaagtagaaacctagctaaaccttttctgaggctctacaccacacaacccttaattaacctcaggtatactctgaagcacgggcctccaaggcctatgatgaacatcatcatgatctctagcgtgtatcaagcgagccagaacttgctccgcagaagcgtgtccttcacctaattgcttattattaatctctttctctg

SEQ ID NO: 7149 - DNA, 514 bp, Glycine max
ttctcttatggcacccctgttgagtctgcaaaatttgtgcttgatctcggaggctcactcctctgggctgattgtgcatccagaaccaccccatcttccaccctcgcccccattttccaccgttcaattcgctgcctcacagcaaagggtcctgaaattgagacccacaggtggctctcgagtcttgcaaatcctatagatcaagatcagccatgtcaaattacagcagagaacagcatcacggggaaaagggtcaccgaaggagagcttgtggaagacctagtgattcatcgttctcacgagcttctcttcacgtgctcgcccacttttcttttgaatggtttagccactgatgctaaaggcattataggtcttgataaatctcgtatttctttctcatcacaagtttttcactcacttaaaatccagagaaaaatcactctgtgcctttctcccacttctggtgttattcaatttggaaaaatgacgcataaatcccaaactgaatctgaaa

SEQ ID NO: 7150 - DNA, 501 bp, Glycine max
gcgtccgaacccttacaaactgtccattttcgggaaatatggctgcttctgagggaaggccattggtggaggcagtggaacacaaggaggatttctatgagcaccaagagccaagtggatgtgggtatggatgctttcagggttttgggttgagttggtgtagaagccatgaagaaggtaaaggcctggtggagcagaagggcaattcgtggctgagttgcaagttgaggaagataaaggagttttcagaagtgattgcaggccccaagtggaaaacattcatcagaaagataagcgggtatggaaggaagcagcagcagaagaacaggtttcagtatgatgaacacagctatgctctcaacttcaatagtggggataagagtgaagatgatgacacgccccccagtttctctgctagatttagtgctccttttccctctgctcgtcgccaaactgaataatgatttgtgcatgctcgtttctgaagaggtgttattactt

SEQ ID NO: 7151 - DNA, 430 bp, Glycine max
ttcatagcagaagtcatatagcgtcttcacattgatattccaatcatcgccagaagatttacaatgttaatgacctaattctgcattacaaatgttgtcgcccgaatctgaacttcttacaagtagataattgtacaattatacaaagcccccgcaatacaaatggcccatcttatttggatacaagtaaccggagtttaccaaatcaagtaagatgaaaaagggaacaatttacatgacaattacaacagtatagcttcacaatttctataaacagtaaaattatgcataaggaagtcgcagcaggcagctaatatgaaatgaagacaattattaataaattccttggctcgatttattttcactatgaataacgttatattagattcatgaagatattatacctaccagaatattgatgaactccacc

SEQ ID NO: 7152 - DNA, 385 bp, Glycine max
ctcttcttggaagcatcaccaagctctcttgctctcttcctcacttctctgctctcttcttttgccataaactgcaccacagcctttgcaatctcttcccttcccatcacttcctccttgcccatgcttgcccacaatttgttttctttagctcccactgggactccaatcttcaacacatcaactagcaacttctcattgaagaattgctctgcaaacattggccatgtgatcattggcaatccagcactcacactttcaagaattgaattccaaccacagtgagtcacaatgcctcctatcgcagggtggtccaatatcagcaactgtggtgcccagttccatatgatataaccgttcttgctttctttcatcttctgctcgg

SEQ ID NO: 7153 - DNA, 299 bp, Glycine max
gcttcgacttgcaagtgctgggtccacaaggacagatattgaagggtggtgacgccaaagttagcatggaagagagagccggcctcactgttccaagggcacatagtcttgtctgtgttccacttgcaaggatcggcgttgcatctaaactcctttcttaattaagatcatcgtcatcatcatcatatgtaatatttactttttgtgtgttgataatcatcatttcaataaggtctcattcatctactttttatgaagtatataagcccttccatgcacattgtatcatctcccatttg

SEQ ID NO: 7154 - DNA, 596 bp, Glycine max
cactgctcagagagaataaagatggtgtggaagcctaggctcaacaacagtttccagtggtattttcttaggtgtagagagcccaaaaatctcatccatattcaaatcctcattcttgacattatcaggcagtctccagttaaatccatgcaacaaattggccaaacttgcttgaatgaccttaaggccaagagggtagccagggcacatccttctcccagcaccaaatggcaatagctcatagtcatgtcctttaacatcaatctccttagtaagaaacctctctggttggaactctgtagggttgtcccaaattgaagggtctctcccaatagtccacacattcacaagcacttgtgtccctttggggatgtcataccctccaacttggcaatcctctctggctagtcttggcaccaacattggtgccacagggtgcagcctcattgcttcctttgcaatggcattcacataaggcaaatttacaatgtccttctcttcaacccatctttctctacctattaccctgtctagctcctctgttgccttcttgaaaatctctggccttctcaatagctctgtgattgctcgtgccg

SEQ ID NO: 7155 - DNA, 298 bp, Glycine max
aatttttgttgctttgtgaagaacgtggaagtcttgatcacccttttcatgggaaatctcgtgtgagaatcagtttgcctaaaatataggtgttagaaatattactgataatgatttatagtaaaaaagttcagctgaacaagggtcctttctcctttttaatagttttggctagagtcaatggacctaatcacccacccagaagagagaaaaagatatttacatcatctcgataatctaagactagacttgttcaaaagaggaagaattaacagtcctagtggttgtcaattgattg

SEQ ID NO: 7156 - DNA, 478 bp, Glycine max
taggctgaaagcaaataatgactttcatatccaacataacccctcatgctagagccctttggccttgaagcgacaacatgattatgagggctttgatactattatatcaggaaacaattatcttaaaattttaagctattaaatgaaattttacatatctcacaaacaaatcaagagacagcaacatctaacacacagtttcctctgatataacattgagaagaaccaaatgaaagtgttccattgagttgctcctctaacatgcaacaaacagcttcaatttcacttccttgtccggttcgtgcttttctgggaaacactggtactccttctattacctctggagagatttgatcctccatggccaactcttctaattgatcttctgttgcagctacgcgtgctgctcctgagtgcagctctggcaacactatcgcttaatattccgcgtgtcctatgagccttgacaggttgcttg

SEQ ID NO: 7157 - DNA, 502 bp, Glycine max
tagattaagattttcaagtgggagatttactatattgaatgagttggaagtagttgattcctctgtgaaggaattatatcctattatccagggcattgcagataccattgagacagaatcacttgcgaagattgttggggaattaagcagagcaacagagaagctttcacaaggactagatcttcttacaaaggaagtcgatagctttttccaagtggtcttgaccggtcgtgataccttgctatctagtctgaggtcaggtgcaactttcattgacagcattcaggcgggtaacagagatgcacaaatagtcaattgaatgtgttgcagcctaactgtggtagatactgatggatctaggtattgggtttcatgttttatggttgatggttttcaatcatgtttggcttattgtattcaagttagaatgagtaataggttatatgattatattattatggttctgaaatgtatatttctgatgttctgtttctgtgtaaaa

SEQ ID NO: 7158 - DNA, 419 bp, Glycine max
  misc_feature (52)..(57): n is a, c, g, or t
  misc_feature (59)..(59): n is a, c, g, or t
  misc_feature (63)..(64): n is a, c, g, or t
  misc_feature (96)..(96): n is a, c, g, or t
  misc_feature (99)..(100): n is a, c, g, or t
aaaatgagtggtcaggaagagaaaaaggagaatacagtctcaagaattactnnnnnntnaagnntgttgttacatccttgaagaacccagcttggnctnnaacatcattagctttagatttatttgatgaaaagattaataaataggctccaataataaagatcattaaattgggtttattccattcatagtttctgataatgatgaaaataatctagtttctttttctgttttcccccctgcattttatgggtagagtgaaatatactatggagtctatggtataaaattcaacgtagaggtgaatttctggttgggactggaatcaaatttgtataatgatggatgtaaatttcatattacctgttctcaaaggacattgttcgtttttagtaaatggcaatgttatgatttgaaca

SEQ ID NO: 7159 - DNA, 529 bp, Glycine max
  misc_feature (53)..(55): n is a, c, g, or t
  misc_feature (58)..(58): n is a, c, g, or t
gatgccaatacaagatcttccgtggcctttatgaacagcagctctcgtaccgnnntcngccatggcccaagccttgtcatagctttgcagaatgttttgactcaaactgtcaattgcaattaggtgccccttgcgaagattgaatattcatgcttcaaggatgaaagatattgggatggagaaagaaattatggcccaaatactaccagtttgacgaatatcggttttcaatttgggtggtaggttagacattgaacagttcagacttcagagatacaaggaaaaataatcaccaatactgttgttaaaattcttatagaaattttatgtacaggctcactggcatcttattttttactaccttgaacgccttgcgcacacttctcaaaatcaaataggcagctgctactgctagcatacatattgtacaaaaatatagagagcttgatacttggatagcatcattgttctaagttgtaccatatgacttccttggatttatttggacttcttggcaccctccttcgta

SEQ ID NO: 7160 - DNA, 528 bp, Glycine max
cacagagaagaaaggtggaagagggaaaccgaagacttcaaagtccgtttcccgttcctccaaagctggccttcagtttcccgtcggccgtgtcgctcgctacctcaaggccggtcgctacgcccagcgcgttggctccggttcccctgtttatctctccgcggttctcgaatacctcgctgccgaggttcgtcattttcttcctttaattttcgatttgtcttttttgtgtattgtgaccttaatgtgttttggggctttaggttttggagcttgcggggaacgctgcgagggacaacaagaagacgaggatcgttccgaggcacattcaactggcggttaggaacgacgaggagttgagcaagctgatgggatctgtgaccattgccaacggtggtgttctgcctaacattcaccagaatttgttgcccaagaaggtcgctggcaaggggaagaccgagattggatctgctagtcaggagttttagatttaaggctcttgttttcgtatgtagttggttgccatat

SEQ ID NO: 7161 - DNA, 603 bp, Glycine max
gcacaattgggttcgaaggtttacacactaaaaaatcctaatatgccaggaaaaagaaaactaaataaaattataaaaatgaagccatcttcctcagagcctgcacaaatgcagcaagtaaaccagccaaggcttctcctacaaacacgattacttgccagctgaaagatccgttaaaacatcctcaaagagcaagccatgaacctgtacacaaattccacggtaaactgcaattaactaaagggctcgtttcttagaagaagcagggatacctgaacctgcaaaactcataacagcgtaagatcatgctacttcatattccaagaggaaaaattaattaaacattgaaaacaaaaacccctatcaaagagttgaaactgctcgttcattagtcttcatgttgatcagtgtacctgactgtaaaataatgcatacattcaacaactgcaaatcaaccacagtaacaagcatacaagagcaacatacgttggaatgttaataattaaccggttgagaaaagggacattgctgtaaggactatattagctataatgctgtaaggctattttgtaatctgtgaatggcggggaagtgaatgaaaaa

SEQ ID NO: 7162 - DNA, 405 bp, Glycine max
tatttaaggctttaggccaccataacttacaaaacttaaagccataaatgtacctgagcaataaaagaaacctgaatacacataagcatcggatcctcataaaaagaagacatggcttcaagttttccacaatacttgacagtgctttatagaagtacctaacagccacctctattcacatccaaccaaaacaaaaatttagaagcttaaaaactggtcatttcatcttcatgatacaaatacaagctaagaccaaaccgggcacaagttttgcagaaagcaatttcctcagcagctgaaactggatcgccaatggagcccatcactgggtgatattgtcccagttgacgatagtatcggggattctcttattgaggtctctgagtatctcggctaaaggacatg

SEQ ID NO: 7163 - DNA, 725 bp, Glycine max
gcacacggagaacttttgtctctaaatttgcaatacacgccttcctgaaagaaacgaaaaaggtaaaacaaatgtgtaacttattgttttcaaagttcactgaatagggaaaatccagaatttaattttcttcaacatgggggcatgtctggcggtggtggtggcaatcttagattttcagactctccatccttcacaataaaaactgtctccataccccaagattggtggcgttctagatggcagtgcataaaccatactcctgtaaattgaaatcacatgcatggaattcatgtaacaaaattgatctctaaacttagaaaacaaaaaatggaaaatgaacaaaagaagttaaattaatataagctggtattccatgccacataccagggtttacagcctcgaacctaatggcagcccagccatttataggcactatcactgtattcaaataaggaggatcaacgagattgaaattcatgggatccacgctttggttaaaattgcctagcccatatccaacaacatggaaactgtagccatggagatggatgggatggtctatcccgccaacaaggtttgtcccttggaaaacaatttcaactgttgcaccatagttcagcacattaaccctagtcccttgctttggtgtattcagtgttataggcaaaaaatccccagtgaagttaaatataaacggtggaaatgttggaaatccaggttcg

SEQ ID NO: 7164 - DNA, 556 bp, Glycine max
  misc_feature (50)..(56): n is a, c, g, or t
  misc_feature (527)..(531): n is a, c, g, or t
  misc_feature (534)..(537): n is a, c, g, or t
  misc_feature (540)..(540): n is a, c, g, or t
  misc_feature (542)..(542): n is a, c, g, or t
  misc_feature (551)..(553): n is a, c, g, or t
caaggagtatttgtgttcttccatgtgcttacgcggttcttttagcttcnnnnnnntctcatattcttcaatggatttgaaaagctcagaaaaattgcctttcccaaaacccccacatgcacccttctggtacaccttcccttcctcatcctccaccatgcacccgatcctctgaattatctctatgaatatcgttggcctgtcaattcaacacaaaacacatttaactaatcaccaccctccaacacacaaacactgtcaaattgttaatctaacttttaccactttcaatcagttcaaagcggaagataaataaattgcacttttatctatcaattttttcaatgtcgtaaactttatgtcaggaaagggacaaaagtacaatttgtagagggaaacactctgatgaactgctacatcaagtacatccattctgacataacactatactgtacatcatttgttaattattgaaagttataattgaaaaattaaaattttatataaaaaaaaaaactaacaaagtnnnnnaannnnaancncagtttaannnaaa

SEQ ID NO: 7165 - DNA, 679 bp, Glycine max
ctagaatgacactttgggacaagggagaaaaaagcatgacttgaaaaaatagttttgttgtcgttcctgagcacaaaaggagccaattcaaccaataaagcgaaaccctttttaatttgtgcatcccaatattcacttctcaaatacctttggctgctgctgactttatttcccaaagggtttaaggaagtagaaatcagtagaagaacaaataagaaagaactcaccaggtacgactataacaagggacggaaagagaaacataccagtaggcacaatccaactcagcaaactaaaacggtatttcctacttgagctaatcctgcaaccacaggaattaaaggaaggaagcaagataaatagaagataaaaggcaaccaattgcatttgcatcaacaaattctacgcactagtaagagacactaatcaaaattccccccaggctaggaaatgatactctcacatcttgatacaccatgttttctaccattggacacactggacttaaaaatattcaagtagtctataaccacagtttcttttatttactagattgacaaaataaacgtcaatttttccatacttatatagtatatatttcactgaataacacgaaaccaatcagccttaataattgtaaaattgaacttcccaattacaaaccccttcacttcaaata

SEQ ID NO: 7166 - DNA, 716 bp, Glycine max
ttgatgcacattattagttcattcaaactcaaattaccatcatattaatgcaaagagactaattaagatcttttcagttattgtactgtgagtctttaatgatagctaatgtgacgccaccattttggttaggctaagcgacaacatttatgaatgaagctgattgagaaaaatgcagtcataactgtatgtgtgtgtgtgtatatatatatatatattgttaattgtttatacttggagctcagccttgtacttgtctaatattagagatgctaacaataattaagggagaaagagatagtgaaaagaaaaaaagattgaaagagcagtgtaatttcatagaagattgattgatcatattttctttgacggctgaaggttgtaacactgctaagaggtgaagaccatgttctgaaagctacaaaatcaagccgaaggaggcctctacaaagagcatactcagaagagctactagacgcgcaagaatacaactcaacaaaacatctaagagatctcaagcgatttgagcagattgcattgggttaacgagagctaaggacatcattagttttaggacttgaagattgtataaaacttttggggcaaacttcggtaattaagtccatggaaatgaacctctaggacactatgaaaatgcaaaaaatattaaaggctacctgcatttccatggagagcaacttgtatacattttcttg

SEQ ID NO: 7167 - DNA, 392 bp, Glycine max
atgagaagcttagaaagaatttaaaaaaaaaaggttatctgttgaatttttacctcagcagcatccatcagctacaagcttgaattattcctgaatgaccaaatgctggagaattgtttctcacacgggtttcacatttgggtgctgctgctggcaataccgtttcaaaggcttcaactagcagtgccacctttttcttcctagctggagcaagctgtgtcacaacttgtcttagagcacaatcaagcatccaatcctctgagttctttctctcatccatcatttgatgcctcaggtcaaccttctcttgtcctggctcaggaaccaatggcagaaaatttggctcttttgggttgaactttctcatttcatcatcatcatcttcaacacac

SEQ ID NO: 7168 - DNA, 586 bp, Glycine max
agctacaaactcctcttctgtgtcactctcatcagctgaacaaaaagatcaagagaccagtcaaagtcaactacagctgaagcaaaataaactcaagttcataaaaggattgaaatataaatgaaaagaagattgatattgttgtatcccataaataacatggacaaaatttggatatagttaccatcgtcattgcctgcagcatcagaatccaatccttcaccccctcccatgcccaacttctgcatagaaagtgaattgatggtcaagacttgagtgcccatctaactaaaagtatcagtgttaaactatatcgtttgagctatgccacttacagaaaaatcaatgtcaccaaagtccatatcagatgctgcagctgaaaagggaatatggaaatgagacaaaataatggataatgaaacctttaagttcagagaaattttgataatcactaacgtttattatcttgctcctcatcttcatcaacccatttatcccaatcaactttcagaaagacaggagatttccctccctgcttcaacaatctgtcccaccacttgttctcagcctttttcaccaagtagca

SEQ ID NO: 7169 - DNA, 480 bp, Glycine max
gaaaaacactagttaccacttactagttactactagctaaccactaagctatgagaatgaaccaaccattgatgatgaagaggaagaagaactccaatcactcactacaaaaccaaaaacaaactaaaagatttgatcaacctcctccgtgtgaccgcaactcctccatagcagccttgatctgatcctgaaccagctccaaccgctttgagtacacttccaactccaatatctgttgtttcctccatttctcatccaccatttccccaccgccaaaactccaattcatcaaaggcatagggttcaagttcaacgaaaaccctctcgctccaaacgctcctcctcccatggcccctgccatcaactccttcaacaccggcgacaaacaactcctcaccgtctcctcgatcatactcggtatgttatttccataaccactgttacagttatcattagtagtagctgcagtaggagtagagt

SEQ ID NO: 7170 - DNA, 474 bp, Glycine max
tgtaatctgctacaaaattgcatttgaggcaacagacctacaaaattacatatttcaatcagaaaatcaaaccattcagatcaccttaaaccaatgatcttaattatataagaatcatgatcctatgcttgaggtgcttggcaaaccttgcatgcatgttaaccccaaaattgatgtagccaaggaggatcaacagaaaatcatataatataactaaccttcagataacaagttcctgactgttgaagctactatttctgttttacttcataatttgtcttgtttaatcaatagccattatttttcttccctcatttttcttttcttctacaacttctatcttattctcttttatttttatctccagctcataaagtaaaccagaaagacggggaagtgctctgctggcattttcagcttctcacactcaatcccgtgacaattacaaaactgtacagaccattaaacgatgca

SEQ ID NO: 7171 - DNA, 609 bp, Glycine max
acgtatagacaacggagagtaaactagagtaaataagggtaaaagaaaaatattgtaggggagggagaagcaaactcaatcgaataattcccacgtggttgaggatggaggatgatcaaagatctcccacttggttgtaacaacaacaggttttattcttgcattagataccttaagttgatccagtttttcaacacatttttgcactctctttccctggaaaatgtaatcatatcagattattaagcatataaccaattactccatgtgacttaccaattgaggagaaaatgtacactatgctcctattgaacttttttggtatagtcgacaaaagactgtatacttcatattcagcaatgttttccatggtaaaactattctaaataaataaagcgaattttctttcatttttttactctttctttcttcttctttttcacttaattttaataaatgagcacgaccaagtcctctttaattaattttatgataagattaaagaaataataaatttatttaaagaggatgttcacccacccataccaaaatatttagaaacattatctatctatagcaattagaaacatttatttccaaatgaaacca

SEQ ID NO: 7172 - DNA, 698 bp, Glycine max
  misc_feature (675)..(676): n is a, c, g, or t
  misc_feature (678)..(680): n is a, c, g, or t
tttctatagaatgggtacgtaatgaaccaagcaatttctcaagtatactccaagagtttcatgccataaataagtcaaattaaacaagaattaaaaatgaaacttaagattgatcatagtcatactattgaattcaaaagattgagatttgagaggtacttgtcgggcccaatcgccatcttctcattgataattaatgagtaactttgctgcattgtgaaggggagttggatctctctcgacctatatacaaaattaaaaaaggaagaagaaaaacaattatataacatttattttggatatagtaatagtaataaataaacaagttgaaatccaagatacaatcaaatggacatgtagtctcacacacgtgcacgtcaaaagatacaatcaacatgaactagagccattaaagcccaagctgtttgtacaatatttgttcgacttccttcaagaggtacgtacattttcattatacacatacattcattaagacattattaataatattacttataattagcattaaagtttaactaaactattaccacaaaataatcatttaattacaaaccttccttgggcaagaaagataactctctccccacccaccatccttattttgtattttgagtagaaatttcacagctctacgaatagtaacacaatttttannannnttaaaagcaaatagacct

SEQ ID NO: 7173 - DNA, 508 bp, Glycine max
ttttgggaggacaagtaggacatggtgcaaccctcgtgccggatcaatcttcacatcaagagtcaatttttggtagctaattccccgatggactcaacccttttttctgctctctaggccctgctttaagaactgcaacctatttctgcataaaaatttacatttaacaaaatacaaccgcacaaagtaaataaaagcggggaagaataattacatacatagtaccagcaatcaaccacatgaaaataaaacaattaatatttagtcgttgtaaacgaagggcattaacatatgctaacaccactgtgcaacaggtaaaccgtaaagccatctatctaaccatactattgtgatattgtctatagttcaataaggataggtacgtgaaggcaggtccaaaccatttaacaatccaataatcaggcttgatagcaataattagttgaaagatatttagaaactgaaattccaagatctatggatcactcacctgcgatagcataaaatt

SEQ ID NO: 7174 - DNA, 433 bp, Glycine max
  misc_feature (359)..(360): n is a, c, g, or t
  misc_feature (400)..(400): n is a, c, g, or t
  misc_feature (404)..(404): n is a, c, g, or t
  misc_feature (407)..(407): n is a, c, g, or t
  misc_feature (409)..(409): n is a, c, g, or t
tgtttacatttttggttgcctgtattcaagggtctcttctttttcatgcatttgataaagtgataattaataccgaactcgattgatacctcattaatttaatgacatcggtttggtggatgggagcaaaaacagaatttgtcgctgttctccttgaggtatatatatatatatatatatcctaatgcctttcattgcacaacacaagttgaagcataactaccaaagaaagagaactcctgtaaaatttagtgcgtgttctggtcattaaccttaaaaattgtttcattcggatacttaaaagattactcaagaagaaagaccactagtgttttccacacacgtgcattattctaaannaaaataaatgaattgccccggtctctactcaagctaattngcanatntnattttttgttttttcaaacacacg

SEQ ID NO: 7175 - DNA, 521 bp, Glycine max
tccggtggcacgcagttgcagcgtctgcagcaagttccacacgctctgtggcacatgcgctgacgagatgctaaacggcacctcgcagcacatgcagcattacaatctgaaatcaattcatcaagttcccaattagttcaaaatcaaatcaatagaattttcgctgctccatcaatttattctctaggagcacaccatgcgtaaactgtttgataaaattataaactaacattatggttacattttgcttgccacaattatcttttctaatcgataacatcaattctgttctaaatttggtgatatattaattggttcagacgacttgatcagagctaaacagagttgtccgaaaaaaaaatcaggggagcatatacctttccttaatttagtaggtatatattcaaaattaagcaattcgttgtcattgcccactgtttttttttaacaaaaaatatttgctctctaattaataaattaacgcgcgtacagatgctggtgcaatacctatctgctgaaca

SEQ ID NO: 7176 - DNA, 409 bp, Glycine max
ggagacttttaaccatttatccaactgaattagttatttgtcaaactcgtacaatttacactcatacaactaaattaaccattttacatgttacaggaagcctaccacttcgatgtaagatagaatttccctatcataaatggtgctcacaagggaagaacaatgatataatccgtgccttcttactatcttgaaatattttactgcgggatgcatcatcacagacatggctcaagtgtttgtgctatcagatttcatcgatcattagcttaagctatagtgcttcacagttttcttcgtcttctccgacacctattgcaatgcagtgctagtatacctagtcaagtactttgatgcttcttatcctcatgatcattgtcatcttcgccaaaataaaactcactccaaa

SEQ ID NO: 7177 - DNA, 1037 bp, Glycine max
  misc_feature (925)..(925): n is a, c, g, or t
  misc_feature (927)..(927): n is a, c, g, or t
  misc_feature (959)..(975): n is a, c, g, or t
  misc_feature (996)..(998): n is a, c, g, or t
  misc_feature (1014)..(1018): n is a, c, g, or t
tcctccaccttttcttcctttttctcagcagctggggcagcatcagctgcggcagcaccacctgcaggtgcagctgcaacagcaccaccaccacctccaacgaatactgcaccacccactatcacctgaacaaaataatcaacaaaggataaataacctcatcagtgtgacccactttatgattgaatccaacaattaaaccagccaggcagaaatgccaccatcaatcatcaataacacagtaattcattgagtcggacatgtgtatttagtatttttctccaattaaaattaggttcatttcgataatcgtctgtctaagcaatgttaaaacttaaactacggaaaataggagtcagttttctatgatggacagaagctgaactttataagtagccgcgtcccaagtctaaataaaaatacatacttaaaattaatacccattaaatcgtctatcagcaaatgttaccagagtaaaacttcaattcttcagaattgcactaaaagctcttgagtaactagatctaaatttgtaatccttttttgtgtgcacaaattatatactttgaggtaatgaacaatgattaagctttacagctcatagcacttaaaccattaattctcctcaagtcagcgcacattctcagaataatcagaatgaaaaaccaaaaaaaataagcataactaaagcctaagcaacactcgaaaaggcacagtgcaatgacgcatagaaaatgtaacattctatagaatccaaataatacaaataaaaaggatcagggataaacgcagggtaaatataaaccgtgaagttttatttccgaatcaagaaaccgaaatcgttagggatgtgaaatacctggaacacagcggaggtaggagacacgggagagaaagaggactgaactccaccggaggaatcaananggagagcggcttgcacgagcttccgttggagnnnnnnnnnnnnnnnnngggaggcctcgatgtcgccgnnnatgttgcttggcgctnnnnntcgctgccggatttgcgga

SEQ ID NO: 7178 - DNA, 702 bp, Glycine max
  misc_feature (49)..(52): n is a, c, g, or t
  misc_feature (54)..(55): n is a, c, g, or t
  misc_feature (528)..(528): n is a, c, g, or t
  misc_feature (538)..(538): n is a, c, g, or t
  misc_feature (564)..(564): n is a, c, g, or t
  misc_feature (591)..(593): n is a, c, g, or t
  misc_feature (648)..(648): n is a, c, g, or t
  misc_feature (656)..(659): n is a, c, g, or t
  misc_feature (676)..(677): n is a, c, g, or t
  misc_feature (686)..(690): n is a, c, g, or t
  misc_feature (696)..(697): n is a, c, g, or t
ctcgcaagtcaaggatatgcgccacctcctctcaagttatggatccctnnnngnnaaaatccgaacccgctcttcccaccatcgtcgaattcgatttgggtagccggagctatcctatttacatcggatccgggttactaaaccaacccgactatctccagaggtgcttataatattaatagttccttcatcaattcaatttactgtaattatttccaatatgtctgtatgtggatttatacttactcaattcatagtgcaatgaatgtagttttttttttttttttgggaaaaggttattttttttttttttttagggggggattaaaacccgggccccccccttttttccctttcccctttcccccaaaaaaaattttttttccccaagggaggggggaagggaccccctttttgttttttagggggaaaaaccttttttggaaaaactttttgggggatccttccaaaaaaaaaaaaaaaaaaaaaaaaagggattggggccccccccaaccaaaaaaaaaaaantgggcccccnctttttggaaattttaaaggaaaaanttttttaaaattttaaaaatgtggggnnnaattttattttatttaaatttttcaaaaggggggggttttttttttttgttaaantttttttnnnnggggccttgtccccccnntggaaaaannnnngggggnngaaaa

SEQ ID NO: 7179 - DNA, 696 bp, Glycine max
  misc_feature (685)..(688): n is a, c, g, or t
caatgaatcctgtggagagtatgcagatgggttaatggagctttgtgaggagatgaatatcaaggccattaatctgtggtctgcaattcagacaagagaggattggttagacgttagcttcacgtaagtatataatatatatgatctctctcctatatatgcatgcattattataaatttttttagttagtatgatttctaaaattaaaaagaaattattatcaaattgtcatgcgtatgataaatttattaatttttataataattatattttgaataattgttttgttgattgacagtatgaaagtcttaataaaattaaacttttgtttttttaaatgagtaaccatgattaaaagtgagaaattaaataaaaaattataaactttttaaggataaaacatgagggaccacaaactccctgaattggaaataactcaaaatctctgcatttccttcatcctgataatggattttggtaatttcttagggatggagttcatctatcagcagagggaagcaaggtagtggtgaaggaaatattaaaggttctaagagaagtagattggaaacctagtctgcattggatgtcaatgccaactgaatatgcagaagattcaccatattatcctccaagtcctgatgggaacaacaaccataaatgtgtctcatattatctcccgannnngtttgcag

SEQ ID NO: 7180 - DNA, 595 bp, Glycine max
atcagttgatagcactgttccatttgactccaactaaagaaagcacaattaaaaaaaggaaaatggggaaaaattttaatgatttcaaaaactaagaacaattggcagaaataaaatgcatgaatttcaaagcaagcaaagaatggatatcttacgaaagacttgctcattgctctcctcatgtcctcatctgcattttggtaaatatcacggaacaatttattcaaagcagcatcaccatcaagcttttcttctttctcctgaatagcagaccacattttcgtcaatattgtttaaacatgttccacaaaatgatgaggtagtgaggtacagattctgtttgatcttgatgtatactctttagaatttttttattataaacacatatcatgtaggtttacaattcaggtcctccagttcaaccaaaatttatttggtcctgtgtccactttaaaatcctgaatatttcaaattaatgcaaacactacacccatccatcagcatgccaacattattgactctcactgctggtgaggaattgagacacgccagtaaaaacacaatcacatcaacaaatacattgccataattagcc

SEQ ID NO: 7181 - DNA, 587 bp, Glycine max
agaaggatcaagattttttgaccatgctgcatcccattccacagcttttgcagtactgcatgccacactaggacctcctggcactgttgcctttgctgcattctgtcaaaatggttcaacataatcagaaggaggtttggaaggatttgaatttgtaaaagtcaatcaatttgtgagcacattacaaggctactctatccttaggtgcaaggttctgatgcacacacaacacatgacatgaaaacatccaattcttttgagtttaaatataggcatgcaaggcactcgcagtgtaaaattttttacaatgccaatcaattagaagtcatattttcaaagtaattattataaaattcaacaaaattttcatatataatagtatgtgattggatgactaaatgcatatattatttattcattgcttttttaaaaaaagaaactataaaatccacctttggaaagaacttctcaaaaattgtcctgtagaggtatccttcttttgtggtaggagtgttttcagggtaaataaaattggcagccatcatcgtcgcatctgtgacctggtcatttattgaaagaaaaaaaca

SEQ ID NO: 7182 - DNA, 334 bp, Glycine max
agatggaaagaaaggcttggtctcatatggcgatggttctccatactaatgtgaaaggtgaaatatgtggtgctgagggctttgggtcacactgtaacctttaatgagttgcaggcttcaatttttgaacttcagcacctgcattgcttgatggaattcgtgaatgacacttgtttttcccctttagagacagcaatgacatgttgaaatattctagtcctagaataagttagacaataggcggtacttgtgacattaggatgcagccttagctgtgaagttgttgcggtatttgttggaatcgagactcatgttgttgctccagttatgtctt

SEQ ID NO: 7183 - DNA, 454 bp, Glycine max
tcgaaagattcatctgactcagatgaggatgctgaagaaagtgaggaggatagtgaggatcaaattaatggtgaggctgaggcgaaaaggccacgtggttctggtaaaggccgaggtaaggcacccaaaaagtcaggtgctaagggaaaagggtcggtctctggccgtggtcggggtgggactgcagctaataaaaacagttctaaatcccctcaggtgaaatctggtaagagaggaagaccccgtaagtcataacttagatttttgtcggaaattttgttctctatacctagagaatgtagcgtgtaattcattggcaggtgattatacttagtgttttgttgttattataattcaatcccgctaactatttaattcaaagtttagaaacatgttgaatttgctaactgttttttaagacgcagtgggaagaattgcccgcttgttataaatt

SEQ ID NO: 7184 - DNA, 227 bp, Glycine max
ctctctctctttctgccacacatcaaacccaacagtctcagcattgcagcagcaactgcaccactgctctgctgcttcagctctcagaagacgagtaaaataaaacaagaggggatacaaagctcccatttttatatgactccaacttaaatctcactgaaagcttgatttgatgctaccccaaaatacacaccctctttcccccatgccataacataaagaaaaaa

SEQ ID NO: 7185 - DNA, 656 bp, Glycine max
cgttaaagttccaaaataatgtagtacaacccaagggtcaatattcaaacaaaacaaattgtttataaagaagaagaaaaatcatttaagtgcaaataataataataaaaaaaaaggatactttcaatgaattgttaggtgttattaagcttggacaacttgtctacaagtatttgctcgctgaaaatgctattcatgttcttcacctcttttccttcactagacataattttatcaaaaccctatgcccctgggaaactgttttatcgaaaataaaccaagtaacatctcaattttcaaacactaaaaccctataacagaattgggaccaaaatgagcttcaatatcaataccaaccagctaaaaaaagtgataagagaaggttcaattgaaaaacaatgaattcgaacaattaagtgaatgcaaagcaaaagaaaggagaagaaattgaccagagatagtagagcaacaatgctgggaaatcaggactagtaaaaatgaccatgttttgggaaaatgagattcacagagagatcttgtaccaaaaaatgatagaaagataaattcccccttcgaaggacacaagcttgttcctttccacctccaccgaacccccgatgatatcccccttcgacaacgacgtccctgcctccgcc

SEQ ID NO: 7186 - DNA, 643 bp, Glycine max
cgcatcgcaacacagactttttctccaaaagcaactcaagggtaagtaaacactcaacatcatacattgaaaatacataaatatatgcataaacaaagtgactaattagtagtgggaggaatgagatttgtggtttccttgatcttggatatgaagaggctttgaaattctgaatccacgtgaagagatgcttgttgcacagatggtgacaaggcgctccaaattgatgcccttccacccaactcttcaaataaaggcctgcaaagcaaataatgcaattaattatttttctatgcacgcatactgtctcatacttttaaaaacattatcaactatttttcatgttattaaatgtcacgtacgtgttacttcttggttccttgcatggatttaattaacattagactaggatttaaaatcccaacaacttactttgtagttgtcacgatagagtaactctcaattccttcttccccagcaatttgtgcaaccacaaagaattgtggcacaacaagcaaatgaccagcctcaacttgagtctctaatgcacacttcccactaaagtccacaatttcaatcttgccacttcctctagcaatgtaaatcaactgaaccgtagggttgattgggtatgatggtgccg

SEQ ID NO: 7187 - DNA, 1060 bp, Glycine max
  misc_feature (1003)..(1006): n is a, c, g, or t
  misc_feature (1015)..(1017): n is a, c, g, or t
  misc_feature (1021)..(1034): n is a, c, g, or t
  misc_feature (1046)..(1052): n is a, c, g, or t
tcttcttcagattggaaacgcctcaatgatggaagggagagcgttgatcttgatgatgttgtaacgcgcgaaaccggtttccttgaacagccacttccagttctcttcggtcctctctttgccaccggcgttgtgagcgagaagcatcatgtcgaatgcgatgccaacgtctgtgaagagttcgttgccttcgggtcgaagaacgtgatccacgattatgacttttcctgtcttctctggtattgccttcctgcagttcttcaagatcttgatgcagtgctcgtcgctccagtcatgcagaatccactgcatatatttcaccccaaagaaaaaaatttgaagggtaagtgcacaaaatacttgacttgtaatgaaagacttgaccatataccataaaaaactatatattatcatataacaggatttaaattcaacacagtggttagtttttttttttatgtctgtgttattagttatcggattagagactaattttatttataatatataatttttgttgatataaaatttctttatacatgatcaaaatcaaatacaaattcttttattaaatatattacttatatatatatacaataaaatcttacatcattatattaaccatttggattatattaaccatttggattacttgggtaatagttatttatacctttctttcaatttttttaaaagatgtacataattatgcatttatgactcattataactcaaactagttcaaactagtaatacaacgatataaaatttcattacattaaatttaattatgtttatgtatgaaaactagaattattttttaaaatactaaattaatatgcattgtttttctcattttataattacatgatatcacttgttatatttatatattttttattatttttctctctcactcactaaatgttaactagctaatattatgagtgtacgaatatcacttttgcaaaagtagtgtgttagagtgttataagccattagnnnntgcattttnnnaagnnnnnnnnnnnnnngtttttgatatnnnnnnntgtaaata

SEQ ID NO: 7188 - DNA, 781 bp, Glycine max
  misc_feature (519)..(555): n is a, c, g, or t
  misc_feature (558)..(567): n is a, c, g, or t
  misc_feature (569)..(688): n is a, c, g, or t
  misc_feature (691)..(721): n is a, c, g, or t
  misc_feature (725)..(759): n is a, c, g, or t
  misc_feature (762)..(770): n is a, c, g, or t
  misc_feature (775)..(776): n is a, c, g, or t
tcaaccatagccgctattgccttttccgtcatttcatcccttttacttctccggtgctctctcctaccggtggcaaacatcatcctgtccagtttgcaactacagtgcggatacggtttcagtgacaagcatctttacctcggttgtgaacgcctgaacgacgacattcgcacaacggcacaagggagaaaacgaccacgggtacctttcataaatatgaaaaacgaaaatgaccacgggacattgctttgatgatgttttattctttactgttcttcactacaacattccaagtgggtcattttgcattgcattttcttactctaacagaccatggcttcttcttcatctcaacatttgtcccatgcacccaactctgttcaacttcagtaattggtcatttaaaggtgtttgattaccactttctttggattggccgcgaatcaagccaagatcttaggaaaaaataagctcaaggccaagagtttacgtggagttgtgtgctgctgaagcggacannnnnnnnnnnnnnnnnnnnnnnnnnnnnnnnnnnnnttnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttnnnnnnnnnnnnnnnnnnnnnnnnnnnnnnntttnnnnnnnnnnnnnnnnnnnnnnnnnnnnnnnnnnnccnnnnnnnnntcttnnttttt

SEQ ID NO: 7189 - DNA, 470 bp, Glycine max
tattgtacagtcttacccttacatatgtaaaaggagtattttcgaattcgaacctataatcaactccttaccaaggcacaactttatgactaaaaaaataaaaattcataagtgcatcagcaggaagaaaaaaaattcaggaattccccatatcatattactccagatacatgaatttaacccaatgaaaatccacaatcatcaaacacaaaagaggcagtgaattacacaatgaaatctacaacagagagagagacaatggatctggaaactaatgaagggtaccctgaattaagttgtagcagccagagtatgtgactgagaactgaactgaactatgatcactatgtgactatttccacaggatacttatgaatgcaatcttcccatggtccattaggagaaggcctcacattcctcagagcctgccaaaccgcactgttacacttgaaaccacttccaaacgcagc

SEQ ID NO: 7190 - DNA, 357 bp, Glycine max
taaaagttatggcctctcaaaatggaatcctgaacgatcactttaggcatgtgttcgagacggataataaccccaacaactacacatttccattcccaactaacaacaggattttttaggattcaaccaaagaaatgatacaaagaaatgctgataaaacaaatgatacaaagaaatggctgctttactatacaacctcactagtcagttttgtcttgccattcatggcatgtgacttcttttgacgttctggctgttctgctttattgctgcttgggtttgaaccattcatcacagttgaattgcttacaatcttagtttctttcgattctgccccgagataatttgacaatacaa

SEQ ID NO: 7191 - DNA, 528 bp, Glycine max
caagttaaatcactcctcctcctcctcctccatcttcctcatcatgccaggcctctcgctcacggaaaaccaatcctttttcgttttctccggcctcaacatccccaatttctcctccacgctaagtctctggcgtgaagctttcttagcggtctcagtttgattctgatccaactgatcgaagttacgtctgagataatcacgaatagtttgcttctggaacgaggtttgctgcggtggaggcgcggtggtccgggcgcggaattcgtggaggtttttgttgatgtcgtcggtgaaacctggttgggagttagggggagtgcgaaaggaggaacgcgtggtgtttgagggagaggattgtttgagattgtcattgaaaagggaagataagggagagttggagttggtggagaagaacaacacgcttcttcttctgcttctgcttcctagacggagaacaagggccatcgctgaactcaatcaagattgttgggacgacgttttccttcgtagggtttgttaggattt

SEQ ID NO: 7192 - DNA, 314 bp, Glycine max
taatgcataagaacttatattgtatcctcgttgccacaattggatacagaaaaagatacgttctatcaccgcatctattataaaagtagtctaacattaatttaaatgacaactattaatatgaaaaggggatcgaaaaaaaggaatgaaccattcttcaaacattattattcttcatgtttaacacaagcatcgtagacacattgtcttagttacagaactgcatactattcaacggctcatgccattttcgactgatggagctgttgtagcagtcatggctactccccgacttcgttgctcgacattaccta

SEQ ID NO: 7193 - DNA, 662 bp, Glycine max
  misc_feature (56)..(59): n is a, c, g, or t
attgttacaattccctgctagagcataaaagattaaaatgaaaggccaaatacatnnnnttcccattctccagccatagttagagataagagggtcaaaaactcaaatgtacaaagccacagccttactccggtgattggagaggctttactgacgggccaaaatataataatgaaaattatccaatggcaataatcaatattctagattaaaaaattggcttgtagccagaattcttgcatccatatactatattcaacagccaggcctaacctaaaatttggaaactaaaaatgaatatctgtatctgacatttgagcaccatcaaatacattctctcccaagaaatcaatgtccagtcagtgtgtatcatgttgataagctgttgccatgatcagatggtagccggaaaggaaagtgtgcaggctgtatttttaaagttggtgagtcaggctttttatcatcaaacttgtagcctgcatcaaattttacacttgagtacataatgtattttccacacattgataatatgattaagcaacttttaatttaaatttcatattgacaatattacaatcagtctcagtttatgtgtagtatacatcgtacatccatatttatattttgcatatgaaaaggttggcttggtgattgaaaggaaa

SEQ ID NO: 7194 - DNA, 388 bp, Glycine max
taggggaatcctaaaatgatggagtgaaagaaaatacctgggggacgttcttccatatgtaaaaggtaaagaccttgaggaagtctgcaagaaatcatattatggcgttacaaagaagtaattaaaagaaaaaaaactgcatctacttgtgtcgttttgtgtttaagaagaattaacatacgcataaggtaagaagagtgtctcataagaggagtcattatcactcctgggtggactgagtttgctgtaatgttcacaccctcttcctgtacacaaatgtcagaaccaaaaagtaaaataatacatgtttaacgactaggcaattagaatattctcaattttccaatccatggtatcatcaagaaaggaaatggtctttctgtagttt

SEQ ID NO: 7195 - DNA, 343 bp, Glycine max
ggagaaataggaccggccagcaaaaagagaactaactagtaccaagatccatcatacattaattgattcctcacatgactagagaccaacgaagctcactattaattggttcaacaacacttcgcatattatataatagtattcgtgtagatacgaacactagtactagtgaaaacacacacacacacacatatatatatatatatatggttgagtagttttatatagtaattagatagattcatatgtatcaagcactaattccatctcgggggttaaattttgatgatctcgtgcttgctacgtgaaactgcgatgcatacttattggacgcacacacaca

SEQ ID NO: 7196 - DNA, 529 bp, Glycine max
aaatatgctataaatcacctcagctactttacagaatcacacagctgcaagaatcaatgcctctcttaagattttttgggtagtcttccatcaacaatacctacaagctttttaattaacctaccccacattgcaaagtctaaatttggagacattattatatagtctggaactatatatttccgactaatctccacattaatatatataaacacattttataatttatgaattacattttcaatttactaaaacaagttaataatcaacaattatttttaaaaatggtaataataatactctctgacactttcttttttttatacattttatatgatttattaaaattgattaaaaattaccaattttaataaattttacatcttatttaataattttttttatttaaatatgagacttcccaaattcgtaatctttaacaaattttaatccatcacaatttttttttttcaaaataaaatgggggtagctaacattcctatttccttttcctcctaaaactgaccca

SEQ ID NO: 7197 - DNA, 680 bp, Glycine max
  misc_feature (659)..(659): n is a, c, g, or t
ataaaaattctcaactgaagaataacaaatgaaacaaataagggattttgttgacttcatttcaaagaaactaaaacactaatatgaccttctgagaaactaaaacaagttaacattagaaaacagtttgaactttaaaattcaactatgaaatctacaatccatgtttttatcctgctgttgaagaaataattaattcaggtcaaggaagatagcttactgttgctgtgcagctaaatcaatttgaacttctggtggagccaatgcaggagattctacgaagtgcaagttaggatcactgcaaaattgacacaagtagcaaaaaaataagtcgaatgtatttaaaagtttgatgtgttcttacttctgattcctatataggaattaaaaagtataaactagtggtagctaccctgcaagtttcctggccaaatataagaatggcttttcaaagttgtagttgctcttagctgaaatctcatagtactgcaaattcttcttcctgtggaatgtaacctgctttgccttaacttgcctgttcttgacatcaaccttgttaccgcaaagaacaattgggatgttctcacagaccctgaagaatcatgtgagcaaatatttcccatgtcacaaaacaacatgatgccaaataatttgagacnaaacattcaaaatgttttcaa

SEQ ID NO: 7198 - DNA, 770 bp, Glycine max
  misc_feature (61)..(67): n is a, c, g, or t
gacattatacatgcacacaaagactaaacaaaaatgaatacagcaaaggccaaaaaagctnnnnnnncctcagctttcaggtacgagaaaatgcgtcacacatcgaaaggagaagaagggcctgatctgttctgccctctcttctcgtacgcatcagatcccgaccttcttcgaaaccgaagcgaatcttttcctcctaaaaaacacacgtcaaatcagtaccatttattgttgggcacaaaattattaattatattatactagtataacataatataaccaagttggctagcctagtggtgaaaatggacacttggattgagctctgaacccaaaacaaaatgtggatatgactgtataagggtcatatatactactgtgtgactaagactaatgaaagtgctacttatgtggacagccacataaaatttgggacaagtcaatttaacaaccaaatagtatcattattcattcataactactcccaccaactacactgcttatcatgcctggccagtcatcacaaaaggacaaaatatccgatacccgaaattgtggggagttgtttacttttactggaccgtgtgtgtaattaaactaagcatagtattttttactgtcacagtagaaaagaaataacgaccttaccggaaaacggagaaatcggaggagtagaaccggcaggagaaaccggaggcgatccactctggtaccctggcggttcacgatcatgatactacgcgtcactctagtcgcttcctccgacgatt

SEQ ID NO: 7199 - DNA, 495 bp, Glycine max
  misc_feature (456)..(467): n is a, c, g, or t
gtgagacctactcggttctagtgaaaaccgatcaagacccatcaaggaactattggatcacctcaaacgtggtaagcagaaacagaaccaccccacccgggttgggcatgttcaactactaccccaaccaccctaaacgttctcctccaacggttccaccttctcctcctgcttgggacgacgttgagccaaggctggcacaaagcctctccatcaaggcacgccaagggtacatactcaaacccccgacaacctcggacagagtcatagtactcctcaacacgcagaacaacataagcgaatacaggcattggtctgtgaacaatgtctctttcacactccctcataccccttacctcatttccctcaaagagaacataaccggtgcgtttgaccccactccaccccctgatggctaaggctttgcaaactatgacattttcagtgtggctagtnnnnnnnnnnnnaacttctagcagtggcatttataggctc

SEQ ID NO: 7200 - DNA, 295 bp, Glycine max
cactctatttgatttgcaatcagctataatttggtgcctgaataataacttaacatcctttagaccccttcaagcatgtagaaaagtaactttgagcccaagatccattcctgtattgccttgatagactgaaagtcattatcacttaataaaggatgaaaaaattgagagaacaaaccaatgaaactgaggattttaagactttttgttcattctccgaaaccgtaatgaaattgggttctccaagacagaaactttaatattattccaaatttctgatttagttggaagctga

SEQ ID NO: 7201 - DNA, 557 bp, Glycine max
acgtgtaccaagccttgtgggcttgtactgactttctatgaaactgcaggaaaggaaaaacaaagaagaaaaacactaatttcccccttcgccaatcactctcataaatcatattacatccatcttcctccgccttttattgggctggttcttctcttgctaaaggattccaatagattgggatactcttcaggatcaacttaagtaataatataagcatcaattgggagcggagcagaattataaacagatcagatgagaggcaaaagcataaattagagctacttctatggaggttgctgatgtttgtagctaaatgcataggcatccctatcccagccaccatctggttcctttcttttcacactaactccggaacttgaggattgtggaagggttctcacgtgctcctccatggctctgccttgagcaggaaagaaaaattgtcttgcagtcaacatgtctctgttccctccatcaattgtgaagccagagttcaaatcaaagttgggacgtgaagatccaaccccatttaaaccaagttgtgtaccggtcat

SEQ ID NO: 7202 - DNA, 285 bp, Glycine max
tatacttgcctaatatggatttttttttctttttctttttcttacaggactccaattgcaaccatatttaagactgatgagacaaaagatacaatatctcctgttgtggcttctttctcttcaaggggtccaaacattgttacacctgaaattctcaaggtacctttattagtttttctgtactgaattaaatttatctttatctagcattttggataaactactgtatagtcccataccaccacatatctatagtcctcgacaatctccaaagggtgcatggtc

SEQ ID NO: 7203 - DNA, 592 bp, Glycine max
ataggacacccataaccaacaacatgggactaccgttggttatgctggtgacactggaaggcagcatgggaatacaggtggcctttactatggaaccgacaccgcggacacaggaaccggtcctagaagtggaaacaccggtggcaccggttatggaggcactggtggtactgattatggaacagctggtggcactggttatggaagtggaactggctatggaatcaacactgggggtgcgcacactgaagcagggtatgggaaggagcatcgtcagcatgagcaatctcatggtggtcagcacgagaagaaagggatactggacaagattaaggagaagcttcctggaggacacagtgacaagtagatgcatcgtgcatgcatgcatatagtatatatataatattgttgtctttgaataaatttgctgcatatgtacttggaggatatagcatatggttatagtatattatatagaggaataaaaaatgtatgcctgtaatgtaagggttctcatatacatggctgaaatataaagcataataaaggcattgatgttgtgccaatacatatgttgagagttattgggctt

SEQ ID NO: 7204 - DNA, 467 bp, Glycine max
ggaattttaaatcgtactataatagatagcaactttacgcaacaactacgattatgtaaacagcacagaaaatatggttgatccataattatacaggaccataaatggttatttaagaaacaaatcacccaaacttgagatatttggcttagatgagaggaagctaacgagaaaaatagctttacttccagctgaagcctttgcttaccacctcacaagaatttttctatgcttgaggtcaatgttgtcttgggcacagctccaataactgtatctttcttctcaccattcttgaaaataatgacagttgggatacttcggatcccgtaccgagtagcggttgaagggctttcatcagtattgagtttgtagcacttaagcctaccaacatattcctttgccagctcatcaattatcggatggatcatacggcagggaccacaccatggagcccagaattcaacaaa

SEQ ID NO: 7205 - DNA, 588 bp, Glycine max
  misc_feature (38)..(40): n is a, c, g, or t
ggaaaccaacctgccctgcctttgcattcaccctcggnnnatccactgtttgtcacctgttaaaaccacaaccaccataataatagcaaaggaaaatcagatcaaacttgaagaacaaggattttttgttagcattgcatgacaatggtaaaaatgcattctacttggttattcccgcgtcagttttgaattggttcatcgtaaaatataattatattcagatgccgaaagctacgaacctttcgaacaacaacataatcgccaactgatagatttagctccacttcagatacagcagaatatggaaataaaacctgcaagaagagcaaaagttacaaaagaagaaagcagtaacctgtattcaatatttaatatctgcaagtgttcccctgtgttcaaaaaagtagaaacaatctcatgccaacctctcccaagaagtaacccatgctatctgttgatccattgtgtgtcggagaagcatagacaccattcacttcttcatatgacggaggtggtggcatggtgttatccagactaggagtagaaggggtttcaatttgtcgtcgttctgatgtcacttctccctcc

SEQ ID NO: 7206 - DNA, 608 bp, Glycine max
agtcagcacacccttcatcaagaatgaacaatttacagattccttgtttttcaatgagagcacattacatatacaccctgatcatgctttaaaatgcactcggttacaatatcaaatttgtcatgcattcattcgctcatgagcaattcaactagtagactcaatgagagtacacaatcttcaaagttcagaaattgtgtcatatgcagcataattctgaggcctctctgttgtcttcaagaggaaaaaatggatgatttactgtgatgtggaagagctactaagtgtagggtctgtttgatagtatacaatatcgccactgtcactgacaaaatggtctttcttcatgcttcttaacaattctccaatgaggtaaattggaagaggactagacttctttggttcgcggtagtattgaccaagaactggcttagctgcttcagtctataagtggagcaaagacagattcaaatttatgcaattaatcaaaattactaatctttttactcatcaaattcaaaggaagggtagaggggcacaggaactcactgcttctattaagtgatagtgtggtatttgaggaaagaggtgatgaatgacatgggttc

SEQ ID NO: 7207 - DNA, 559 bp, Glycine max
acatgcatgacatgaaattaagcacaccaaactcaccaagtccaatactaaaatttcaacacaacaaaagcaacaataacttatatatggaagcaccacaacaacacaattacaacaacgaaaagcttaattattccattaagtaaggtcgactatatgaattattagacgttattcatctcggttaaagaccatagctagcttcaagaatattatttaatgtaagatctttcttgacaactttctttaatgtccttcttactaactctctccatcttttcacagcaggatagacaacaacacaagtattcttgaaccctttgatgcagcagttaactaataacaacagtattagatactattgattgtggtgatcatgaaccctcttggtgatgtgatcgttaacgtgttggctgaaagtagcagcattcactagtggcgattcccacagaaccccaagttcatcatcgtaaccttgcgctgcagaagcagtggcgattgaacccagatgaccatcaacacgatcatcacatggaagtggattcatgatgctacgctc

SEQ ID NO: 7208 - DNA, 366 bp, Glycine max
cgataactagataaccacaattaaagctatatctatctataactaaagggctcaagcttttaataaaatacaagttttgaaacactaattaacagcttaattaatttcctgcaaaataataaagcctcaaacgtcaatcgctagcccaaacaagacaatatgcatcatggtctcaactggttacaaccctttttgatatatatagtttgttcaaccatggcatatcgtgctttacttcaatcttgattcttgacaaaaggattctgcttatgcttatgcttctgcttcatgggcacaacatgggtgtgatataatatgacattaggctttacatcgaagtccctgataaaacgatccttctaccta

SEQ ID NO: 7209 - DNA, 348 bp, Glycine max
atatatagctttctgctgctgctggagctttaaagtgtgattgtttgactttgatgtcacttgcaagccattatatctcccgttacgtcatacatatctggtattacattgatatttatatctttcgtttgttgaaactcgcgaaaattctgaagccataagtggtccctatggggtcattaagactaattatacaggttacagctgtataagtggatattcctgtctatttggacctgaagttgcatggaattatatttgactattccataacgccgccgccgcctcatcttccctttcatacccggtgttgatgtagttagtttattatgacctttggtgttacgg

SEQ ID NO: 7210 - DNA, 511 bp, Glycine max
  misc_feature (68)..(68): n is a, c, g, or t
ctgctggatcttctacagcactggttcacaaggcggcggacaagagactacagcgtaagcgccccttntagcttagtgcttggtttcttattgcgcgaccaaagatgtatccaatattaacatgtggaatccatgacaggctcactgctatcactcaactggttcatcatgggatgatattcattccaatcggttacacgtttggtgctggcatgttcgagatggagaaagtgaaaggtggaagtccatatggtgccggaacttatgccggtgacggctcaagacagccaagtgagcttgagttacagcaagcattccaccaaggcaagtacattgccggcatcacaaagaagctcaagcaagctgcataatgtttgccttcatatatatagattatactattattattaaaccataccacaatattgcttgaaaatcattaccgattttttagtcttgaaatatattgacttttgtttttctgagcttgcaagtatttttttttttcttt

SEQ ID NO: 7211 - DNA, 200 bp, Glycine max
tgcgattattttttgggagacctctttaacatgttgccaataaagtcatattcatattcattttcattcctgtacaattgagtgaagttatactaaatgcaacacataacatatccatgaatttcaacaattaattaaatcaaaagacaagttaaaactaaagaaagaaggaaagaaactaagttataaaaataaaaaaa

SEQ ID NO: 7212 - DNA, 261 bp, Glycine max
gaatgttgtaaagggcaagggtaacgattttctgtaatcctttctttacaagacatgctgacatgaaagttaaagattcaacatatgaatcgactaactatttccaacaaggaattaagccattgttgtatatttgacatatagataggaaaatggctatggtcctccaagtactgcattctcaatgtcttctctgcttaaagcataactaaacctcctctccatatttttttcaagattcccaggtccactcttcaaata

SEQ ID NO: 7213 - DNA, 599 bp, Glycine max
cattttgtttatacagcaggcttaattccacacgtacaagagtgggatatacatgcatttctacattaattatgaccagcattatttccttattggtttgtcttgttatgttggtattaaacaggtattgtgcttgattctggtgatggtgtgagccacacggtgcccatatatgaagggtatgctcttcctcatgcaattcttcggttggaccttgctggccgtgatttaacagagtacttggtgaaaatccttaccgagagaggatactccttcagcacctctgccgaaaaggaaattgtccgtgatgtgaaggagaaattggcatacgtggcccttgatttcgaacaagaaatggagactactaagagtagttctgcagtggaaaagagctatgaattgcctgatggacaggtcattacaataggttctgagagattccgttgcccagaagtactgttccagccttctctgattggtatggaagctactggaattcatgaaacgacatacaattccatcatgaaatgtgatgttgatattaggaaggatctgtatggaaacatcgtgcttagtggagggtctactatgtttccggg

SEQ ID NO: 7214 - DNA, 385 bp, Glycine max
ggaaatatgctgaaacaggaatcgcttatagctaagagaacaagaactacatggctagcttttgtagtatggttcttatcaaaacccaacaaaataacaatgaaataatgagtgatctatgtagcccgccacaaaaatgcataatctgtgatgtctaaaacatgaaaccgctttaatatatttaagcagttttcttgtttggctcaaagacatacttgatcagtgattccttgatggaaagaagctcagggaactcgttcttcagtttggatgcatccatctcgttgttgctccgtgcagcaattatcaccttggcttgctcttcaagattgaagttagcccacttgaagcttggatcgatgtaatccctgtacatctcaagaat

SEQ ID NO: 7215 - DNA, 570 bp, Glycine max
  misc_feature (53)..(54): n is a, c, g, or t
  misc_feature (558)..(562): n is a, c, g, or t
cagaaatggcgagggcaccttgtttatcagaataattatgataaaattttccnntctttatttggatcaattttaaatgcttttgttctatttctcattgtaatcaatatagtgattaaccatctaaattacaatttcaacaattcttccttcatgtaatgaaaatttcatttcaaatgcagcgtgaggagctcgggattttcaattaattgcttccactcgttgcaaaatcttgcaacggttgctccgtccaagactctgtgatctgcaccaatattaacctggaagcacaaaaacaaatcataaagtgctgtccatttcatcttcttacccatgcaaaaatcgtgataattaacatttggttaataaatatagttagcttagtgcaaaaaaaaattgaattcatagttcaaacctgcgttttctttgtcatcaaccttgaacttctttgttcaatgcaaactcaacctatacatctaagttatctaactataactatgaaaataatcgaactacaaaagctgaatttgcagtaaacatgatgcaaaccgaaaagcnnnnnaacccttt

SEQ ID NO: 7216 - DNA, 408 bp, Glycine max
cacatgatagaattgccttaatatgtcaaattaattggattccacgagaacttaaaggccaggccttccagaagctaccaaccaagaaatatgacaagataatggtacttactatttcaaaattgcaggcctaatggatcccaactccctttcattcctcccaccaacaaatgtcataccatgtgccctgtcacaacactaatattgagttgagcataatatcccacatcaacattgctttttacacctctcatatcattgccaccttagaaaagagatgcaagcaaaactccagcatctggctgccaaaactttttttcttcaatctttctgagcagcctgaattgttgttgaacatgaagcagagcagcatgggcctccagaacatatgattaggagtgcaattgc

SEQ ID NO: 7217 - DNA, 454 bp, Glycine max
agaacaattacatgaaagctgatccaaatgccccaccaaagaggggacgtggaaggccaccaaagccaaaggttccattgccaccaggcactgttgtgtcccctccaaggccaaggggtcgtcccccaaaagaccctaatgcccctcctaagtcccctaaggctaaggccacccctgccactggcaggccaagaggaaggcctaagaaggttgctcgctcaccggccgtgccgtctcccaccgccgtctccactggaaggcctagaggcaggcctcccaaagtgaagcctcagttgacagaagttagtgttgagtcatagaatggtttcttagttataatgccaaatttagtgatatgctctgtagtggtggtgggtgtggtcttagattttgtgttgatgtaatctctttgtaaaattatgtagtggtagctaacctattgtgaggctttgtg

SEQ ID NO: 7218 - DNA, 494 bp, Glycine max
  misc_feature (432)..(433): n is a, c, g, or t
  misc_feature (473)..(473): n is a, c, g, or t
  misc_feature (475)..(475): n is a, c, g, or t
  misc_feature (477)..(478): n is a, c, g, or t
  misc_feature (483)..(484): n is a, c, g, or t
  misc_feature (490)..(490): n is a, c, g, or t
aataatattttttcacagaaaatgtaaatcctttactaatgtaattgattgcttctccattttcttttctagttctgttgcttcacccacttgaaacaaatttctttctctgatttgtcgttggcttttcatatctcaattcagcatgtgtaaaggccacatgtaaatatgattggctatgaaaagccaacgacaaatccgagaaagaaatttgtttcaagtgggtgaagcaacagaactagaaaagaaaatggagaagccatcaattacattagtaaaggatttacattttctgtgaaacaatatttcagtttgagttatattgctttaaaagagatcacttgattggtgcaagaatggtgtacaacagaagaaatgtgacaattataattgcaccccctaaagtgaaagttggactattcctcgtgaaanntttccttcatctttggatgaatgtatttgtggatttgggnangnnaaaannaaaaanaaaa

SEQ ID NO: 7219 - DNA, 1142 bp, Glycine max
  misc_feature (41)..(45): n is a, c, g, or t
  misc_feature (1067)..(1069): n is a, c, g, or t
  misc_feature (1072)..(1075): n is a, c, g, or t
  misc_feature (1080)..(1082): n is a, c, g, or t
atgcattttcagaataatctcttcaactacaaataaaagcnnnnntttgctatatacagcattatttacaagccgatactaatgtaatggtacactgttgtacacgctggagactattggcttacattccaacatttcctcttttggagaattatgtagaagctgcgtaattcaggttttgtaaaccaccattcctttaacggttagtatttatcaaaatcatagaactctatgttcttgtatttctgggatataatctcagcttgaacttttcttgctgtgtctgttgcacaaccaacaagaataagaatagatgttcctgcaaatccccggaatgcggtcaagtgagtgatctgttcaacaactgctggaccagcagccaagatagccaaaaatgttgaacccagaactgatattctactaagaacctgcaccaagagagaaaaccaatggttgactttttttttaagttcaaagatagaatgttcattgaattttcaaaataaatctaaaattaaattccattcacaaggagggatatcacaagccgtacaattttgaactttaatctaactatcacaaactacaaagctaatggcatatactagtatagcacatgtataatgctcccttcagtcctttgtataagaaacaaataggtctatttttttgtcctaattataagaaacatagactcaccttcaaatatatcattgttaattttcttttatacccataattttattatgaaatatattaaaatgacacacttactcacaacgcatgtaagtagatgcatttattaacctaataacaatacaagccacactcattggtggaaaaaattattccttgaattatgtgaggtgtcattaaatataatcactactcactagtcactatttagttctaaatgggtattttaggaataacatttaaatttatgacaatattaattaaattaactagcttaagtgttaactacttttattgatcttgatgtactagtcatttgtttcttatataaagactggagggagtatatttttaagagaaaagacagtatnnntcnnnnaaagnnngcaaagtgcaaaactagaaaaggacggaattactgttttgataaatgtagctgtagtctg

SEQ ID NO: 7220 - DNA, 485 bp, Glycine max
attcagtggcttgctgttaacgctgcttatgaggggtataaattatcatgctgtttcagaataatatgttttgaatgtcgaaaattcaagacatagcacttcacatctttattaaggatcaattatatgttttagaataataaaatatttgctgcgtcttttactactgttattaaggatcaattattcctaccaccatatcatgacacttcacataaagacgttctagatacaataaaggcaactataattgtctacttctcaacaatatatcagcaaatatacttctcaacaattatctcataaaaagcataaaccagatttcatatttgctgatttttgaagattatcaatgttctgtaatagaggttattagcaagattaagtttcttatgtatagagaagcttacgtgttgcatttgttttagcatcttgatataggccttgtattagggagacttttgattttctctagatgtggggta

SEQ ID NO: 7221 - DNA, 746 bp, Glycine max
  misc_feature (47)..(50): n is a, c, g, or t
  misc_feature (645)..(645): n is a, c, g, or t
  misc_feature (647)..(648): n is a, c, g, or t
  misc_feature (681)..(682): n is a, c, g, or t
  misc_feature (689)..(691): n is a, c, g, or t
  misc_feature (702)..(703): n is a, c, g, or t
  misc_feature (724)..(726): n is a, c, g, or t
  misc_feature (728)..(735): n is a, c, g, or t
aaacattgattctgagaagcgtatagtgaagaggaggttggaagacnnnntatggtgcattagaacaccaaaatctagcatcatagaggaaacttctacagataatcagcacctggatcaggttgctcatctggtctgtccaattcttatgcatacaataactcttcctgatttcatcttatgctgattgaattaggagcacaaacatagataattggatatgaattaagtgttaagaagtttttggctaaatcaaaatgaagggttatctgatagtttgttgtggatcatggatcacgaatgcctaggattaacataattttctagccttcctcattttagatatatatttatttatttatttcagatttaatagacagatgaattttgaaatgctttctttaaaataagattgtaatagaaaattgcttgctatagaaatataatgattgcttgcagttgttgctttcttagaaagaaattcagtatttgagctccagtctgatttattcattttctttattcagcttatatctttgtctgcaaaaaggtactgatatcaatatggatgctgaaggcttgaggattcaactataggaggcctctagcacataaaaaatgtttttgttaacatctaggcacccntnnttttttttttctttttttttaaaaaaattattnnggttttnnnaaccaaaaaannaaaaaaaaacgttttttttgnnngnnnnnnnnaaaggcccttt

SEQ ID NO: 7222 - DNA, 210 bp, Glycine max
tacctttataacaaagataaaaactagaacacatcttaaagatgacaaatccaaatctacaaaagtgtagataacacatttattatttactaaactatgctagctttgcttggtgtgattagctaggtgtgtgaagggcccaattggatagggctcaccttctatgggctttacgggcacttggtcttgttaccatgggtggtcatatca

SEQ ID NO: 7223 - DNA, 684 bp, Glycine max
  misc_feature (562)..(563): n is a, c, g, or t
  misc_feature (579)..(580): n is a, c, g, or t
  misc_feature (587)..(588): n is a, c, g, or t
  misc_feature (601)..(603): n is a, c, g, or t
  misc_feature (605)..(609): n is a, c, g, or t
  misc_feature (634)..(636): n is a, c, g, or t
  misc_feature (638)..(644): n is a, c, g, or t
  misc_feature (646)..(646): n is a, c, g, or t
  misc_feature (655)..(657): n is a, c, g, or t
  misc_feature (660)..(663): n is a, c, g, or t
  misc_feature (671)..(671): n is a, c, g, or t
gacaatagttaaatgctaatactaagtcctaaaacagcagtagcagttttactctaacacatctaagggaagaaaggtaacaaaacaacctcactttgattaagttctctagtacctttcaggatatgcagaaaaatcatcttttaaagatgatgagacaggttacccactcagtcttcaaactttattttctttggagcaggttggatgttacccacctgtaacagcaattatatagttcagaatggagcaaacaaaccacagaatttgagagcaaaaataaaaaagaagacttttctaattttatgaaaaaatacagattgataaaagcaagagtctcacaatctcagggcattcataatcaatcccagcagcctctatccttttacgtcgtttttggtcatgtttcagaaccttctccaccaacttcttgtgctcttccaatgttctatcctggaatgacaacaacaacgaacagaacattatactgagaatcagactgacaatatccagaagatatactttcttattcattgatctagataccttgtcatgacgcttnngttcaatttggacagnntccaatnncttgtaatgggannngnnnnntctccatctacaaacaaaaatgcannntnnnnnnntnatttgatannnttnnnnatattcancatacaaaactaa

SEQ ID NO: 7224 - DNA, 339 bp, Glycine max
ttcatcccattggcagcattagtatccttaggagaatccgaaggagcagaaccagccttaccaacgctgggaatctcaggagtgctcttagaacccttaggagaaggagccgcagaagaagcacgagtcttggtggttccgaagagttccaacggcaacagaaccttgtcaacctggtacacagccagaggaaacttctccctcagtgggttgttgagctgcgtctgcaccacccctgtggagatgttcacctggttaccaccttggccggtgaagttcagcccccaggtcccttctttctccgtggcctgcgtcctcacggggttgctcacgggcgaa

SEQ ID NO: 7225 - DNA, 398 bp, Glycine max
gcagttgatttacgtgcttgagacctcggtgaaataacattttaatattaattataactcttctgtatattgaattacaatatacataaatacacttctaatacttgcatgctctatctttgcatgattgcatgcaaccttcggagcggcaatgatgagaactcagaaatagaagaagccggcaagagcagcagaggcagctccggcgacggcggagaagtgaccaagggaggaagaggcagcggcgctggaaggagaaccacccttagcattgtcgaaagcaccgggaggcacgggtccaccaatgggtgcagccacgacgctgttgggtgaagaagccgcgccgctggccgcggtaagggctccgatggagtaatcatcgtcctcatagtcatcgg

SEQ ID NO: 7226 - DNA, 523 bp, Glycine max
ttgtgtgatggaggattagcttcacaatcttacaaaaactgaaaactacacagtccactccttttctcattcctttgcaacaagacttcgaaaattagccatatggtttcagccagaatgtttagagaagcattggagaaccaacaacattagctctgctgacatctatgcaaaaaaatctcaatagtgacaaactgctagttaatttcacatctgtttgctttcttgtgatctacaagataaacttcaacattttgcctataatttccccaatggcaatactaaatcagaagtctgatatctgcaagccattggccacaaaataaatcaaatacaattcaatcacattatatttgcacatttcttatagtctactctacaccaatccgtcatcgtcactgccactgatagaaaatattgaacccttcatttgagatttgtcctgccgtagttttctatccttaaatctacggaaagaaagtgtaggatcatgcttagtgatagaaaccccaagactccgtga

SEQ ID NO: 7227 - DNA, 770 bp, Glycine max
  misc_feature (57)..(57): n is a, c, g, or t
  misc_feature (59)..(62): n is a, c, g, or t
tttttctatgagacaaaggtggcataatacagagcagatcattgcaaggactccccntnnnngagatacctgggaaaaagacaaaggcaagatctaccactttaataataacttatcaaccaaaagcttctttcaaccattttctgtatgtgcctctggatctgacctatacaaatacaaatgagaaccatcatcaattgaaaaccaaagcatcttaccgcctaggcacaatatatatataaagcgaaccagtactggagcaatatgtatcaaaagaccaaagcagacaaaaaaataattgtacaactacaaccagcactactgtaaagtgcagtcagccatacagccaaaggtaaagtgacacaggtgtaaataatctcatgcaaagaagaatgaaaggacagatccttcttcacattatgaaattgtccatctaatgttcacatcatttaaatttcatttaagagctcatatgcccatagcttatttagtttaacaagatcaacatgcctgacaatggaaaattttcaataccagagcaaaaaacaacctttcaaagaaaattttgttaatgcatgcattgcatgaaatgcttgggatcagtaaaatgattcctacaattaaactttttgagcacttcctgtactttcatcatctctccctattacgttcatccatttcatctttaaaaccagccttatagcacaacaggaaaatccttatccttttcaatttaacccatttttcgcaataaatcataagcacctaca

SEQ ID NO: 7228 - DNA, 325 bp, Glycine max
tctaaatgacatgattcctgaatgccgtgatcattttgggtgacaagaacaagatgaatgccaagattgaaccaaagaacatcttgataaaatatctaactgggtcatgatcaacatcttcagaggtgctggtcggtgcatatattgctgttgctgatgggagagcttctattactgcatctgctaaatctgtaatgaaggaaggggtaacaccaagggcaggtacacgtgcccaattcttgatgccagattcaagagccaattccttgtactccatgtcaatttcttcaagggtttcaatatgctcactcacaaaactcactgg

SEQ ID NO: 7229 - DNA, 435 bp, Glycine max
ctttatattgagagagcaatttaaattttaaatttttatgatattatttagataaagataaggatatattgttatcatttagatttagagtgctattacttgtttgattttaagattaggattcaaagtgtataaaaggaaatgaaatcctgattccatatctttattaataaatattcaaacaatagagtgtcattttttatgatttaaggtttatgcatataagaaactagcgtaataagaaaataatataaatgaataaaaaaaattggaaaagaatataaagtcatagaaagtttatctcccaacacatcaaatatgattcccccaacctctcactatatatagacacattgtttagtaatatttaattattcgttagggttacgaaataatagtctattattaattagagtgtttattggagggagcgca

SEQ ID NO: 7230 - DNA, 327 bp, Glycine max
atttagcactctagaagactagctcatggggcttcactccggccttcaaagaaaacctagcacccaagtaagacttgaggtctggaacattctcaatggcctttaacagagtagtgtccacggttttttggtcatctttcttttcttggggaagcacatttttctcctacaaatggataaaaatgataatagaaatcagcatcatagaagcaactcaaaataacaagggaaacattaaaacaaaactgtcaaaccaacctccttctctgcctcgaagaactcgccttcgccctttgttttctttttcttggcttccttggcaaagta

SEQ ID NO: 7231 - DNA, 705 bp, Glycine max
gattcattgaaaaggatcgacaagacatcataagtcatttgtaacagcagcacaagataaccccaggaatgaatcctacgcatgagccccctttcccatggccactgctaacacatctttgaacgcactgtgtattacctccgcatgctcctcttaggcagattagtcccggaggattaaaatccacattcgcttgtcctgcattattattcatcaccacaaaagtttcaaactttatatatacatatatattggttccttaatttgcatgtctttccaaaaaatttagcacatgattcttcggatttttatatattaatccaaccaatttgactccaacaaaatgaattaatagtgagatctgtggatcggattgttatctgcccataatttttttatttttaaaaaaaggttataattcatgggacaaaaactaaagcaacttgtcgaatcgtatctaacaactcaagccttttttccccaatcaacattagaaattagactcggaactctaacaaaacaaacaacatcacttttcagttttcacattaattatttctattagaatgcaaatttggagataaaattgactatatttctttacctgaacccaaaagcaaaacaatgcatagcaggcccaaaaggagagtttgattggtccgaaaagccatttagtaatgattttcacctcctgtgcttactttg

SEQ ID NO: 7232 - DNA, 687 bp, Glycine max
ttttgggtttgtccaatatgtggacccagctgatgctgcagatgcaaaatatcacatggacggtcgaattcttcttggtcgtgagataactgtagtgtttgctgaagaaaacagaaagaaacctgctgaaatgagagcaagagaacacaggaggtaaggattagttgtttgtattttgcaatgttatttaacaggttttagtagtagagtcttatattgtcatgtcattggcttttgtttattgttacctgatgtttgaatttttttttttaatttaatctctagggatcgatcgcatgattacaggcgatcttcacgaacctattctcctagtccagactattctccttctccaagacgaaggcgacattacaggtttgtttacttatgtaataaatttaatttctgatacaaaggatctgcagtgtttgtactcacctatattatgattcaggtcaatctcaccaagggacagaaagtatagggatcgatcatactctagatcatcttatgcatcaagaagccgcagcagaagtaggagttacagtaggagtttgagccgaagtccgggctactctaggtgattaacttgataagcatggtggtgggtgcggtggacaatgctttagtttgcatatgtattttttatggagcttgtgtgttgaaatacttcaaaatgttggtatt

SEQ ID NO: 7233 - DNA, 474 bp, Glycine max
  misc_feature (33)..(33): n is a, c, g, or t
  misc_feature (36)..(37): n is a, c, g, or t
ggtggattatatcaaacgcatgcaagcaacacnttnntcgctggaatttgctaggcctaccattttgagcatgttgcgatcttccttgaacctctccagaatagtgcccttgacagcatcattcttgtcttgtgtcgcatcttgtgtgactccccagcattctattacttcaggcaatatacggttagtcttggagagacaagggctaccaaacgtggtacacgaaaatgtatgtccttgatcaaagtttgctgatataaacaaacccaagtgattcactcgtcccccaaagccaatgccatttggaatgtcctctgaactgaagttgatagcgcactacacaatacatggacattcaagagttaaacaagaataataaatctataacaaataggatagagtgtgatgatcacacaggcagaaacaagtagatagtagttacccattgcagattattgtttgctccagttgggg

SEQ ID NO: 7234 - DNA, 353 bp, Glycine max
ctctcacccgaaagctggacgagattctgaccgagacggagaacgatgtgggccaattctctttcgaagaagaagcggttgaaaagttcatgcaagagctttacaaagagatcatcgcatccccaccaacgccgtcagaaccaccctcatcctcaaatgtgctgcaggtgcaaaatgactccattgttgctcaagatgaaggggatttcgacgacgatgagtggctcgctagggtccttagttctggtcaggctcaggtcctcgacacttgtgactgcttttgattttaacaacaaacaacaaaaatcagatcaatggtatcctagtacaatgtgtcatgtactgctcaaata

SEQ ID NO: 7235 - DNA, 509 bp, Glycine max
ttctccttggaaagaaagataaatagctgaatgaataggattacagagctaagatcacgatcgatgtttctcaatcttcttctcgagctcgtccttctttgcgcccacaaccttgtcgacttccttccctttcttccacaacacgaaagtcggcatcgcctgcacctgaaactcctgcgccacatcctattcccaaaaaaaataatccaaaacagaatataaaaagttcagaattattcgcggaaacaaaaattggagtcaattaagaagaattaggaagcgaaaatcacaggtaattcgtcgacgtcgatcttgacgaagtcaacgtcgttgaacttgtcggccatggcgtgaatcgctggctctatgaatttgcaaggaccgcaccacgacgccgagaaatctatcacaacctaattttcaaggaaaatattcagatccagcgcatagagaaaaaattgggggaaaatcgagatctagggatttacgagcttatcggtatcttagat

SEQ ID NO: 7236 - DNA, 749 bp, Glycine max
  misc_feature (60)..(61): n is a, c, g, or t
  misc_feature (712)..(712): n is a, c, g, or t
  misc_feature (715)..(720): n is a, c, g, or t
  misc_feature (737)..(741): n is a, c, g, or t
taacatcatgaatagttgtcacttattcgccgtgcatctagattgttgaaattttcttanncctttttccaaatggacatatgagaagctctcagactgttgccagaggccaatcataaaaaaacttgatggcttccttcagtggcaattatgaagtaaacatatatccacgccaactcatgaatagttgtcaggtatctttagaccccacgagaaatttggcaataaaaaatccaattgtatcaagcggagacgatggatcaaacctctgaacaaggtcttcctcccctggtcgtaaccactccctgcacagacatcatggtgtgcaccaaaaattggcactgaatttcttttttggacaaaaagaaaagaaaggtatatccacaaacaatactaaacagcatcacagatgagtgtgcatacaagatcgtctatgtaagggagaaataaaaatgcacaatcatggacaaatggatgaagggcttactctatatatccatcaggaaattcacagctaccaactagacccggtcctccaattcttgggtgctggaataaatcaaatagcaaatccgaataactcaaccaagtgaactaataattcattacagacaaactaaacatcaaaatttgtttgtactcaccacttacccatcttatttataaattataagagggatcatccttcaattaattacatgtataatcaagntannnnnncagcccgagaattatannnnnctaatcag

SEQ ID NO: 7237 - DNA, 525 bp, Glycine max
  misc_feature (508)..(510): n is a, c, g, or t
cacgaaagagaatgcaaaagtaggcgtgagagagtgaaattgaggggtgactctggagtcttctagggctgggactcgaagggaatggaaagttcctcgggctgggcctcgggcctgctggagggccttttgggaacggggagtgcgagaaaggccttggtcttgctgatgggcctggtcttctggagctggacgatgtcgccgactttgaattggttatcggggtcgtgggcctggtacttcttcttcttcctcacgcgcctcttgtactttgggtgaggggccagccgcaccacctccactgccaccgtcttgtcgctggtggagcacaccactctcccctgcattgtcttcatcgcattgatttgaggcaggaaactcggtggggcccagtgggtctgagtcaccgccgaactgtgcttggagagaagggtggtggaatgaccatgtccgttcagaaatggggttgagagctgcacaagccacattttcttatctcaaagcacgnnntggcggggggtgagt

SEQ ID NO: 7238 - DNA, 265 bp, Glycine max
aactcttcaaagcctgtgtttgggttactgtttctcaatcttgtaaaattgaggagcttctcagagacttggcccggaagcttttttccgaaataaggcgaccgattccagagggaatggaaagcatgtgtagtgataagctgaagatgattatcaaagacttgttgcagaggaagaggtatctagtagtatttgatgatgtgtggcatttgtatgaatgggaagctgtcaaatatgcattgcctaataataactgtggcagcaa

SEQ ID NO: 7239 - DNA, 400 bp, Glycine max
gcatcaagagataagagaaccacatcaagaggaacggtgaaggcatggagagatattctttaaacttgagtaacttgcaaggtctaaccctgtctccacttaacatgcaaggatcattctcttcattatatggttttccttttaccaccacaatagaaccaaatcttccaccaaagatagcttagggcagaagagatgcactaaatattagaccattggaaaacgcctaaagagtagcattactatatagtgcatctgcatttgcatggcctattattgaaaattttaattgggcttgaagaatttaaatttgagcccatcattgacaatgctccaaatacctccaatggaaaaggccaagctaaaaccaacccccaaccaaccgagaatccagttgaag

SEQ ID NO: 7240 - DNA, 543 bp, Glycine max
gacatgggacactttctgacgtctattatgaaaggaagaacgttcaaatgcactgtataggcataattaaacggcatattacatgaaactagaagctaagcagtgtctgctgccggttgagtcaccccaaacttcaccaacagcttagtcaggttttctggggagcaaacttgatacttgacttttccagagggtgagagaaatacctctgcaagctcaagcttttcagaggtaagacttgtgctgtccatagttttacttagcaccttcagtgcaagttgaactgcttcttcccttgtgatatcatccttgtagtcctgtttcagaattgactgtgctgcctggttgttggcaccaatagctgcagctttccaaccaccataatttccactggggtcactagtgtaaagttgaaagccaaaattcttgtcccagccagcaaagaggaacgagactccaaatggacgaagaccaccaaattgtgtgtaaccttgcttagtgtcacaaagagattgaaccaactgctcaaccggcattggctcg

SEQ ID NO: 7241 - DNA, 320 bp, Glycine max
aattagataaaagaataattatataaactaacttataaatctttagctttttagcttctatattacagtaaattataactataattttttttagctagttatgaactaattttatcaaatataatttaaaaataacataaattactaataaatataattttattaattaaattcacgtaaatgagttaaatggaggaaagaagcactaaaatgaaacgtgttcgctactaggaatcctctcagtcctcaataaaatacctaacaccattctcacctaccgccgagtgtgacaattcaagcttaggttccattgtttcgca

SEQ ID NO: 7242 - DNA, 313 bp, Glycine max
actgctccagtcaacaagaactctgcgcaatctaagtcctttggggatttgtacaaagaattttctacttgtgggatcaataaatacttcagataactaaaaaaccagagaagcagcatgttgcacttatctgctgcaaacaaccagaggatcttgtgaattgattctcttgaaggataaaaaaatgctcttgcagaggattcacattcacacacgagctgtaggagcttctctgtaagctgtaaccttttgctatgtatagataaattatcaagccagttcttttagccagttcctacccatttcttgaatt

SEQ ID NO: 7243 - DNA, 742 bp, Glycine max
cagactcactagagagcgtgagggcttactcacaggttggaaccaacacccaaacaagccaatctgttttctttttctctttttttggtctaatagtggtcactgattttggggttttcctttttatgttctaaaataaaattgcagatttggtgttctttttggcttccaagctcttgaagaccattcctcaggtaattaaatacaatatgaaataaagatattatagtgtatgcatgcatcatgttattttcgattgtgtctgtcctacataatctagatacaatataaataattatcatatgagcagtttaatttattttttttactttgtatttcattgtcataatttgttctctggtttactgcatgtaaaaatataggcagctgctacgacatgttatgtggccactcatccaaggcttttcaatgtctccggcaagtactttgctgactgtaacgaaacttcaacctcaaaattgggatccaactcaactgaagctgcaaggctatgggccgcatccgaattcatgatttctaggggtccaaaagctgcctttgacctacttaggcaccttgaattttgaagttaatttcttgggacactgcaatatatacagtactatatatgatatgattttatggaaaagatacatgggtctagagagagcaaccctaatattgttttgctctctctttgatcttaatagagtcaagataatgatcgataggaagggttaac

SEQ ID NO: 7244 - DNA, 502 bp, Glycine max
aagtatgccgcctccaacgagtacattggtagagcatccctcgttattagctccggaactccctgttgataaaatataaatccgttcttttccttggctttctacataatacaccatagtctatatcattaaaatggttagatcctagtttcagacaagagtcagtctccctactactactactgttgctactaatcctactatctaactttctatgctgtaaagttgtgttagaagacaaacgagaaacatctatccctcgcgagccttctgcatcaggagaaactgaatcatacctgtccatatcagataggggtgaatgtcgcaaattcaagggagaagatgaggatgatgaagatgtgtcagaatcagaattcctccacacactactccagccattccctgaatcaccaaaaagatattcagagaagtcatctgtgctagttgaatcacgggtgctatctgtactacaagaaccttcatcggagttgctgctgataag

SEQ ID NO: 7245 - DNA, 625 bp, Glycine max
ggtagagttataggtatatgcacaagaaagaaaaaaaaatacaatatgaagtatgaactactattaattttgcaagaaaacagaggcaataacaagttgaaattttcaatctcactaaggagaaataaaatgaaaagtaatcaatcaaaagcactctcagcactagaacttagtgacggaattggtgaaaacagaaggtagctaacaagggatctgagaggtgcaccactccataacatgcagtggagccttcaccaactccaacgcacactccactattactgttacgcacaagcagcaagggcatatgcatgtcaacaacagcctgcgaaaattacgaatcaaagacaaagttttaacctttttgatattttcactcaatcagaccaaaacccatgtttcagaactggaaatcacaacatccccaacaaacaaaattgaaataaaattatatggtactaattaatttttcatactgaagaagaaaattgatgacaatgaaaaagggtgtgttgtttgttcttacccaactatccagacgacgaggccaacgattgagacgaggagggcgagaaaggcgaagggaagacccaagagaaaacccaagggcctgcaatcaccatct

SEQ ID NO: 7246 - DNA, 310 bp, Glycine max
cgctgaaacaaacatggtctgcctctgttagcagcaaatattaggttgtttgttccgaacccaaccatggaagagttcagatccaaatcgtacggtgacggaaggatgcagattgaggcctaccgtggaaccaacatgcaagatctccggtgctacagcgcctcctacgcctcttcggtgcacccaacaacaacacagcaaacccagatgggaaataacgacgccaagtttaagaagggaaagtcaacgaatgggtccacatccaaaagttggagctttagtgaccctgagttgcagaggaaaaagaggg

SEQ ID NO: 7247 - DNA, 689 bp, Glycine max
cagccaagatctttaaccatacatttcaatatgcatttcagaatataaattgcatttgaacaacatttagctctggccgcaaacattggcacccttcttcaacataaatgctactggtatccagatggcattccagcaaagcactctactaatcaaattctgaaagtgcacctcaaggatgtggctttcctgtgtttcaagcacaatttcgattcactcacctgggaagcatttgataattcagcatttttcatgcacatacaacagtattattttggctatatatgtttgaaacactaacctcatggaaatggaggatgccttggaataatctttcacaatccctgcaatcttttttatagttcaacataatttgtttgttgtttgtaccaaaacatgggagatctttaggaagatttaatgctggggttatctaatctagtagagagaaaaggatggcatatgaaatacctccagagagtctgcaagttcaaagtttccattcacccaatcaatgtactctatttgacacggttagtctgtggctagagaatagtggaaaacatgaaatacaaattagtcaggaataaaatcagcaattagactgaagtagaataaaaactagtgtatgaaatacctccagatttactgataaagttacaggtagtcttgcttatcattggaaccac

SEQ ID NO: 7248 - DNA, 490 bp, Glycine max
catatgtttctaagataggagtattggttcaggaaccaattagaaatcatgataatatcttggaaatgacatatataggtacattagtaacattttttcaatctttcctcttctaatttcttaaccaattctttataataagggtacttgttatcattctttttagtaacattatttcttattagtaccaacgaatacaaccagcattacagcatgcttaacttcattccaaacaagaaaagagcagagaggctctgcatacgaatagcagatgaagtacacacagagaactacttattcacgagtaccaaaaacaggagactagtactacaatttgtcaaaaggtgcaatcatgcataatgcatgatagctcataactgggaggactcacggattaactggaactccaccaccactgccagggtttggaaactcaaaaccagggtttgggacaaaggtgtcatcaccacctggaacataaccacgacca

SEQ ID NO: 7249 - DNA, 612 bp, Glycine max
catcaatgactactagaatccgtcatgcattgccattgcttattgctacatagccattacacactcacatatatgcacatagataacaaaccaccaacttaactcacaacaaggttgccataaggcaaaaatatatggtaagcctaacatgctccaagtctcttgccatccacaagtcgcttccagtacaaagcaatctctttctgagtctctattgcactcttaaccttctcactagtctcactagtctcactagtgatggctgtgatatgagcaactttggtagtgagggggctaggaagtgtgtccaagagcttcacaaccttctctatgtcagcagcaagtctctcggccaagccacggctgaaatcctccctgatcaccacccggaggaccgctatgtgttgcgcgtccggtggcattgtataggccggaactatccacccgaattttctcagatggtctgctatctcaaacaccgtgtgttggctactgtctttcaaggaaaaggctacaagtggcacgccaatatcctttgagatgatgttaaaccgccctgttctctcaattccttccttcaaaactcttgcattctccaagcaattttccatg

SEQ ID NO: 7250 - DNA, 385 bp, Glycine max
ttcttacaaaataataatatagacatataaaacaaaaaagattctctcaatactttattataacttctgcactccgaccagtcagttttttctcttccaaccaaaaatggatgaactgcttagagtcaagaagaaatagagcttttcgagatgacatcaaaagatattccattttgttgaagtctttcctggagatcagttggaccaaatacaatccctggagtgtaaacacctccctttggtagattctttctttggccgtgaagaacgagagcgcactgaaccataattattggggtggttacataacccatttcaggtcccattactcttgttataatctccatgtcaggttttgtgtttccctgtgcagcaagactctcat

SEQ ID NO: 7251 - DNA, 490 bp, Glycine max
cgcaatccgcaaaagattcttcaagatctgcctcctaatagttccaaaacgtcatcagtttggcactgcagaaaataaaaaagatgttatgttattatgatcaacgcgacctgttctgcttcaatcaactcaaaacgtacttgaaaaacatcatacttccagatcagacaaaactttgtgcatctactcgaatatgatttaagtcataaaaacaagtaagccaatgcccaatgggaaaataatcttactatatgtcgaagtgtcaatttgttcaggaagctcctttatgtcaacctcaaacctagattgcacctgacatcagcgtatagaaacttgttaataaaaggcactgttggagaatacgtgccttgattccttctccattttcccaatggcagtacaaaagaaatattcctaaaatctccatggaagtagggtctaacctgattaagaacctcagagtcagcagtagaagacacaaaagtaattg

SEQ ID NO: 7252 - DNA, 756 bp, Glycine max
gtgctggacaaacttaaggctgagcgtgaaagaggaatcaccattgatattgctttgtggaagtttgaaacaacaaagtattattgcacagttattgatgcgcctggacatagggatttcattaagaatatgattactgggacatcccaagctgactgtgctgttcttatcattgattcgaccactggtggttttgaagctggtatttccaaggatggacagactcgtgaacatgctctgctttcattcacccttggtgtgaaacagatgatttgctgctgtaacaaagtaaattatgtctcgacttttaaggcccctttcattttattagattattttattttaattaatgttcttgtcccattttgcaacagatggatgctactacacccaagtattccaaggccaggtatgatgaaattgtgaaggaagtctcttcctacttgaagaaagtaggatacaaccctgacaagattccttttgttcctatctctggttttgagggagacaacatgattgagaggtccacaaaccttgactggtacaagggtccaactctgcttgatgcacttgaccagattagtgagcccaagaggccctctgacaagcccctcaggcttccccttcaggatgtgtacaagattggaggtattggaactgtgccagtgggacgtgttgagaccggtgtcttgaagcctggaatggtggtgacttttgcaccaactggactgacaactgaagtcaagtctgtgggca

SEQ ID NO: 7253 - DNA, 526 bp, Glycine max
cacgcaaagcttcaatataataccaagttatctgacttttttgagattctggcaacatctgaggatagagatggaaaggtattaaattaatattgtcctctcttcgtaattaaacaacatgtttgcataatattttaacttgtatttaccttttggttaagatatctaacattatcattgctattttagactttcgtttccacagcacgtggtaggaaatatcccgtgactgtcaacctatggcaaccagaggtaattaattcataaaattgctttaaatggcaaacaccatttttaattagttaattctcaatttcttattttaattatattgcaccttttacaaataatgttacagaaaaatgcttttgaatgggctacatctttgaaagcccctcacacagaggatgcaattcgggttactcagtccacagcaaactttttcataaggttagacctcaaacattaatatttccatccattttattcttctcatattataaatggtcattttagagggaccaaa

SEQ ID NO: 7254 - DNA, 441 bp, Glycine max
cacatgaatagaggggcatgaattacattacatgatttttattctcaaatgtcaacttaattgcagaagcggctgcctggcctctgttaaaagccaagtaatatgatgatgatgttgttggacactcatgaaaaccaaaagcaatgaggaatagagcagcacacttatgatagtgtcattgtttaccatggccaatttatctatattaactgttttcattctctagaaccactttcttgttgtagcctctacaagcttgtcattgttaaaatgaacttgtactcttatttttatttcttagtactactatctgacttgggattttcatttcttaggttttaaaagatcatagtatggaattactatccatgaaagctccagctgatgtctctacaattttggagccagagaaagaagagatatctttcaaaactaaatctt

SEQ ID NO: 7255 - DNA, 355 bp, Glycine max
tttgtttcatagacctccaatagttactctataatataatatagtatgtataaaatgtcataggagggattggtgaccaaaattgggcgtcataggtagtggttttgccatgatgatgacgatgttccggctgcttccacccactcaataattccaatagcattctcattgttattattgacataggattaatccatttccatcatgtcgccttcttccacctctaaaggttgaccagtttctggaactatttcttcacatgccataggagaatggagggcaacccatgggacaacagccaaacagtcgtttgttgacatttcagaactcttctccctcctcatttcatcttcaa

SEQ ID NO: 7256 - DNA, 618 bp, Glycine max
tccatcatcatcataacactatagccaaatgaaacaatttaaacactgttttaattatttttgtttctcttgaaaagaaagataaataactggataaattggattacagagctaagattgcgatcgatgtttctcaatcttcttttcgagctcgtccttctttgcgcccacaaccttgtcgacttccttccctttcttacacaacacgaacgtcggcatcgcctccacattaaactccttcgccacatcctattccccccccaaaaaaaaaaatccaaaacagaaaaagaaaaggttcagaatcattcacggaaacagaaatggaagtcaattaagaagaataaggatgcgaaaatcaccggcaattcgtcgacgtcgatcttgacgaagtcaacgtcggtgaacttttcggacatggcgtgaatcgctggctctatgaatttgcaagggccgcaccacgacgccgagaaatctatcacaacctaattataatttttaaaggaaaaggttaagattgagaatcggatccagcaaaattgggggaaaatcgagatctagggatttacgagcttattggtttctttgagctcgtgaagggagctgccagcgcgccgaaga

SEQ ID NO: 7257 - DNA, 696 bp, Glycine max
tacattctttcctttcttctactcctcatcttgggtactcaaactctcttccctaacaaggattacaaaaacaaaagtatatcgagttgttagaaaaagcaagaaatagaaactccacctctacaacgttttcttaattgcgtccatgagcatcacttcctgcagttttgcggttcaggtaacgaatgacagcatcctcaaccctgaagatattacaaaaaagaacacaaacaaattagaaaatattttgacaaaaaatattatataatattgtttgccctacatgacacatatatcaattaaggattgggatgaagggggggcatacagcctacagggtatccatgtcataacttataatttctctgtatgataaataatctatccaacaatttcatagtgaagccctatggtattgtattacaatttcctaccagttgccacttaagaatggacacgcctgacacatcaaaatctgaaatgaaatgtcttggtttttttctgagtcacgttgtgtctaacacaagtgtctggtatagatgcagcttcttttttatgtgtatgattgtcaacatattaaactcccaactttagcaagtaaatactcacattcaggtcacaaccgtactaaacaaacaagtgtattatggatatatatacctaacaacaaaaagagaaaaggtcaaatgtcatcat

SEQ ID NO: 7258 - DNA, 1231 bp, Glycine max
  misc_feature (61)..(67): n is a, c, g, or t
  misc_feature (1176)..(1177): n is a, c, g, or t
cccacctgcaagttgacacaattcctaagggcacaagaaaatgtttaatgttggcatcttnnnnnnncggcatatcaagctgtctagttagtaagcagggctattcctttgaagaaaagaggctgcaggcctcacataagagaaatccttaaaggggtttccgccatttgggctggcagcaggtgagtcaacaacaggcatatcagtccagcgcttctcaaagttggcaacacactgcacaccagctacttctggcctaaagcttggttggatttctcgtgcttccaactttctccaattgattggtttaaaccacttgtggcttttaatttcctcaacaccccggggtccacaacctaagcgcctacctggttccttctgtagcagctgtaacagtggataatcgtcttagattaacttctgttaaccagtcaagtagcaatagtagaaaagctcaaaatagaatgcaaatcaaggaattgacatctcttgtaaagaagaagaaaaattatgaactttcgacagcattccaagaaaagatgaatttatctttggatatgataaaaactcgatccttttaaagccaatgatgaaaatgtgtcacttgacatggtagggcaattattctaagatgacagtattttattgacaacagtattttaaaacggaaaagttatctagagcttattatgtgcctaataatcatgagatttatatgaactgttctagaataatcaatggaaatatcttctttgtggactagtgattacccctttcaacagtgaatgtgcttcacttgacaaaaatgctggcagcttaatcttgtctttaactatcttctgctgaattttgtcacggtttccgccacagaaaggcggctgcagaggaggtaaaacaacataaacaaccagttagcaactccaaaagagcctagtagtttattcagttcacaagccattaaaacttacaagcaaagtattacaatagcaaaacactttaaattacagtttctaagcttgaaagcacttacttaaattaaattcaataagatgaatatttatacagttaaactttaaagataggagcattgtattactgaatacaagcttcagcactttacaatctatcaagaaggtacactattatcctatagccaatcaaaaccttgcaataaannctccataagaaaaaccagtcttacaaattaacaaggaacaagatgcaaccttcc

SEQ ID NO: 7259 - DNA, 463 bp, Glycine max
tctctggtaccaaaaaccttacccttttcttctgctgctggatcacattgggtgactttatctcctttagttctgatggtcctggcaagtctacattctccacattatctactttattctcagtcatcaaaagggaatgtgtagaacatgtccctacaactgccattctgtcatcctttacgggctcatcatttgaagagttcgacccagttctttctgtgcgtatgaactctgctatgcagcacagaagatcattctcaaactcaacatcatctctgtggacatcacggtatccatatcgcactatgcaccggtagagtctgaactcttttggaccaacgcgaccaactagaaaccgttcctcaggtgtaacatgtggaaccggcacgtgcttgatgcatagaaaaactaggacctgatggaaggctgggagattggttacaaagtgggagaagattactgg

SEQ ID NO: 7260 - DNA, 270 bp, Glycine max
aaattgatgatcagtaaagtaaagctatcaaaatttcccttgtgtagcagcaaaaggctccactttcttaatgcaggaagattcataatgtggataagagaaaacctcatctacttaagggtattaatcagctcaaatatcttactttcatgacaacttgatcatttattacttgcttcaaacttcggttattctgtttcctactttcatttatcataaaagtaatagcccttttgtatagttcatactttgtgaaattgtgatacagca

SEQ ID NO: 7261 - DNA, 734 bp, Glycine max
  misc_feature (689)..(690): n is a, c, g, or t
  misc_feature (693)..(693): n is a, c, g, or t
caagccaaatatacttgacaattatagatcaccatttattttggttcaggtaaatgaatatcaatggcaggaaaatcacaaagcagagattcaagttgtccacgataacttctcaattgagagccatgggaaggctgctcttgtaaaccagctgtgtgatggctaacttctgagtgttcactctgttccaaagcttcttgtgctttgatttctttactaaacaatctgagggcatctgttgttgacaaagaatgcacggattcatacaggccttggaattcattccttttttcttgtgtttcaatcaaccttgcttttaattgacgtggaagatgagaaaaagcacttcacagcaagcaaatggccaaaaagaaaattttaaaaaaatcattagcaaaccagtaacactaacagtattaaaattcaaacaaactgcatatcttcccactcacaatacctggtaacacctcttacaacaccccaactgtaaccatcaaggaccgattgtttaaaaccgatattgaacccttcctgtgcagaagcctccttcgccgctataagaccatctcgatacccgatctaaaatggagaaaaaaaatgaataggtagtcacattatagaggtaaacaaattagaaactaaaatgaggaaaattaattctagaatgtcaacataccgtatgaaattgnncangcctcctctgccactccctgtccaaatccgacaagctctcc

SEQ ID NO: 7262 - DNA, 534 bp, Glycine max
tgttaaaacgaggtgcctagatagtggaaccatctcctgacctgagattgatgaggtaagcttgctgcacacaactcttgattggtatcagtgtcatgcagtttctttcaatcttatttggccacggaaatgggaagaaaatgagaactgattcaaaaccccctgcagaaaaattgctcatgaccgaaatcttaatggctgttgcaccatgcagacttgcatccttggtcctcttgagcaatccccttagtacactacattacttcctctttcgacaagccaatcttcaactcaatattggccatgatgtaaattttgtattcctagccagcactagtcctaaagccagtgcaactccaaacatagcatgcagcctcacacaaaagtacttagccatgaaaatcttatttttgtcctgtaagaatacaacttaggtttaatagcaaactataagaaatacaccaacggatcaaatctataagaaaattcacttgccttgtaattgtcttcaacaaatctaactaccaggtttcc

SEQ ID NO: 7263 - DNA, 335 bp, Glycine max
aaaaaaagtttctctgtcgtggatcactgtgcgcggttgacggaggcgattttcggtggcgcctttcaaatttttttcgttgatgcacaatagatacggaagcaaacaaaacgtaggttgcagagctgggatgtttcaattattttctcttcatctttgttgtaccatggatctggaaacagaaagacctaggccgcatatctagaagcaaacatggggcgactttgaagatagaaggatgcgaccatggactccattatcggtggtgaagagcgggagcaagcgaacaagaaagagagcatcgtgaacgtggttcagtcttggctcgtgtgatc

SEQ ID NO: 7264 - DNA, 772 bp, Glycine max
tgccgaggcattttttatttgcataccagaaataaaggaaaaacaagagtatatgaaataagctcacaggagcaaaaggtggtttgtttaagtagacataacaataagcacttagcagcagcctgaatcatcattttgctagttcattcttctcttactttaggacctgagtcgttccagatgtagcatcgctagtttccgaatcaaccgaacagctacccactgactcaaccgaacaactaccaactgactctgcataatcttcatccttcttaatgctttcatttgaaatagaagggtcactacctgaaagaaacatatatcaaatcatgcatccagttcactacaatttagctctaaataatagaagcatgccaatatgctgattttttttttcattttctaaaagtcacttcaaataaattatgccagatgtaaaaaatatagatagataaggtcaaggttgtgtgtgttcatattcgtggacaggctagtttcaaaatttatgttcagaaaattactgtcatcatcacttgatgaatcgtcgctcgatgaaccgtcgctcgatgaatcatcgctagacaaatcgtcactcgatgaatcatcactcgaagaatcttcactggacgaatcgtcactggatgaatcgtcactcaacaaatcgtcacttgatgaatcgtcacctgatgaactatagcattttgaatcctttggaagtgacaagatagttgatgtcttcttgggttcggggacaggggtggtatcattctcg

SEQ ID NO: 7265 - DNA, 423 bp, Glycine max
gaaattaaaaaacaaaaattattccttgtatattacaagctataatctgcacttgtattagtacttttgaaagtgtgcttcctatagctcataatatatatgtagatgtcattgtaacacattctcctcccccctcgatggtatatctgtttccaaacaatttgttccttaatttcaagtttgattatacatgaaaagtatatagtaacacacaaggttttaaaaaaggcccacgacttagatttggatcacaacatcaatattttttaattgttgatgatcgcagtcgagatcgcatcagtcacatttatctgtgattttccatgatgtcaacaaatcgcatgcgactgcgaccgatatttaaaaccttagtaacacatgattttcactacttcttgtctgtagaaagaacagcaacaccaa

SEQ ID NO: 7266 - DNA, 494 bp, Glycine max
ggggagaaatgagtaatccgtacttgcttaaagtctacaacaaagaaaataatttcatggcatctataattcaatttaaagaaacacgttgagaatcaagcagcatgcatttctttggatagcccttcaccaagatgttttccaaaagtttttctttggatagcccttcaccaagatgttttccaaaagctttgacctgctaagtcctcaagtggaaggtgccagtatcaggctcaatgcctaccagccatgccagctgtttctgaatgtcaaatgcatccaaccttggtaacgttcaccaataattctcattacccagatccatctaggtaagatccatatttggacacccaaaatatgtgctacctgtagtggcagttcatgttttacattttacttgtatatatacagtgtacaataaatgtataggtagcaaggtttacaagatgacattactgaagtacaaattgtcccaaaccctatagatgcaatta

SEQ ID NO: 7267 - DNA, 300 bp, Glycine max
tttaattaataatcactgaatgtatttagcaaattaataacataagatacaaatagttagtcattttgtgctgccagctttagaacttgcaaaggacattgtctaaattgcaagcgagcaaaaacctgtgcagaagacccgaaatagttagaatatggaagtgatagtgtgatcaagcaacccactgagatgttccgtgacatatagatttcccaaactcaacggcacgcaaatactaaatgtgtgcaccaacaataatatgaaatacatgtttatagagtggggttagagtttaggaga

SEQ ID NO: 7268 - DNA, 630 bp, Glycine max
aattgttcacataaaaaactgacaagtttaacttgcaagctcaaatgaattgttcaaaaaagaagcgagacttatttttctccaacaaaatagcctaactaggtctgaaacaaaaattacagatacttaaacgaacacatactgcgaactaggaaggaacgaatcatcatgccatgggtagcacacgggcttccttgaaagggtcctccaatcaaaatattttgggctcaaaaagcctgctagtgaagcccaacgaagaatagatcaaccacgagaatgtttcccatgaacttacttgggaagcccagtttcaccgttcagaagtgcttgactgctatcagaaagcaaaacaggtccccttccaggtctggtacatatgaaataactgacatcccccttgtatttttggggtggaatattatctttgatttctggaggaggtggcaaagcttctacgtcctgtattccattgatccccgcatcttttgcaattgacttgtccccaataatgtaactgaagggagtgtgtattgcaggtaactaagaaattcaaaagattgacaaaaatctaagaatagtatgcatgcaaaactttgaaagcacctgctgaggtcatctgaatttggaggg

SEQ ID NO: 7269 - DNA, 385 bp, Glycine max
gaaaaagttgcatcgaaacaaccatgaaggaaaataatgaagctattcccagattccgacctccatgaagccattttcagtggcacagcccctaaacatgccattgcaattgaaaccataagccacttccccagcgttggacacagcaatgagaccagccatcccttcatcgagacggtgcttgatcacaaaatccacggcttcttgaagcttcaagcctttgtattccatcaccgctgccacctcacgcgccagcgtgccacgtatgatggcctcgccttcacccgtgcacgatacgccgcacacgtcgcacgcgtaggtcccggcgcctatcagcggcgaatcaccgatgcgcccggtcattttgttcatcagccctcccgtg

SEQ ID NO: 7270 - DNA, 570 bp, Glycine max
gcatgaatcgagacaaatccacagaaacaaataaacagcacaaaagctacaaaagtaaagtcttgaggtaaaaaattggcactagcagaaacaaaatatagtgaaggaaccagatcatgataaatgctaataaagtgggaaaaaaatcggttgaataactaaacaaaattaattacaaagctaagtatataattcaactgttagaagaaaaaaagtcgttatgcattcctaaaaggcaaggcacagtcaacctaaataatttccctaaatattttcccctcaacccactacaatattttaaaatagccatgaaaatagattactagatcaaaattacaaaagtaattaatatacaatatcattggtttaacaaattacaccacagaagaaaaataccatccacaaccaagagaagatgacataagatattgatatcaaagaaaagtctaggcatataataaaaccattaaatcagtacaaactacactcagaaataaatagccatcttactgccaggctaatataaaaaatggtcactgaagtttatgactttgtgcaactgtgtaaaac

SEQ ID NO: 7271 - DNA, 373 bp, Glycine max
tgatgctgatggaaaatatccatacactggctctgttgattgtgctgtcaaaaccttcaaagcaggtggaccgttcaaattttacactggattccctgtctattgtgttaggattgctcctcacgtcatggtattattctataatgattcctttgcttttgtttctttgaattaatgttacattcaaggggtttattaagtttatgttctgatatatgattgtattaattgcttatgcagatgacatggattttcctcaaccaggttcagaaattgcagaaatcctacgggttgtagttccccgtggtaatttgaacattttgtgttgaattcaagctttgagcatattgaataatttgttgggtgtagttcc

SEQ ID NO: 7272 - DNA, 697 bp, Glycine max
  misc_feature (674)..(675): n is a, c, g, or t
agcggtgcctgcttctggtctccccactgtacagcctgcaatcacatagtacaacacgtttcattataccacagtatacatatatatcaaccgttgatttctcacatgatctaacggctcacatcaccccaatcctttttttacaacttagcaaagaaaaatcacataatttaaaataaaataaaaaaaaattcataaacttaaacttaaattcttaaaattttagttaaaaagatgaatcaacatgttattatgtatcctaggaaaggagtgtgagataaagtcttaaaaaaaattcataaacttaaacttaaattcttaaaattctagttaaaaagatgaatcaacatgttattatgtatcccaggtatcctaggctaggagtgtgagataaaatcctaaaataaaattcatagtttctcaacacttgatgcatgcaaattaagttgttgattagttatacatggggaaaagaacgtagcaacaaacaataatataccagtcatagacagtgggagtgttgggaagtggtttgtcaaacatctgagcaccgatggtctttgtggcggagttgctcccaggatggaagacgctcctccaaacgttgtcagctttacgggccgatcccggtgtcgttggagtcgtcggagtcatcggggttgttggtgtcgacnngcatcgacaacgtcttctgcag

SEQ ID NO: 7273 - DNA, 522 bp, Glycine max
gacttcagagaaggacccgctcttcctcttcttgacgttctcattaaagacgtgcgttcagtgattccatcttatatgtgtatttaatgttattagcttgaaattaatggctttgattgattcattgtgcaggaaaagaataagggagctttcgatttcatctatgtggatgctgataaggacaattacttgaactaccacaagagggtgattgagcttgtgaagcttgggggattgatcggctacgataacaccctatggaatgggtccgtggtggccccacccgatgctcctctcatggattatgttaagtattatcgcgattttgttatggagctcaacaaagctcttgcacttgattcaagggtcgagatttgccagcttcccgttggtgatgggattaccctgtgccgccgcatcatctgatcattctgctccttccctccccttttacctacttcacctaccacatatggaaaaaacacaaccttctactattttacctaatccttaaataaacat

SEQ ID NO: 7274 - DNA, 212 bp, Glycine max
  misc_feature (58)..(61): n is a, c, g, or t
aaaactgcgttgccataatagtttgtgttactctgctaagaaggctcctccaccgcannnnattgttggtggccgtagagtgattgttgctgcgagccctcccaccgaagacgctgtagttgccactgaccctctcacgaagcaggatctcgtcgattatcttgcctccggttgcaagcccaaggataaatggaggttccgttttttttttt

SEQ ID NO: 7275 - DNA, 679 bp, Glycine max
  misc_feature (667)..(668): n is a, c, g, or t
ttcacgaataatgccattacttttaattgctttataccattgtcattaagatatccatatttccaagttccaaccattgtagcattcgcctcgttggcgaatgagaagaaaggcaaaatcaaagtttgttttggtttacgccatttagaagaaagtaaaaaaccaggttggaattagaatcacaattgtaaacctgttgcctagcaaattcttcggctccggagaaggcgagataggaatgtggggatttgtccataaccaaacgagcgagcgagatcgggttcttaacggtggtaagacccgaaacggcgccgcatcgtcgttttggaccatccatgatgctagcctccatctccaccgttcctttttctgtcagggcagatccacggcccgaattgaacagcggatccgtttccaattccctcacctgtcacaaacacttgtcaaatctaagaaaattattaataaacaaaacccccatctcctgggaacgattaaattattattcttattatcaacgaaagaaacacggatgattcacgaaacacattcacacgaaacgagccatgcatggtaacgggtagtagtattgtcttttttgtttatttttagttttggagataaaattaaaatgcgtgaaggttacgatgagattaccacaagttcnncgacatctatg

SEQ ID NO: 7276 - DNA, 255 bp, Glycine max
tactaatgaatggcaaaagcgtaggaatattttcccagtggaaagtagtggagatgcactaaacacttcaaggtggctctttaacaaatacctgaacctgagcaatcctgaaacaaagcttgtactggagttgaactgaacgcaaatcaacgaaatttctataaactatgcttacatgtttatatgaagccaagaccatctcgttaatccagttcacttatctctagattttcattttccatacactgatacacc

SEQ ID NO: 7277 - DNA, 297 bp, Glycine max
acgttgtattattctctggtaaggaggaattccaattcatgtataggtagcatatcatatgctttctgtcggaattaaaactttcatttcttcacatgaattcacttagatattacacaacaacaacaacaacaaaaaatagatagaggagagtggtagctgatacaattgatgccatataaagaatagtatctatatgaaaattttctacataacttaacaaaatcagattattaagttaccaattcttcatttgataaatttgaacttgacggagaggcttctatatcacggacg

SEQ ID NO: 7278 - DNA, 380 bp, Glycine max
tggttgctgaagggtccaaaatatatatgcaaggatatttaaaatgtttcttttttaaaataaaagtggagtgaatctttctgattccgacactaggattgaattttaatttttcatctgcagttctaaattctcactcttgaacctgctccgacaaaaatctagatagaaaaagtgaaactcggccccgaccccctcttccttgccacgcctagacaatacccattctatgggtcaattatggcagaggctcggaactcttctgaagagcacagcatttttttccccactttctaatgaagatggcaaagacgcataattatgacacatcaagagaactctaagcctgcatcatatttcttcctttaagccacacctca

SEQ ID NO: 7279 - DNA, 372 bp, Glycine max
gggaatagccaatatatgatttacatatgcatttcaaaacaaaggaatttaacggttgatgattttcatgaatgcatgatgatttttgacctacgaaaccaactgacatgtaaaaaaatgcataatgctaggatgtaatctttcccatcctgggtcaacaatcacaatcgatccccagcctagaaaagcaagtatggagaaaaaaaattatatggatgaccaacagcctaggggcaattatacacaataggatgatcaaaacaatgattttgatgcaggttaaaagtcagaagaagaaaaaaaggaagagattcactttaaataaagcactttgggtggtgttgatgaaaaccagttcgttcaacctcatgc

SEQ ID NO: 7280 - DNA, 583 bp, Glycine max
  misc_feature (32)..(34): n is a, c, g, or t
  misc_feature (536)..(537): n is a, c, g, or t
  misc_feature (565)..(567): n is a, c, g, or t
ggcaatgcaaccctttttttagtctttacctnnntctcagccgcatagcccagtaaaaaaaacacatatgcagatcacaacacgtgtcaactaaacaatgcttgaatcctatcaataacaaaagaattttcaaaaggcttgtaacagttttatttcaaacgtcagacaaataaataacctcccattactttcaatgcagctcctcattgtatccttgaaatttatatcaatggaaaggatctgatttagttgggtgtcagaaaaaaataaaaaaaacctaccaacatttgaagttcaatgagttggcaaattctgcactatacttataatattatcaagcaaataaaaagtaattaaataaattggaagtacaaacataaaaagttcatacactataatttaccagaattaacaattaatcaaggatgatagttgctctataacaaaaactatctccttcattttgtttttcaggagaattcatttacggttctatacaacagtaacagaaaaagtaaaaggaacagaggtcgaannaaaaccctgtcattgaagtttgcacttnnnataaccacggcaaaaa

SEQ ID NO: 7281 - DNA, 496 bp, Glycine max
ggaagctcttttaagagcttctctattgaaaaaagctctatacttaatatctagtaacaaaggaaaaggcacggccttagagagatttagcatatacaacgtctgccacctattcaagattgtataggaaagacttggttctattgccaaaaatctacaattaaccttaaagaagaagcataatttctcctacatgtccattgcaagaaagtggataaacatatttcaattaatttccaaagagaccagtctccttagctgcataactaatattatcaggggagattttgttctcaggcttgtagcacctgacagcaaacaatgcaactcttggaaaaatcacgccttgctatagttgaccataactttctaactaaagacctgcgaatgtgctgagcttttccagcaatattttcccaaaggtcctgaggattgctttccagttgttggttaggacttgaaacatcaactaaactgatgctcatattgtggcgga

SEQ ID NO: 7282 - DNA, 494 bp, Glycine max
tcacatgtaaagcaagttcgtgtcttataatacaatagcaacaaacaaatgctggtatttgtttgtgttcaacaagttaacatattagacagcagtttatgtttggagtttcatttcttttcattctgacccaaatcggcagccgctttcgctgcacgtgtcaacacatccgaaacccaaagagcacctttggcaaagtagctactgttggctatagcagttccagccgccacagcagcttttccggtaactgatgcaacgactatagctgttgttcctgtcactgttgcagctgatttggtgaaatctgtgacatgatatttctcatccacagacttaaaagtttcaatccctgaattaatggtatcagtcaacccaattttattgctgagttcagcaaccttggttgctgctgtagatgatacactatgagattcatcgaaagcttttgccatgacaaatgcatctttgcccaatacatatcccttagccac

SEQ ID NO: 7283 - DNA, 719 bp, Glycine max
cgcattgaattagtatctccattacagttatggacattgcatccaaacccaatagaaagatcagagtattacgcatcccaagaagtaaaatcctactacaatttatcaccgagatgtcctaaaccgcattacatgagcacaaattcgagatgtcctaaaccgcattacatgagcacaaattcgagttgtcttggaagaggaccaagaaataaaagctagataatgttcacccctgcatccagaattaccaatccgcaagactcccaaaggcattaagcctgtgaagggggggaaaaaaagggggggaaatcacctcagtaattcaagaagaggtacatcttttcattcatttttttaatgaactagaaacttggaagggcaacaaacaagtactttcaataatgcttttttaccataaagaaggaaagaaaccaatagctaccttattggcaatgttgttggaaagccagtccagaccttcgtaaaggccctccccagaggttgcacaggtgctctgaatgtacctggaaaaaccagaagtgagttacattacaacaggatagttactaatatagcacaagaagggctttgttattaaaaaaattaccagtggcgctgtctgagagagtgtagacccaacttgtcggtaatctcagcagcattcattgcattaggaagatcttgtttgttggcaaacacaagcaatactgcatctctca

SEQ ID NO: 7284 - DNA, 745 bp, Glycine max
tggagaaggaggttttggtagagtttataaaggtgtcttaaatgatggaactgctgttgcaattaagagacttactagtggagggcaacaaggtgataaagaatttttagttgaggttgagatgcttagccggttgcatcatcgtaaccttgtaaaactagtgggatactatagcaaccgtgactcatcacaaaatctactttgctacgagcttgtcccaaatggaagcttggaggcctggcttcatggtaatataatttctcaaatcatggcatcagctctgtaatcttgaaatgacatgttttgcttcttccaaatttacaataacgtttaagaaagtattttactgtgcttaattaaaattggccttgatttgtcctaggtccgctgggaataaattgccctttggattgggacactagaatgaagatcgcccttgatgctgcaagaggacttgcatacatgcatgaagattcacagccctgtgtaatacacagagatttcaaggcatctaacatattgcttgaaaacaactttcatgctaaagttgcagattttggtctagctaaacaggcacctgaaggcagagctaattatctatctactagagtcatgggcacatttgggttagtttcattcttttctttcttatacttgttattttcatttaatttaaatttaagatgaaatgaaactgttatataggtatgtagcgcctgaatatgctatgactggacacctgcta

SEQ ID NO: 7285 - DNA, 592 bp, Glycine max
taactcctaaatctgtgaaaagcagagtcaggtattgaggaggggtgtagtcccgcgcggacctttcaacctcaaccttggatggaataggtacgccaaaatcaataggccgtaacgcaggggctaaatccttttggtcgagagggtaaaggcgggcaaactgcagtgtaacacaaacaagacaacatgtaactacagaacataaattcctaatttgtcaaaaaaggatatgaatgcattcaaatgtaccttgtagctctcagcagcgacataaactggtttattcatactgtgtgcaaccaatgctatttgataggtccccatcatgttgattatgcccccactttcgacaactccatctgcacccacaaaaaccatgtccacctcatccatagtatatgcaacagcagaatctattagaagtttcacaggaacatcaagcttggccagctcattcgacaaccgcaaacctgttcggtctggtcttccctctgtgaatttgtagacacaaaggttgaagtgcagaccacaatgaagatgccaaagatacatactccaccaatttaaaatgggattgatgaagaaaattatg

SEQ ID NO: 7286 - DNA, 645 bp, Glycine max
  misc_feature (583)..(585): n is a, c, g, or t
  misc_feature (587)..(587): n is a, c, g, or t
  misc_feature (639)..(639): n is a, c, g, or t
acttaacatgcttgttctctgggaatgttttggcccatgagttcatcacaaatggatcattcactacaaaatcagaggcaatttcagattagccatttaacaaacgatctatcttcaagacttctattactagcaccatgagtagtttcttttgtaggtcatagtatgagtatggtttctcaccacaccacacaaaaggccagttcaatccatatagaattatacccatgataaaagcaaatcaacaatcaatagccaataattaaataaacaatcaagcaacaacaggctattaggaatccatgtccagaaaaaacccggaggctcaacaagtagaaaaaggatggtgaatttcaaggcaagtaccttggaaatttagattaaatcatacaacaattgagaagaattttcaaacacaagtcaacaatactacagtatacatcacttggccaccatcattatcaattgattgaacaatcgaccatcccaagtcaaattaaccaacaagtacacccccttcatcttcttatgctgacatcccaaatcaataaccaacaagtatacagccatgcacacatggagnnngnaattatgatgtgtttagagtctcaccactgatacagattatttcgtccacanccttcc

SEQ ID NO: 7287 - DNA, 637 bp, Glycine max
  misc_feature (593)..(593): n is a, c, g, or t
  misc_feature (595)..(595): n is a, c, g, or t
gaacaccaaagcaaccaccttgggtggggacatgatgcacaatcatgattgaaaaggctaggaatataattattaacaaatttctcaaatgtatggattaatatgagacgagtagtcacggattcctgctccttcccatcccatccactcctcccacatgtcccaatctggatcgttcattcccctcagtggctcatcgatgcctccagcatcataataagcctcatacgattctgcctcatttgattctcctctcaatttggacatcacaacctgtgctccaataaacaacattcaaatcacaattagccaattaggcagggtttaaataaagttcaaaaaagaaaataattcatgcaactgaaatttagagaaaaagggtatattatatataacgcacatcataagcctcgttgatttcgtgaaactgcaccccacaattgctccctctgcacacatctggatggtactgaagcaaacacaatagaaaaccaactaattaattaatattattcctaaataccaattgggataaaatatcaatacaagggttgggacttgggattgaaacctgcagagcgagctgtctgaangncttcctaacctcagattcagaggcacctcgttttattcttaa

SEQ ID NO: 7288 - DNA, 248 bp, Glycine max
ataatacaagcatctctacaaacccacccatcatccactgaaactcagttccgtagggattgacccaccagctgccacaatctgttgctcaagctgcaacgagtatccataaaataaatataaatttcaaatccaaaatgtaatagaatgttattcaacttaagttttttttttttttatctaattaccctgaacattgtttcaagcttattcttgacaaggcagtactcttgtttcacttgttgccg

SEQ ID NO: 7289 - DNA, 316 bp, Glycine max
acatctacaaaaacaactaatccataatgatcaatatcaaaagcatagcaattgcaacaaaacaaaaacacccaattccgatacaaaccgggccaaaatcttacatttcaagtgagcgtacggactgactacaaacaaaccaattgaaacaaaatactatcaccaattcagcatcttgacgtataacatgactgagtttaaaaatatcagtactcatatggggaaatgacatcatcgattttcagtatcatcttgacaacttgagtagcaagtaagagctgttgctgctttccgatcaaagtttcgaagacatttt

SEQ ID NO: 7290 - DNA, 563 bp, Glycine max
  misc_feature (33)..(36): n is a, c, g, or t
tcaggatctggaatatgccattgcataccactnnnntaaacacagctcagaaagtacaaaacccaaaagccctgcgggatacatgtaatttcgtaagaaaattcacccaaaattgcatactaaacaacacatcaaaatacaaggccgttcatcttgcgccaattccttgactctatctgtacatgtaaattattaattagccaagaagaaattttacaaaagtcaaataaacaaaaataagaacgttttattgaacaaatactgtatgcaataatcaaaagctatactgaaaaaaagctaaactataaaaaaaaaattacaaactgtctagctacccctatcaaccattagtggattatgagtactgtaaacacctgaaagctcagttttattttgggttatactcctccagctgatcgcaactcctcgagagcaaccttgatctcattctgcaccaattccaaacgcttggaatacacttccagctccaaaatctgttgcttcctccacttctcatccatcgttgtttccccaatcctcaaattcaataaagtcattggcat

SEQ ID NO: 7291 - DNA, 445 bp, Glycine max
gggagacgcataagtatagcgaaaattgaaatgttatgctcctttgatgtttatgaaagttttagtaagcttaacgttcacattcccaaactacagttcttgattgcatcaaattcatttccatttgcaaagcacctcagtctacattcctagtttccttcgaactttgggtcagccatgacaaaatgatacgctatgaccagtacaaagatgaagacgccaagaaaattggcaaagaaacccagatcttgatcatcaatcatctgccacatcacagtcaacaaaatcaacacacgtcagcaacttggtttgggatatcacaaaatgaattcacaacatagacatcaaatctaaaatgccatcctattaccctccaaattttgattctgtcatgacatagcataaaaataaacaaggagacgcaaaaaaaatgggtaaaaaaaaa

SEQ ID NO: 7292 - DNA, 474 bp, Glycine max
tatatgtatttttacattaagattatgccacgctcattgaaagttgaaacctacaatgctgataatcgaacacactgacccttctactgaaaaacatggaagttcagacgaatttatagaatgcctaagtcaaagggggataagttaaagaagaatgctaacaacacatttttcaatacatttttttatctgctttctttcattgactgaaattcatgtgagtttcacttgtttgtggatgagactcacatttttagcaagactcacgcgaatttctatcaatagaaagtatgtcagaaaaaatatattagagaatatattgctagtatttttgtaagttaaaattaacttaaaccaaggcaatgctgctctctccaccagggggtttccgggcacctcgcacagggtctttgatttctgcctttccatcagcaaatatgtcactgccagtcatttctctgagcttagccctgc

SEQ ID NO: 7293 - DNA, 173 bp, Glycine max
  misc_feature (63)..(72): n is a, c, g, or t
aaaccggttgggggaaccccggacttgtgatacatccatatatagttgtcatgttaactgccnnnnnnnnnnaacttacaatctgaaattccaaatctggaattaaaattttgcccccaaatttgagtaagtggactgatgaatttttttgtccacaactagcgttttaatca

SEQ ID NO: 7294 - DNA, 548 bp, Glycine max
ttgcacattttagttgtgactaatcgtgtttttatagttggtcttttctactatacatttgtctttactttgtctctgaataggtaaaaatgcttaaagataatcatatataataacataatctagtatcacaacactcagctccgggatgtcacaactacaatgctgccgccatcaccatctccaactctgaaacaatcataataataaaatagttagttgcaacccttaaagattaaaattaggccaacaatatcatagagagaccacatatccaaacaatagcagagaatagaatccagaatgaaaattttatttcctatttcaacttgtaatcaaaatgcaaatgtatgaatatgaactaatttcaattatgatacaattataatttatattataacctcaacctcaatccaatcaagttttgaatggttcctaaggcacaaactaaaaataccattaatttttctcatattcattatcattttaactgctagaaatatataaaataaaacaacaaaagaacagtcctaaagcctcagcgaccg

SEQ ID NO: 7295 - DNA, 530 bp, Glycine max
gtatacagttgcaccaacggtcaacacttaataaacaacacaaagtgagatagcgccaatgattctacaaccactaccaaaaattaattcaaacactggcagcagcagataagttttcaagattctagaacacacaagagtgtccatttacagcatgctgtctgtgagagaaggcaacctacggaagaaattcaccggagcaggcggcaccttgctccgaagcatggggtgcctcatcaagtaaaatccagtcagaagaataggcagttggaagggtgtgacatacaacactatagcagccacaaagcagaataccatgaacatggcggaggcacgaggatcacgccaattcacaagagcttggatcctctctccttgagtagctaaatctcctacaacactctgaatcctcccagccacagttcttaaccggtcgtacctccaacgtagaatgtcagggctctttgagctggggaatgtgtcaaattcctcatcaagctcatctggggtcaccccttctgcataggaga

SEQ ID NO: 7296 - DNA, 310 bp, Glycine max
tggttgaatttgcagggttgaacgaactggttttcatctacaccacccaaagtgctttatttaaagtgaatctcttcctttttttcttcttctgacttttaacctgcatcaaaatcattgttttgatcatcctattgtgtataattgctcctaggctgttggtcatccatataattttttttctccatacttgcttttctaggctggggatcgattgtgattgttgacccaggatgggaaagattacatcctagcattatgcatttttttacatgtcagttggtttcgtaggtcaaaaatcatcatacat

SEQ ID NO: 7297 - DNA, 576 bp, Glycine max
accagaccagcagctaaagttgtaaggaacgaatctgaaatttctaacttctcatcattgcgactggcttgctctgtgggaagcttcatgtccgaaactgcaaaaggttcaagtatttcactatatatgagttcgggacatgttcaaatccagagtagttatatatatttataaatctttctacagatactgttgatatattatgaaaaagcattaaataaaatagtaaatgcttttaattttttgaaaacttaaaaaacattcaactctgttttagaaaatcttataagaagaattaatttgttttctttatttcatacacagcccttcggtaccagtgaaaaacatgttcagttactattgtttggaaataaagtgattgagggtaacgagaatttatatataaaaaaatatataaagataccatattaacaattacttttttttttacaaatttaaataatactaataactcaaacactgcaagaattagtcaataagttatgcattgaggataaagttgacttcatggtggaaaaagaaaataaaagagaaaagatattgtaagttcaaatt

SEQ ID NO: 7298 - DNA, 735 bp, Glycine max
tggacgagccattaatctcagagtcagtttgatagtacacaacatcccccttgtcactaacaaaatggtcagtcttgaagctctttattaattccccaataaggtgaaaaggaagaggagatgatttctttggttctctataatattttccaaacactggcttagctgcctcagtctgcaagagaagcaaaagaaacattcaaactcaacatcttatgtaaaatcactatccattgtttcaaaacaaatagtaaattagagagacactcacagcctcaactaagtgatagtgtggaatttgaggaaataggtgatgaatgacatgagttccaatgtcatggtgaatgttattgatcaatccataatcacgatcaagagtagttagaccacccctaaggtagctccattcctgttcaacacgaagaaggataaagatgtaaactaaattgtatgcattgacattataccagtcattttcataagaaaagaaaggacttgaaataatgaaagatacctttccacgataccaaggcaatttgtcttcatggccatgatggtgcaaataagtcaccaaatccaaccacatgacgaatatcttcaatttcaagaaagtcaaatgagaacttcattcattttttattcaaaaagaagaaccattgaaatgatggaaaaggggaagaaacttacaacatagggaacaccataaagcttaagaagttgaattggacccattac

SEQ ID NO: 7299 - DNA, 579 bp, Glycine max
atgagtaaatcactcctcgggttgtagaacaaggccaaggacacacgatctttgtttgagttcacaatcaccctgtgttctacactcttgtatattgcattgctcagcacctaaaagataaacatggcattgaacattgattaattactaacaaccaccaattgttgaaatttgagcctaaaaatgcttgtttgggatgattactatatgattatttcctcaaaataagtaaaccaaacatgtaagacaaatgttatgactaaaatagcgtgtggaagaaagagtaattaatgtaattagtcattatatagcagcttgactagtaaaaagggtttgaagttttaacaaatctagagagggctaggacctgaatttggtcaccaatgttgatgatgaaggcatttgggacaggcttaactgtaatccattcatctcctcttcttacttgaaggccagacacaaaatcatcagggagaagaatggtcatgccaccaggatctgagtgaggggagagtccaaaagtgaggtcaggttgagggcactttggatagaaacaggttgagggcactttggatagaa

SEQ ID NO: 7300 - DNA, 292 bp, Glycine max
tgagcagtcaaatggatgctttggctgttgcagatagaggaataagatttgttttgcttccggaccctatatttgacaagtttgagcagcaaaagagagcatagatgctggatatataattgaattttttgctcactagtttaattctctgcatcttccattgttcatattagggatgttgtaatcacatgtcattgtctgccaaagacaagtaggtaacagatttgttttaattgaacatagcattactgcttctttagataattctatgactcttggatatgcacatgca

SEQ ID NO: 7301 - DNA, 393 bp, Glycine max
aaatcaatctagacgtgaaagaaattttagcaggtgagtaagtgaatgcattaccttgggaataatttactggatgatctgaaaatcggtcaggagttgatagcctagcagagtgctgaaaattttctgaattgtttatagacactggatatggccttggtctttgagaagaatttgatgtgggggtaattgctgtagaaccattagaggtagttttgtctctcccagatatctgtttaatggaagaccgtacatgtcattaacaaagctcagcactgggacaaaaatctaaaatttcaattactatttatcacgtggattggcaatcaaaaataagccctgttatatgatgtcccaatgtattgttggatacttggaagcgtctctagattc

SEQ ID NO: 7302 - DNA, 685 bp, Glycine max
  misc_feature (60)..(62): n is a, c, g, or t
  misc_feature (675)..(675): n is a, c, g, or t
gatatatatactaatcaatcggtcaaaatataataataacgaaattctcctaattttacnnntttattgatacaattgaattgattgtggcaatgaatatgtgtaccccctcccgtttttcttcccatcttttagtgaagttttcctgtagctgctttgcagaattaacatgcaggaactgacatcaaatatgctatgattctcaatgtagacacatactataggtcagttttggcccgtttcatttcgttggagttgaatgtagagggactagcactgagttgagggctctcttctctaaaattggaattcagcatagcaagttctcttagttgttgccttttgtagagatcctgtgactcatcctgcacgtgaaacggaggagaataagaaaaactcatatacaacacaatatcaacacttaatgtctctttgctaattggtttgcaatttgactaatggaacattttgctccaaacaaaacccactttcctacacatttctgtctatttgctgcagctaatttattagcatataaaattaagtaaaaacttcagtggtttgatatatgtagtcacaatatctcagtagtaagtaatattcagagctttaaaactataaggagataccatgggtttgagtagttcttctatgatttcctgtgcttgcctcagncttatatcaa

SEQ ID NO: 7303 - DNA, 170 bp, Glycine max
tatgacagatatgcatagattgagttctcgcctattaattttattagcagaggttccagttttatcgatggtcttctgtcagaaaattggaggtaggttatgccggaaagtctatttatattccgtcctttccttcaaatgatggcatagaggatttgtgcattaagaag

SEQ ID NO: 7304 - DNA, 544 bp, Glycine max
aaggggtttagctaagtgtaaggtttttagagacataccataccattgctgctgagagcaaagctagtttcaagtctgtgaaaatgtaattgaatgactcaaatgaaaatcctgtccaagtctgcctgaaactttctgcatacatgatatacatgaccaacaatggtatggatatccataatgaaatagaaactgctacaggagcacctataaaactcagatctgtgcagaaaatcaaggcatatgcaatgaaaatatgaaccaaaagtggaatagctgagaagaccaccaatgactttacaacagattgtgtttgaagaaacctcaagatattttgcaagaagctaagtgcaaataagccagggataagaaacttggtgtaaagggaagttgttcttgcaatgtcttgagattgatgtagcaatacaaggattggctctgtatagaaccaaataattgatataatgatggaaaaaataagagagatgatgcaagaggcttgtagataaattcccaacatttggtattcttctgctccaaaacc

SEQ ID NO: 7305 - DNA, 300 bp, Glycine max
acgattacgaaagtgtacattaattctcatctcaacgacaagaaatacaattgacgataattctgtaagatttagaacagaatttatagggttaaatatatttttaactctaatgaaatttcatttttttactatttcaaatcatttattaattttttcgtcataaatatcagtctatcaaagagattaaaaatggcagaaaaaagtataaaaaatttaagaaactgatattgataacaaaaaaaataaacaagagactaaaaatatacaaaataattcacagagaccaaaaaaaaaaaa

SEQ ID NO: 7306 - DNA, 268 bp, Glycine max
tcttcgtatacaagtttagtaatcgaaagacagtttctaatgtcaagcaaacaaaaaaatagcatacatatattaataattataaattatacataatccatcggacagaaggtacattcgttctgaaccagacagagaccaaagccaaaatcctggagaaatggaaaatgggtataatgagcaaccaggaacaatccgagaagtcctttcaactaatatgtttttgttttggcagccttcttcttgggttgccttctaggaatagaga

SEQ ID NO: 7307 - DNA, 604 bp, Glycine max
gaagcgaaattgcttacactcaacattgatttgaacttgaagcaacttcccacaagaactcatcctcatcatacttgatctcacagaaatcattaaaaaatctatgcgaacaaaaaaaatgatcttgtaatgtcatgattatgcgaagatcaaaacctttctgccaatctagcagtaactgcccttagttttgaatacacctttcctgctggcgatcctagaatcaggctacaaagagaatctctggcaatctttatgttggcaaaagatcccaatatgtgaattttggtgtcagcaatcacgattcttgtcttcgacgcattctcaattgcaaactttgttttaccacccttaccagacaaccttccaatagcacgagacaagtgatctcctcgaagtgttttaacatccttgatctcaaaggactcaatgtagagctcatccaaacgcagaagagcaatggcatctatgacatcaaaacccaacatgaaagcatggacaaaatcagcacatttttgcaggttactaatatcaggtgtatcaggccttgtcttcagctccactctacgagccttcaaattcatacggacatcaattttcatct

SEQ ID NO: 7308 - DNA, 778 bp, Glycine max
  misc_feature (59)..(60): n is a, c, g, or t
  misc_feature (62)..(64): n is a, c, g, or t
tgtaccactatagcaaaatgagcgaatcataggtacattttcaacgtaaaagaacaaanncnnncacgtgcaacactcattccttgaatattgacacagggagattctgtctatatgctccgtatcattagtaatgcatggtattaagatgctactactaattgtctttggattagcgttgaacgtataaattacacgttccaatgcgaaaattttaaagcaactatattgtagctttcatctaaaagtccgttggcgttgaattcaactgattcacaaacacaaactaagaagatgtgttgtgttgttgaaaaaacctaaaagggtgttggacccaggtactcaatgccatccatttcagagttctctggcatctcaatttcttccaaccacgcgtaactatcattttcctcttttgcctcaccaataatcctttcgtctgcagggtaaaatcataaatggtcagagacatggcaataatgtacaattgtgcatcctcagacactagtgcaatagaagtgtacaagtggaggtgccacctcgtcaagtagggaatagtgatgcaccaaaaaaagcatagatctgatgctaacactatctagcactgtttaatgtttgtgcatatatattgctacccttttttttatctttttcaaattcgatattaaaattgaatcaatgtgttggtaagaatctccataggtgaaagtttgacaaaataaggagaaaaaatgaccaatggaaacatcaaacatttgaatcccatgcttaaattttt

SEQ ID NO: 7309 - DNA, 441 bp, Glycine max
ggttagatcaactttataagtacttgtaccaaaagaaactaaggagttaagatgaattatgcttattccataaacttaaaattaacttatgcataagttaaatcaacttaaaaaaaaagttaaattagagagtttacacaaattaatttataagtttatgcataacttacgggagaaaatttatattatcttcttattttcttctatttcttaagaaatttatctaaattgaactttcaacacatttcattatgtagatttgctttccttgatgcctgtgtgtagatttcacactcatcagtctcctattgtccttagatgtactgctgcttatcccaagataagaagatccccccttcagatttcttgctgcttttgggcttctcacaaagactaccctgaaagttactcttcacttgattgctaagctagacgaggttc

SEQ ID NO: 7310 - DNA, 362 bp, Glycine max
aagaaataatattaagggctaaaagctacctaatccctttacacgtttattaaggaaactcccatggtttgtcccaacttccgcaaaacctcctcatcattccagtacctgaaagaaaaagaatcacttaagaagctacttgacatcaatattatgggggaaacatggaaatgtcaacacagcaaaaaaaaaaattaaaaagaaaaattgcttctaaacctcatcatagcagcaggaccaccagtctctatctcctccaaaatatgtttcagagatggatcctccttgatgagttagttacaggaaaaaacgagggtagcggtggctccgaggaagccaaagaaaggtgcggtttcgtcgcc

SEQ ID NO: 7311 - DNA, 596 bp, Glycine max
gatatgtgaaattgatatatcggagtgtatttttccttgatatatttttgtttctcttgatttctattggaacaggtattattgggtgagagtcctggatgtgaactggaaaatagcttcccttccaaagctggcctgcaaactgttctggaagtgctcaaaattcagatgaacttttggcctgccttgggtcccatttttgtgaatttggagtcacaatggaggatgtactgttttgaaagaaaaagtaaggaactgtctttgatttgtatttattgaatttcacaccttatttcgtttgatatttttatttttttgttatatttggactagttggggacgaattcagtatcttttaccctactctaccaatatactgtgtactctgggagacattagaatctagtattttagggaagcttcaatttaaaataccttactactactactacgacttattattattattattttgtagggaaacagattaagaaacgacgccgagttctggttccaatgtggaggtggggacgaaaaagtttgttattccattttctgaacggccaccataatgtaaaatcaaagttatgttgagc

SEQ ID NO: 7312 - DNA, 638 bp, Glycine max
ctctcctgccccatatacaaaataatattagtaagtagtattgacattatttggatataagacttagttgtacattttattattatttttatatgtgttggcatattttgtcacccaacttcttttatgtttgtacattatgtcacttaactttttaatgttttgtttaggcgcattttgtcacatagttttcaaaattttgtgcattttgccgcttacattataattttgtttcagaaaatgagtgataaaattcgtgaaaacataaaagatgagtaacaaaaagtactaattaaggaataaatatcaattgtttaacataaaaatctcctcataaaggaaaatgttttttttttgcacaggaaaatgatatatacatagagacatcactatcatctgataaatagatacttacttatagaggtaaacaaatgattatctgagctaactggcaaaggcagataatgacattagagagggtgattgttattgaaggtgacaagtgcctaaataaaggttttcaattcaataaaccaaacatgtcattttccatctctttcaaatatttgcattgggctaatgtgcctgcataacactaaaattaaaaaaatgtttttctttcccaatcaaacaaccta

SEQ ID NO: 7313 - DNA, 390 bp, Glycine max
cgctcagctgaactaagagatggggttgtctttcaccaagctttttagccggctctttgctaagaaagagatgcgtattctcatggtaggtcttgatgctgctggtaagactaccatcttgtacaagctcaagctgggagaaattgtcacaaccattcccacaattggtattcaccttaattggtcttctacatgcttcctttttttcttgtgtttcaacttcttttattctccatagttttagaagttctagtgctttatgatgtgattctactcaccattcagcttcccttgcatgtcttatggttgttgaaaaatgaattgccaattgatgcttatgtttgttgttatccaggattcaatgtggagactgtggaatataagaacgca

SEQ ID NO: 7314 - DNA, 586 bp, Glycine max
ctgaaaagatacatgcagtggacaaaataataatgcagcagaatagatatcttagccagaaagtgtaacaatctcaatcaagagtatttccatttcccactcaaagcacgaatccattttccttcacatcttccacactgtgcccattatttttgttctcctgctgagtaggttcccccttgaccttttcttcattcaaccctgcttcttcctcttcttcttctgccacctttttctcaagagattgaatcaaattcagcaagcaagactctacatcctcattcaaacactttggcatgagattctcagcaatatcagcaggagtcacattggtcacttccaacaaattcgcaattctagcgaacaaatagtgcgaatcaacatccaagtagttcttggcaagcaccttgaatgcctcaaagcggcaataggacaattcaatgtgtttgtccatcctacctgtcctaataagagcaggatcaagcttgtccacaaagtttgttgtgaaaataataatcctctctcccccacatgctgaccaaatgccatcaatgaaattcaacaaccctgatagagttaccttgca

SEQ ID NO: 7315 - DNA, 212 bp, Glycine max
  misc_feature (52)..(54): n is a, c, g, or t
  misc_feature (58)..(58): n is a, c, g, or t
acaaagactctcctactctctcacatgaacttcctgtacggccgaccattannntttncttgcatatgctgtaatcataacagttcaaagcattcttatgcacaccctcaacaaattaaaatttaaaaccatatgtcctacaattaaagcatccacccatacagcaagctcggagagtttgatatgataaatcatgtgaggacaaaaaaaaa

SEQ ID NO: 7316 - DNA, 499 bp, Glycine max
agaaacacatacacacccagaaagtgggaaatgaggagagggataaagaacaacataattgaaaaagaaaccggtgtttaattaattgtcatgcgaatcaaattaaagctgaatattgctacatgattattctaaaaggagaaaaaagggttacttagtaacacggaatatactcatagtcatagccaaaactgaaacggatcggaccaagatgcttgattccccaggaggagttgttggatcttgcagcaaaaccaacaaagacccttttcactccaaccaaaaaagcaactagggttcactcataagcataagcaaacattaccttttcactttgtcatcaacttccccttgtgcttgcttgtgaccttgtttagtgtgtgaaggtagctccttgttgtgttggtgaaggtgattatgatcatcaagtgcaataaggggatggtggatgatgatgatgatgtttatgataaaggaattagagttggtagcaatgagg

SEQ ID NO: 7317 - DNA, 554 bp, Glycine max
cttcaaagccacaaacctgggctgttggttcactaaaactttcacacagcctccttgtgacttattcctaagccctattaccacaaggatgttcaacaattctcagtgcatcagcactgcagcctcttgcacaagaggctgtgtaacatgcacaaaatgctcagcttccctctccacctcttcccaacacttgtgtgcactcttcccttctttcatcttcttcacaaaccccacaaacttcctccagttatttggttcaaacaaatgcggattcatcctcaggtatgtgaaggcacacatctctctatcaccagactcaccatcaacatccaattgtgatgcccttatgatctgctcatgtgcatactcgtcgtaccgtggcagcgcgttttcgccggcaagtggaacctgtgccttctgcgttgccagagccacttgcttcaccagcttctcaggtgcacaaagggcctcttgtggctgctcgtgatcgcgcatctcgatacaggtgaagttaaagatggcaccgtggcgcgccagcatttgagcaatggaga

SEQ ID NO: 7318 - DNA, 163 bp, Glycine max
gctttttggtcatgagtcaatatgacgggttaaggaagcaagatttgcttttgcacaattatcattttattaccgtccttatctttttctttctttccatagtagaatcacatggtatatgtaattgatctttattgtgaatatgatgccgttatttgcatta

SEQ ID NO: 7319 - DNA, 568 bp, Glycine max
aaattcttggacaatttctaatgaattagcaccccctcaataccaatttaattcagtggaaacctttcaacagcaaagtgttggttataatgattcaaaatttgatgatggcatggatttctggtatgacatattcatcaaatcaggagagtcaatcgaattgccagagttctgaaattctcatgaacacattgaggctatatcattaaatttggcagatacgaaacatttttttaagaaaataaataaataataataatcatgcatgttacaaaattgaatctaactgctacaaggaattaagggtacatttgtaaagggtaagaaaaattatgttatgatgtaatatataagaaaaagagggcgcaaaatatgccagctaatctgaaggaccaaaagggaaaatactgactttgtttatgtatattgtggaatacttcatgtccgtttaacatttttttttgttaaaaaatgtttcaataggatagagttgttcaaattgtattagcaataaattaattatgtaatgaagtattcaatttttgcattccacgtgttttattgctta

SEQ ID NO: 7320 - DNA, 313 bp, Glycine max
  misc_feature (34)..(34): n is a, c, g, or t
tcgtgggttaaacaagagatgaagctgatgacanctttcaatctttgagtttttcagacccagatccaattattcaagaaaagggtatagtgaaactcaaaaaaaaaaatcaaaatttaaccaaaacaccataaacacaagcaaatatataaatactaggaaacctcagttcaatcgtcgctgtcattggaaatgtagaaacaccaagtaggttctccctgaaaacagggtctgggatcaactacaacctaacaagttggattgtaacatcattggggaatttacaataggtaactttctagcaagctacaaa

SEQ ID NO: 7321 - DNA, 487 bp, Glycine max
actatatacaaaatatcacgaataactccagcaggacctaatccgacatgattgttacatacaaacattacaatcacttaacgaacaacaaaactctaccagacatgatccaaaacatccttaggcacccaaaaggaatgtaagctccaactctaaccttgaaaggtcagaaggagttataagactcaccagagtcactagacagtggagagttacgaggagaacccccaataccacctacatgactactatcaaaacctatggcttcaagccaaaaactaatccagggtgattcagatgtgtcacctttcatgaagatattgacctgcatgttaagagctcaccgcctcctgggtgtgatatgctcttggttaaggacattatggggctccttatgtcccgttcgatttctgttcagttttcctgggcattaagccctcctcagaataaaaaaaagaaaaagaaaagaggatgtgccgcctctcgt

SEQ ID NO: 7322 - DNA, 400 bp, Glycine max
aatttgccaaacgcttaaaacaccatgtcagaattccactgatcccctttttacatctcccacactctcacactcccaagacatgagaaattattacatattttaattttcacatgacacataatcaagttttattaattctttttagtaaactgaaaaactcgagtatatgccaagtaaaaactgatctagaatataaccaagtagtcagggatcatgtaataatttctcccccaaagaattaacccaacacatgaatacacaatgtatatggaaaaggcaataaaattcaactaattatgacccatgaaggatacatatctcaatggcatctaactcccttgtcttgttgcccagccaaatcctcaaaactccaatctcttctcattccactgctact

SEQ ID NO: 7323 - DNA, 628 bp, Glycine max
cgtggcaaagctcaattctgttcgcacgaccaaatccctgccactactaattccacctcaccaaaatcagaacaaaaaaacaaagaaagcaaaagcaaataaaattatattatttttgaaaagataaaaaaatctccagataattaattactttaatcatattcctcaaagttaaactctatgaaaagtacttgactaaacaaaaaagtatattgagtgtaagtttggagctcaaaaagatgttttcaaaaggattaagaataggcttcatcacataatgaatggaaacacaaacaaacaagtcctaatatgtttgattatatgtttacctaatttaatctgcggcttgctttattccgtataataatgtcaatgcgagtttgtgactcaaatcagagacagttacttttcttcattcaacaaattaaaagtaaaaactataagttggacaaaaacaaattattaagaacaataatgacatagttaacatgactaacaagtgtaataagagtattgattttaaaatactccataaatacacttttaccgatggtaaactgtagtagtaattttgaagaaagaaagggttttgatcaagttcacttttctttcagaagaagccatcgag

SEQ ID NO: 7324 - DNA, 782 bp, Glycine max
gagggcaagcacatgcatcaaacaaaagtttgctaaactgctaaacgaagttccacaatgtcaataatgtaaatcactagcaactgaatccatcatctacaactcatttcatgaaataaaagttgctctacattgtcatcttgaagctcttatcccacttttcattgatggatggaccaatccagtaaaaggatgaatgccgacagccacatttgctccttcaatcccatgaaaaatattttcaatttgttttagaaccaatcttcctcttagcaaaagatggcaaacagaaagccgctgtatgaatctgaaatagaaaacagacaaaatatatgagtcaagtaagaaaaatcagtcggatgttttgaagttagtggaaaaagaacatggtcggagcaacaaacctcagagttgtaaaatttcaatggtcttgattgctgactatcattctcatttataggattcactggatgcttgaaatcaacaagaggaccctcagttgagcaaagcataaaaccaatcatcccactgaaatggaaataatcaaaaccaacataaatatggttaataatataaattctaaacataggactatgttttgaagactgcaatgcaaatgggaaaataatatttgaaagggcataccttgggtatgtaggaactgtggtccatgcatagttgatagaacctttgaatatttggcgacaattagccacaatgtcctcaatgatgtgcatatgaagccatatactttctgcttgagtacacacaactcctccagg

SEQ ID NO: 7325 - DNA, 550 bp, Glycine max
tgcgggggtattgttttatcaacgaacgcaaccaggcagattattgtactagcggcacccgatggccttgtgctcctggtaaaaagtattatggccgaggaccaatccaactcacacagtaagtcattaatcctaccatttcaagaaaaataagaacaggttattataattaagtttctgcaattaatttagatgaaacccatttcattaaaacaataataagatatgtatgttaaacctaatatttacatacacttaaaggatgaagtagcgtagcatatgatatgagagggctaatgggatattgagcttatcaatcaataaatatattagattacacttaagggatatatatcaagtatatatgagggtctatattagtaataatgcatgtttgtagcatatgagtgagctaatgggatgtgttgaccctttttaacagcaactacaattacgggctagcaggagaacaacttaatctaaatttgctaaacgacccggatctagtatccagagacccaattgtggcattcagaacagccatatggtt

SEQ ID NO: 7326 - DNA, 494 bp, Glycine max
ttcagggccctaatgagctgcaagtggcactcctaatttctcagttaggcccttaatgtattcctttctagcaggattgtcttcctgtggtctattatatgctgtccacactggctcgcccttaaacagcctcattaactgaacacaaacacacaacaaaacaatgattaatcaacctagaaaagccttgaatcttgatatatttaaacaatcttagactggcatcattttcttccttccacatcccaaaaacgaagccctagcaagagaatatatggttgtggttaccataagactttcataccttcacatagttacttgggtctagggtgaagcgatgataaattcctgctggtaaaatgataagatcaccagccttgatcaaaatgcgaatccagcgatcatccttgtcccgcacgtcaaagtagccacttccttccaaacaataacgaatctcttcatcctgatgaatgtgctcagtgtagaagttcttc

SEQ ID NO: 7327 - DNA, 381 bp, Glycine max
tctcagggcccctaaagtcaatacagaagccgtgatgccaaacatcagcaagaaagatcctaaggttacatgatttattattcaacaaaaaacatgaatgtttgttttagtttggctttacatatgaacatgatttagcttatatttgaggttatgtttctgtttctcaatcaacagtgccttaaagaggagtccttaatgtgtcatcaatgccagagaaatgataaaggcagggttgtgagatgcacaagttgtaagaggaaaagattttgtgtacactgtatagaaaattggtataacatagcctctgtttcatttttctctctcctctttctatgtcagttataagaccattatactgtatatgccttgtttggttga

SEQ ID NO: 7328 - DNA, 360 bp, Glycine max
ctctaataatcatcatctccttcaccatcatcatctccatcaccagactcggcaccaacctcctcataatccttctcaagagcagcaaggtcctcacgagcctctgagaactcaccctcttccataccttcacccacataccagtgcacgaaggccctcttcgcatacatgaggtcaaacttatgatcaatcctggagaacacttcagccacactagtggagttcgaaatcatgcacacagccctctgcaccttggcaaggtcacctccaggaacaacagtaggaggctgatagtttataccacacttgaacccagtggggcaccaatccacaaactggatggttctcttggtcttgatg

SEQ ID NO: 7329 - DNA, 839 bp, Glycine max
  misc_feature (35)..(40): n is a, c, g, or t
  misc_feature (770)..(773): n is a, c, g, or t
  misc_feature (775)..(775): n is a, c, g, or t
caaaaaaacattatcaaggcttaggagagtttacnnnnnngggaaaatcactttcaatcctccaataaagagggaaatgtatgcaggctggagtcatagacaatgctgataatcgtcaccagtcaatatcccaggacaggtcacttttatttgttcaatcattgccactgtccacaggctcttacagtggaagacaaattcatttggtcttatacttcaaaattcaaactatattgaaattgggtatgcaaactttttcaacttttcctagtgtgtcttgatcatccaccaaaacttgttgagagcatcataactgtcctttcctcaactgttacatctactccataccaggtaccagctgctaagtctcatcataactcgatgttcttacagccacataaattgttgcctaaaattcagaagtggtatatttgagcatgaacagctaagcttatacctacaagaaaacgagaagtatcaatatttcatcttctagtattagagcaaatccatgttaaaatgttattcagtattgcaacacaaatgttttgaatgctccttgctagcacatgcttcaaaacctgcacaagtcacattaaactcagacagccagacatcagttaactcatggaatgaataagataatcaaaagataaattaatgaaaatgtgaactatcatatttgttgagcctgcaaaagatcaagaaaaaattaggcagcaaaattaaaaattagttttcacatgcacaattttgtccatgtgaggaannnnanggaacctgagcttacagaagtcaaggcaatcaacataaccctgaaagcctaagagataagatcg

SEQ ID NO: 7330 - DNA, 682 bp, Glycine max
ggatcagtacgaggaatatgtcaaaactgagctttattacaaaaagcatttgctccggacacctcattgttcccttctgctgtctaactatgcacagtttctcttccttgtccttcatgatattgatgggtgagttctcaaaaaccaattttgtgatcatatccgattagtattagacaatgctgcattctttagctagccttttgattagtgagaaggagcaaaataataagaggaaagaatcatgttgcttgttttattctctatgcaaagaagggtgtttaattttttgttttctttgtcaagctcaaatgagtcgttttgaagatttattttggtgtagagtgtatagaagtgacatcaatactgacaaacaatgagggtactacttgacttgacttgtgttcatgggtataggtaaacttttaacgggtgaaggcataacagataatgtaaatgtatcctcaagtttcttatttctttaggcccttctagagggtattcttttgttgatttattttttccatttttaatacatttgatatgttttttcagggcagaagagtactacaagcgatcagtgctagcggaatcaccggaagctgaggcattcagtcgctacgccgacttcttgttgatggtaagaaaggatgtttgggcagcagaactgagatatctgcaa

SEQ ID NO: 7331 - DNA, 240 bp, Glycine max
ttttttagcacaatttctattattggataaacgtgactctcattatgtgatgtcacatatgctacttaatgaatctcatttattgtttagtgagattcacccaataatagaaaatatttgaaacaatatactatcaagtgtgttgttagctttcctcgacaaataagaaatactaataccacactctttaacacttgcagaaacaaataagattaacacatcaaattgttgacatcagca

SEQ ID NO: 7332 - DNA, 486 bp, Glycine max
aatcaaattcataacactcgagctattttatgtacacaatcaaaatcaataataggaagggaaaaaaagacgatccaacttacatgttgaagcaaccctggcacttaacatccttcaaaagaggaataaaacatgcaaacaaaaccaattaggcaaaaattaaaaatccaaatgggagacaaatacccttaaaagaaaaataaaaaaaataaaaaagggatgatcgaatttctaatgaaaataccatgaagaaagagtttggtgactgaacaagacgcttgagcttgtgtttcctcttctcaagctcaaccggaggatttagcaaatcaatatcattttgaagaacctatcaaacccagaagcacaaaaacttgacagttattcatcaaacgtaaccactttcatataagcgaaacgcagcaacaaaattaaaataataaaaaaattgcaccatcgccacagaaatcaaaatacaactcgaaaaaa

SEQ ID NO: 7333 - DNA, 632 bp, Glycine max
ccaatatcctttgccagcttctctgcctcactatgtgtatcaattacatggtcaaagcaaatgtatctaccagatgcattgttgttcatttccttgaatacgcttgcatgagcttcagccaatttggtcacatcaactgttgctagcaaacgacgagagtacatttcttgggcacctacatttgcaatcgtaaaatctttatgtttcatttttaaattaattgatattaagtaaaattgtccaaaagtatatataagttacaccctaggaattgagggcgatacaaaaagaaaatgggctacagatactatgttagatgcattttaaaattaattgacattaagtgaaattgctcaaaaatgaatatataagttacaccctagtaattgagacaaaccacgtggactttacaacatattatatcaatatcacatagtacaagaaattggaccactgattttggtcaatagtaagtagtacctttgagataagcaattgttgctgttggattcctgttacaaaattcaggacctgtaattagagctggacaaatagtagtgagcttcaaacccctttcatcagatattctccaagcagccttctctgctctcatcttgcctaaagcataccaa

SEQ ID NO: 7334 - DNA, 198 bp, Glycine max
aactacaaaaaaaatagagacttcaatgctttatataattctttcttcgtaataaagcttaacaatgacgttttgggtttgaaatcgcgcctatgctctttttctctgttttaattttctgtcttcccttcttaccctttatagatatgataattttccgtgtacttaattcatgatcgcaccactttcatgtacata

SEQ ID NO: 7335 - DNA, 166 bp, Glycine max
cccctattcctcattctttctaggcaatagattttataatgaaatcatatgcttgttctttgctttacttgcttgtgtagaatgcatcatttctgagttattaccactctgaaacatggtttttgacaatagatgaggggacaaattggcctcttgtataatctgg

SEQ ID NO: 7336 - DNA, 561 bp, Glycine max
ccaacaagaggctcggaatctactacgaccgcatcgaggcgcgtgcaatgttccacgacgcgaggtttgattcccagttcccggaaccattctaccagggccacaagagcaccaacgtgctgaacccggtgtttaagggtcagcaattggtgccactcaacgctgaccaatccgcggaactgaagaaggagaacgccactggggtgtacgagatcgatgtgaagatgtaccttagggtcaggttcaagttgggtgtcttcaagaccaagacgcttaagcccaaagtatcatgcgacttacgtgttcctttgaaaggaagcgccggtgctggtgtctttcagaccaccaagtgcgactgggatcgctgatggattcggattcacccgaccgacccgacccgacccggttctgctttcacgtcatttctcccttttcttatttctttattggttagttttggacatagtcgtcgtactccttgtccttcagggttactgttcagagatatgattattttattataccgcatgtatgtatgcatgcatcatctaccttgactac

SEQ ID NO: 7337 - DNA, 290 bp, Glycine max
cgtatttgttagtagcatgacactgctatcaccctccaagaaaatgcaagaatcttaaaatgttagtaactattccaaaatatttaaacctattatttaatattaaaatgcacatttatttatcacttgactcaatctcaaatatccacaattgatgagtgagtgttgtaaatcttatggtattgtatttgattcctacaaaaaaaattcattgttggattaaaaatcgtgaatttatttatgcattcactagttcagtagctagtttaaccatatatacatgtattaat

SEQ ID NO: 7338 - DNA, 476 bp, Glycine max
  misc_feature (458)..(458): n is a, c, g, or t
  misc_feature (462)..(468): n is a, c, g, or t
agtctccagaggttagcaatccctactatattgaaacaaagacatcgaagaaaaacactaataatcgacctaaaatttgagcacgtaccaatatatgaacttcaaattttcatctgtttagaatcttcatatgttacatggctctgaggttcactagaatataagcattggattcttcgctgggagatgattttgtcaacactaaaggccctcggagctgcctgaaattttatcaatatacgaactttagattttcatcacagttcagaatcttcatatgtttcatagctctgacgttcagtagatttataggcatacgattcttcatcgagaggtgattcataaacactggagccttcagagccgtcataaacaggagtttcaccaaaaaaggaactttcagatcgttcggatttttcgcgaacttcagtttctgctgtctgaacaaatcccaaaancgannnnnnngttcattt

SEQ ID NO: 7339 - DNA, 320 bp, Glycine max
ggtgagtaagactgagatcaatggtttgatcttcatttttagcattgatttttttttaccattattgtacatgttaggttacatttcattactttaaactttacattacgtcgagtttctgccattctattgatggtattagtcactcttgattttcccgcatttttatagtacgagaactgcttgaaatctgcatttcaattcccctactagtacatgcatacattgtattgtggttgacttgtgttttttgtgttgaaaagggaacatgtaaaattcaaagtataattctggatttctccaaatctgaaaaagtggta

SEQ ID NO: 7340 - DNA, 335 bp, Glycine max
ccacataaagggcgctataaattaatgcaaaccaaaaaaaccttgcatctccgtgttagtgtcaagctacaatctagaaatggaaagctaggaaagcggaagaccttacagagatagggaaaataagaaggatggagtgaacagaccaactgtgttggtgattttggacaattctactttccactaatgaaatgtggccttggtcagtaacctatcaaaacagtcatcgaacaaatggagtcaaacggttttatcacccatcagtagtgtatgccaccagccacaggcaacatttcttggccggcaaccagcaatagaaacttgaccaggaatga

SEQ ID NO: 7341 - DNA, 617 bp, Glycine max
ttacttagtacccctcctccataacgacattccccaccaagatatcctactacactacactaacagtgatgatagcttgtcaccgccagtgtaaaaatagagtggccagctactgtatgcaaaattgctgcatgagaaccacataacactgtcagaactcagagaagcctgagtattggacgaaagagacttgaaaggagggatcaggccgtaaaaacacaattcctatcaggcacggcattattgaagacaactttatttctctttttccaaaggaagaagtagaacagcactccataaaatttgcccgcccacagaagaagttttagagaatcccataccttcattttgccaaaaaagagcctcaatggataagacatgttagattttttaatggatctgtaacactacaacatgtagaacctaattataagaccggagccataccttgttgaaaagtgcatgagcattgccaagttttggaagagcaccacattccctttttgattacataaggtcagagttccattcaggcaaaactaattacaagaaatacattcaaattcagctaactataatgggtttaatatatataccactgaccatatatcacttgg

SEQ ID NO: 7342 - DNA, 254 bp, Glycine max
caaaagttcaacatcacatgtacgacacgtactcaacttgatttcgcatatgacatttaatattaagatagccccaataacatataaatgggtcgagtggagcaagtgggtggcaacagcttttacttgttagaaagaaagggtcagaaaggtgggtgatttcttatttctagctgcatctttcaattttcatttgcaggatcatacaaagcaacattgtccacgcaagctaaagtaagacattagcaccagtc

SEQ ID NO: 7343 - DNA, 584 bp, Glycine max
tgtgttgctcttattctgggctcctgaagttaagaagaggggatccacatttgggtatagaatcaccaacactagagatgctggtttgtataatatattaatctataatatctagggtcgagtaagacatgaacctatttacagcagagaaaaaatgaagagaaaaagttgtggagatatcaaataatggtggaatagattagtacgaatcttccaatttctctcattttatggcaatctgcattctttacatgtttgctggatgcccggcatttagaaacagcacttggcactctctgaaaccgaaaaccaaatggatatatcgagtaacaaataaatcattagaacaacagtatcaacttaaaggagggatgatgactctttaggagaacactcttttattgcatcaacgtagatagtgtacaagcagatgtttagtatattttacgtgtcaggagtattttttattgttgtctggttccaatcaaatctttttgcttactatttaagcagtatttcttctgacatagtcatgctcttcatctttggcaggaaatatcaatagcattagaaactagagcctt

SEQ ID NO: 7344 - DNA, 601 bp, Glycine max
cccgtacatccaaacatcgagaataaaacatttagaagtaattaaaaacccgtcatcctttctagtaatgctcctaaacccaatcaagcctctaccctcttgattttctcaagatgagaaacatcttcggcgtatatcttttcatttacaaaaagatgaacctataccttatggtaattgtttttattatattaactaaagttgggattagcagcaaaatatgctaaaaccccaacaaatggtgcgttaatgtatgtggttggctcggatttcctaaaatcaactcgatcatccacataatcatcattttcgtcaggtcctccaacaatggcaccaacaagaacattaggattgggattggtggaattgtaataaattgaaccttctttgcatgcaatgaactgaggatgatccttgatggagggtaaggaagatccacggtgatgaatacgttgtggatagtagttgctatagccaaccatgtaggataatcccattgggttatcacccaaaatgtaatcaacttgcctcttagcatgttggcgaagtgtttgtgcactaacatagacattgccacaattgatggcttgtgaagcgtgtg

SEQ ID NO: 7345 - DNA, 600 bp, Glycine max
tgccacggtagtagtacattttccataacaaaatactccttatctactgaaacattcaacatggaagtaagtaactgtaattcaaaacccaaataaaaaagaagcaataaagaacaaaagcacaaactcaaccagaggagacagagacttcacgcaactccttactcctaagatactcccgcaaaatggaaagcctggccgtctcgaaagcaaaatagcccaacgccgaaaaacaagcactatgcaggacccggggccccattccacgggtaagccctacccacccttcctccttcaaaatctgcttcaccgtggccgaaaccccgtcgtacataaccgcagcaaccttgctcaccccctcgccccgaacctgcgtcatcaacctcgtcttcaccacatccaacggcgtcgtgagcgacgccgatatcgccccggcgagggccccacacagaacactctgcaccggttccatgtaactctgcttagtcttctgaagcaccgcggctttcaaatactcgaaagaagagtaactcagaactcccgcgggtaagtttctcagcaatgtcgcggagtaaccagcatagaggcccatcacgacgt

SEQ ID NO: 7346 - DNA, 366 bp, Glycine max
ggagaacttttcttcaagttcaatgcagtcctatatcacagcttgtatgagaaaccccttaaaacgcgcattagttacacaacaacaacaacgggcccgttaggcccgtcatgaataaaaaaaaaagttgcaacaacaacgtactcattttcaaccccatgatgtgcgaagtggtattgacaacgaatttatgattcaccgtactcatttccaaggtagtgtatattttgtactgtagctgcagtgacaatcaagcataactatttcagcagaaaggaccgggtaactgagcttcagtgcagcatcgcaggctttaatttcacgatccaaaaaccaagtcacgtaaagaagccaaaggggaaatga

SEQ ID NO: 7347 - DNA, 205 bp, Glycine max
tctctcattgatcacacaaatcaaggatttcataaacaagagaatctctgagttgaattgattattgttgttatcgattattattggtttatagtttagtggtggctcgtggtgaaatgataattaatactaacaggcacatgcaatgttgcaactatggaccatgtttaggggtcccggaatgccaaatttaagaacacagaac

SEQ ID NO: 7348 - DNA, 495 bp, Glycine max
  misc_feature (465)..(469): n is a, c, g, or t
  misc_feature (476)..(477): n is a, c, g, or t
  misc_feature (479)..(485): n is a, c, g, or t
agtcatctaactctaatttcttcacaatttcttcattaatgcttcacagggacataaggaatatctcaggaaccaccttctaccaaatcctcgtacctatgtcaatccaaaaggctttgatttccccaaaaagacaggttagttgcgaattttgctaatttaatatacttgaacttgagactgcaataaaactatattgttttgcttagtattgtgtgtcaaccgtcaatagtttgcagtctagcatgccatagtatctcaccttgtgaaaacaatgatagtcttgggaatatggtgtattgaagtatcagacttagataatagctcaagttatataagtccctttcaacttgttgcctccttgtaattccaatttaaacaatcatcttcctgaactgatgagttaacattgtgtaaattgcatctttttgttgctatatgtttaaataattgacacttgacatnnnnntgaattnnannnnnnngaaacacaaa

SEQ ID NO: 7349 - DNA, 420 bp, Glycine max
tttagaccaacgtcaaaatagacaatattaaagataaaaccatacctcaaatatgccatctttcgtttttggtgtagataaatccttacgataccaaaattcaagacaatgcaactattggcaatcccttcagaattgcaaaaatgcactatggaagaaaaattaggagggagggggagtaacacgtttaaaattctatacaacttctgatgttcatcatatctatgagaagagaaattgataattctcagcgcttgcctcatctaaaatcacaagctggatgatcagtaagatacctatacatcttcattgaactcggtctatacatcatatacaggcatcctttcttcaatggatccacggcagacagggcaccttttacatttttcgcagcaagtgctaatatccacattgcctcga

SEQ ID NO: 7350 - DNA, 464 bp, Glycine max
acacctaagaatccttaagtgaccctacctaattcaatcatttgcactccaagaaaaaattcatgggtacaagtacaacacatgagaatcctgaagtgaccccagttttgctacttctagtgttgaactgttgatcaattcaatcatttgcactccaagaaaaatatcaaagtgtaaaacacctaagaatcctgaattgatcctatctttgttaactgctagttgatcaattcaatcatttacattgcaatcaaaatcaagatgtagctggatggataaggctagcccttgagtagaagctacagaaaacaaataattcaagtgcaaaagcatatatacacgtaagatcacagaaaccaaaatcgtcaaatttccttgcctcttttatcttaagggttccaaaattacaggaaattgatttttcatatttttggtttagctaccagaaagcagctcacaataac

SEQ ID NO: 7351 - DNA, 444 bp, Glycine max
tccctgacgaggaagaagcacctacttttccacatagggtgcttgcggacttgaaaaacacggattcctcctccaatcttagtatcaggttctgtgtgaccgttcttaagcaactccagtagcatcatatgttcatactgccacacaaaaaacaactcatagtgaattcagcaagtagattaaggttgtgggcatcatcaagacacgttactaagactaagccaatttaaacattaactggccatgaatttgcatgcagttgaatcttgaattgcacatgcattaaaatagattacaaaccattttatatcacatgttgatggcactgaaagccatttcacaagctcatgcattaaaataattgtttcctaataatcctatgcacttctggaaatctttgcagtgaatctgccaaacatgataaataaatagattgtgaaaaag

SEQ ID NO: 7352 - DNA, 508 bp, Glycine max
aagtagttgctttgaacatccaaacatcaaccaaggaggaaaacgattccaaggcttcccacaaaacaattgccaaggcaatttcacctaggcctgctgacagtaagccggagaatccggctaaaaaacataaacttgggaactactgcagtcttaaaggcgatgtaatggagatcctgagacagatgccgagtgtgactactactggagatggccccaatgggaagagaatagaagggtttctgtacaagtataggtctggtcaagtgtgtattgtttgtgtctgccatggtaactttctcaccccagctgagtttgtcatgcatgctgggggcaaggaagtggccaatccaatgaagcatatcactgttttatctaactcattttagaggcaatgtgaatggatttataattcattcatcttggaatgtagagggaagtggaaaaaatacacacttgaccagacctatacttgtacagaaacccttctattctcttcccattgggg

SEQ ID NO: 7353 - DNA, 498 bp, Glycine max
ttcttggcttagtatattatcactgggacttaccaagttacttatatagcaacaactaaatgttctctcgggtaaaagaggtgagggataaataaaacttaaggctcaaaaatttaataaaaaaaatagaaaaagaaaacctgcaactagcacccttcaaaatcgttagcaccaaatatccccaccgaaaacagttactaattttcctttctcattctttggccgcatttttatttacacttcagatcaggccagtgttcatacgttctgcatcagagcacaccatgtgtgcatatgaacattatcgcatcaagaaaatgttttccagcctaaaaattagagttccaattgatctgtgcaggctgaggctgctgataagatcctgaaggggggcctacagtttcaacgggcccagccacagcctgagactgttgcaaaagggttgaaggtgaagctattgtctgccctgcttgatacataccagcaaatgccccctcg

SEQ ID NO: 7354 - DNA, 390 bp, Glycine max
catgctacatagttttacacctttgaataagactaacaattatccgggaagtattataccatttatcctaaaatactaattaaactatattagtctttaaagtattacaaatcatgctacatagtttctcaagtattgaaaaattcttcaaattagtctctcaatgctagtaaaatatatcaatccagagactaacttaaggaacattcaatactttaagaactacttgtataatttataatttaattaatttaaggactatttgggagactacattgatagtttattcaaatacctatcaagcaatctcttggctatataacaccggctaaacaaataaggacgatatagattagagtctgaaactaattatctgatgtaactgtttca

SEQ ID NO: 7355 - DNA, 674 bp, Glycine max
tttcatgcactagatcctcagaagagctattgggagctaggaaggcataccattccctctttgaccactccattgaagaagatgttgcctctcacatccatggcattgaaagaaaggtgaggtacacttgcaccatcctataggagaaattattgaatattgatcctgattcactacgtgcccataaactcgaccaatttttatgtgacacttagatgagttttataatattaacttgttctttcaaattaaaatttttggtcatgtttcatgaagattgactgtgatcatgacatgtggtgtccataataatttttaatcttgtgggtattgtaattaagacaattcttattgttacttcactttatatggtcattataattaattaaatgatggttgtaatgtaaagcacatagtagactatgtccaagtttagaaatgagatgcaagattgtatttgataaaataagtaaatgctagatatattacaaagaatgcttaggtgaatttgctacgtctttcgaaatacagcacaatatctaaagtcaatctaacaccaattacttttgtgaacagctattggttgccctactaagtgcctatagatacgaaggaacaaaggttaaagatgacactgcaaaatcagaagccaaaatcctttccaatgcaattaa

SEQ ID NO: 7356 - DNA, 474 bp, Glycine max
tggtgataagtggtgtggagtgagtgaatggcatccagcgaaggaatattcggcggcgcattgtctataaaaaggagagttagagagaagaaaagtattgaatagaatgtggtcagccctaaagaggaattacgaggttagcgaggagattggtcgcggtcgtttcggcaccatcttccgctgcttccacccactctccaaccaaccctacgcctgcaaactcatcgacaaatccctcctccttgactccaccgaccgccactgcctccagaacgaacccaaattcatgtccctcctctctcctcaccccaacatcctccaaatcttccatgtcttcgaggacgaccactatctctccatcgtaatggacctctgccagccccacacgcttttcgaccgcatgctccatgctcccttctcggagtcccaggccgcctccctcatcaagaaccttctcgaagccgtcgcccactg

SEQ ID NO: 7357 - DNA, 360 bp, Glycine max
aagcaaagtgaaaaatgatagataaatggtcaatcaaactcaaaccccttcatctgccttccgggtgcaatggaaaaagctccagagttctatgttcctcttgttcacaaggtgatgacatgttttgttcttccaagcagtcaaatacccatctcctgcacttcttcttgtacggactatcttcctcgtgatctctctctaccacttccccctgcaataatccgttaaagtactttaacttttttattttttttcaaacaagatctcatagttattcttcttatactactaccaccatcctaggttagtgtacaacatactatatacatacccttgttgtctccaaagtaacaacactgt

SEQ ID NO: 7358 - DNA, 494 bp, Glycine max
tcaccctttgccatctcctggatcgacatttttgtgaaaccattctttgtttttggtgtacaatgacgataacaaggacccaacatgtaataaatcctcgtacatctatctcaaccgtcaccactagaccaatcctaatggattttcccaaaccattctctcgcacaaatcacataaaaataatacactcactaacatctaataatagaatgagatcttaatgtaataatgtgcttctccctatgtactcttaaaatcccctcaccccatcttcctgaggtaataatgataataattacataaaaaaatttctcatcataactcaaatttcaaccaaaatgagggttaattgaattgtcgtaccttgcaaaactcgggcgagtcaccactgaaccgaaccctcaaatatgctcaaaataacggtttagtttggttggatttgaaaaattaccagatggttttgtcagtggggccatgtaggagtggtctggact

SEQ ID NO: 7359 - DNA, 493 bp, Glycine max
  misc_feature (315)..(322): n is a, c, g, or t
  misc_feature (330)..(336): n is a, c, g, or t
  misc_feature (343)..(357): n is a, c, g, or t
  misc_feature (362)..(365): n is a, c, g, or t
  misc_feature (373)..(375): n is a, c, g, or t
  misc_feature (379)..(379): n is a, c, g, or t
  misc_feature (381)..(385): n is a, c, g, or t
  misc_feature (390)..(393): n is a, c, g, or t
  misc_feature (403)..(405): n is a, c, g, or t
  misc_feature (409)..(418): n is a, c, g, or t
  misc_feature (421)..(421): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (431)..(433): n is a, c, g, or t
  misc_feature (435)..(437): n is a, c, g, or t
  misc_feature (440)..(440): n is a, c, g, or t
  misc_feature (445)..(447): n is a, c, g, or t
  misc_feature (449)..(449): n is a, c, g, or t
  misc_feature (452)..(453): n is a, c, g, or t
  misc_feature (455)..(456): n is a, c, g, or t
  misc_feature (463)..(474): n is a, c, g, or t
  misc_feature (478)..(484): n is a, c, g, or t
aaactcgccggactttcaaatccgggaacaacccctccaaaaggacaattacaccatacaacaaaaatcaacaaaactaataataactcgtaaattaattagattcacaaaaacataaccctcaaagaaccatacaggaagaattctcaaatgaaaaggttgagaactttccagtgactccactgatccccaaatctgttctccgtcgtcgttccggactcctcggaggtcatcgacggagactctggccggcggctctcctccttatgcaagaaaaccgaaaaaaaaaaaatgctcctctgtcgggttatggannnnnnnntctcatgnnnnnnnttgagtnnnnnnnnnnnnnnnctcannnntcaaatgnnnattntnnnnncttgnnnnattttgtgtnnngctnnnnnnnnnnggngnctntgnannntnnngcngtgtnnntntgnncnntgtgttnnnnnnnnnnnngtannnnnnnggggggggg

SEQ ID NO: 7360 - DNA, 343 bp, Glycine max
ttttattgcttcttgattccgtattttatcattttgcctttgtaattttggatctctggctttggatagcctcagttgctgataccgttttggtgtttccaatgtctttaatgaatttatgtggacttaacatgatgttttcaagtgctcaagactgaaataaatagctgtgtactcgagtgtattattcttaggtacaaataaaatgcatctgctgacgtgcaacgacctaggcaaaatcctttcacgggatgttgcacgtacatatatatatgatgcattgtgtatcccagtgacctggtcctaccacatttggatccttgaaaatttacctggcttgtaa

SEQ ID NO: 7361 - DNA, 202 bp, Glycine max
atattgctgaagaaattaaagggacaagcgataatgggaattttattggctgcaattaatacaggtctggccactaagtggttgtgactaattaataacagtaatacatgacaattgacatatatattattactctagtagtgacacgcatgcatttttattaagtactagtagtttttaccacacctatgaaatcacacca

SEQ ID NO: 7362 - DNA, 750 bp, Glycine max
  misc_feature (50)..(53): n is a, c, g, or t
  misc_feature (56)..(62): n is a, c, g, or t
  misc_feature (374)..(395): n is a, c, g, or t
  misc_feature (398)..(400): n is a, c, g, or t
  misc_feature (403)..(413): n is a, c, g, or t
  misc_feature (429)..(429): n is a, c, g, or t
  misc_feature (433)..(435): n is a, c, g, or t
  misc_feature (444)..(448): n is a, c, g, or t
  misc_feature (450)..(450): n is a, c, g, or t
  misc_feature (452)..(452): n is a, c, g, or t
  misc_feature (463)..(467): n is a, c, g, or t
  misc_feature (475)..(477): n is a, c, g, or t
  misc_feature (479)..(480): n is a, c, g, or t
  misc_feature (494)..(504): n is a, c, g, or t
  misc_feature (506)..(508): n is a, c, g, or t
  misc_feature (513)..(515): n is a, c, g, or t
  misc_feature (520)..(523): n is a, c, g, or t
  misc_feature (525)..(549): n is a, c, g, or t
  misc_feature (553)..(554): n is a, c, g, or t
  misc_feature (558)..(562): n is a, c, g, or t
  misc_feature (568)..(570): n is a, c, g, or t
  misc_feature (572)..(577): n is a, c, g, or t
  misc_feature (589)..(611): n is a, c, g, or t
  misc_feature (616)..(625): n is a, c, g, or t
  misc_feature (629)..(636): n is a, c, g, or t
  misc_feature (638)..(638): n is a, c, g, or t
  misc_feature (643)..(645): n is a, c, g, or t
  misc_feature (666)..(667): n is a, c, g, or t
  misc_feature (674)..(674): n is a, c, g, or t
  misc_feature (677)..(679): n is a, c, g, or t
  misc_feature (714)..(716): n is a, c, g, or t
  misc_feature (720)..(723): n is a, c, g, or t
  misc_feature (729)..(731): n is a, c, g, or t
  misc_feature (741)..(743): n is a, c, g, or t
tgtggcgatttcctatctatcttcaactatataccctaaccatgtctcannnnttnnnnnnntcataaactgaatagacaacaacaacgccaccctctatcaagtcatacataaaaacacaaaaaacaagacataaacacaacaaaaaataaaagtagtccttgaaaattggttagtgtagggtaggcaacacagatcctgagatcccagagagaatagatctcaggggatgaaggcacaagagaaaacctggtgaggcaatctcaatgcctcagatttagagaagcacatgtcatcaaggtcctcactggtgcaccacctgcactttgagttctctgagcactgtgacttcaacaccaactctccacagcaannnnnnnnnnnnnnnnnnnnnnccnnnttnnnnnnnnnnntttcccctcccccttnttgnnnggggggggnnnnngncnctttctttttnnnnncccccccnnntnnttccctttttaccnnnnnnnnnnncnnntcccnnntttcnnnntnnnnnnnnnnnnnnnnnnnnnnnnntttnntttnnnnncccttnnnannnnnntccccctttttnnnnnnnnnnnnnnnnnnnnnnncttcnnnnnnnnnncatnnnnnnnncncccannntttttcttttcttcccccccnnctttctnccnnntcctcttttcccccccccccccctccttttccccnnntttnnnnttctcnnnccttttcccnnncccccct

SEQ ID NO: 7363 - DNA, 601 bp, Glycine max
agacaaactagaccaggggatgtctagactgtaaataacaacaattctcccaggcaggtatgcatcaccaaatactctctacatcaaaagtactccttacccacaacccattccatttttcatttaggcaacataagttttgtgatttcttcattattctgagttggatccactggagagatcaggcatacctttcagacatcgtgtactttcaaagtttcatttatcaatgtaaagataataaatgtttagaaacacgttctcatgattaagagaggaaggttgtcagaagcattaatgattacctcaagtttgaaacaccttgactgctcagaagcaagctgaccacgtattgattggagttcctgcatgttcagtgtcataaaagtgaggacatcttgatagcattatagaataatattcaaattttgtctatagatctcatgcatgactgcattctgcttatatttattaatatattattagaaacactattttcaccgtataactgaagtcctttcttagccctgcataaataagggagttgtcatggcatagtgaaattattagattttaacaccatcatttaccaatacttcac

SEQ ID NO: 7364 - DNA, 425 bp, Glycine max
tacgggcacttatttgttgtttcggagctcgaaagaatgaagctaaaggtttatgaaccggaaaatgattcctgggaagccatagaagggcctcctttgcctgagcaaatatgcaagccttttgctgtgaatgcttgtgattgtcatatttatgttgtgggtcgaaatcttctggttgccgttggccatatcactagactgaacccaaaagaaagctgtaaggaaaaatggaacttcagtgttcgatggcatgtaattgatgcaccagaaagcttgtcagatctgactccttcaagctctcaggtgctgtttgcttagttttttcattatcctgtaatattatgctcacgaatgttgtatcaataaaatgtaattaatataattattagaggtctaaaagttgtaatagctgtgtgaaggaacaa

SEQ ID NO: 7365 - DNA, 229 bp, Glycine max
  misc_feature (224)..(226): n is a, c, g, or t
tgcatatcctcatcctcctcatatgcctcctgctgattttgttgcctcctccttatctcttcctccatgttcacatcatggagtgtggtctcctcacactcatccagctccatgtctgtcaactgcgatgtaggctttagtggcagagtagtctccaaagccttcacctgatcaagactcagggtatcaggaaattccaaaagaggcaggcctcccaaagtaannnctc

SEQ ID NO: 7366 - DNA, 422 bp, Glycine max
agagcttggttatcaccctttaaaatatctcatattattggcttccaattaatatcagaagttcagaactgtgttcctgagcatgcaagcttctctcttcctatcgacaagtgttgttcacattgccacgcaaggcagttaggattatggaaatcccataagcaacagagcaccgcatctgcaataggattttcaactaccaaacgtaacagttcaataatccttttcgcacaataagggaaagggggtaacagtacgactacgaggttgcgtaataagttatttacttaggcccgctcaagataccgaaccacacccgcaggcacacacagtcacacacaatcacaaacattggaaaaatatgaaggaacaaaatggcaaaacccaaaatctgaatttgccttaaaacaaacatgtagcag

SEQ ID NO: 7367 - DNA, 499 bp, Glycine max
ccagttacccggattaagattccctaaaattatggcattcatgcattcacttgataaataactaataatcaaaaacatgaaactcgaatcaatgtaatattcattcagtgatcgatattcccattcccattcacatgattaggcacaagagtcttgaaatgatgaatcagagccgtgagactgtcgtaagaagaaccaccttcttgaacagctttccaagccttctcctgcatctctttggccttgcttctcattctcttccctttctctccatcatccatcaacctcttcacggcactctctatcctctccccactcaccaccttcttcttcccctcgtacggcgaaatgctccactccgccgcccccacctccaccccgaacccgtgcacctccgttatcagcttctcgttatagtactggtccccgaaacccggcattgtcaccatcggaaccccggagctgatcgcctccgccaccgcgttccacccgcagtgcg

SEQ ID NO: 7368 - DNA, 558 bp, Glycine max
caatagtctccacatgtttggtcccctaggtagaggtgtcaaggtgggccatgagtttgtcaaaacctggttgatctggtcttccggtttaggcagtgggcttcaggcttcatagaactcagctgtttggatgggaagggaaaggcaacaaagggaaaacaagagcatcagaattctaaaaggtacactggtcaggttaagatatcaatctgttatatactactataatgtgaatggcctatattataggaagttgccagataaaatacaaaaataatgaaaactgtaatctacctgcagggacccatcaagttttagtaagcatggtttctcctccgagaagaaccattctgagaagacctgacaatagatactaaatatcagcattgatgagctttatttagaacactctcaacataatcaataatcagtaagagtaacttcctcataacatggatcagtgaagaatataaaataataataatacttggggcataaataacttgattagttacccataggcactagtccttcccaaagaataatttccataagctc

SEQ ID NO: 7369 - DNA, 664 bp, Glycine max
acaccaaaaatgctttattatgctacaaatcatgattaaagatgttaaagcagctaccacacttcatgattattctttcaattcaatgtctgatatgaatcatcagctataattcatttactactattagctataatatagacattccgggtgtaagtaactgtatttaaattacctctccataggaaaaccaagggtgccaaacagatttaatgggaaggttcatcttcttaactgaatacttggttgatgtaataggcacccttccatctgtgtcaccactgtaccaaacaacagatagataatcagaatttgtgaatacatacatctacaaatgttaaggatgtatttggctggagcagtaatcggaaagacaccgaaaaaataattgttaaaagacataggaaaaggataagttaattgcaagtttttacaaatactactatatgaaaggtgaatgaagaatttacctgaaaatccaaaccctgaggctattgttgaggaattcatgtaaaagtggaagaactgttgaagcttgatcaacccactttgttatgacatcgctgcagggttcccagtcatgtttgaggttggttacattggcatggagagcctcttgaacatcttttctattaagatatgcgtacacataattctcactaca

SEQ ID NO: 7370 - DNA, 686 bp, Glycine max
aacaacaacttcttcacttggatagccagtagatgaaaatgagaaatgtgcatacggctgcaacaagggaaagtatgatggtatccattgacttttttctctttattgctgaaagtatgctatttacctgcaacattattaaaaaaaatggtacattaaacaccggaatttcaagtaacatccatgattaataaacataaacttcagaaccaaaaggtggtttcaacattctcataaaatatgaaatccatcatcatatattcatattttatgtataaattaacatccttattctatgcccattttttagcactccttgttcaatctaacaagacatgggacgatgtagatggccaacaggaaatgattaaaacaccaaaatccatgaagagaatcataccgttgggaggcgactgctcacattgccgagctttgaattgataccaccaaatgtcgaacgttggaagacaagtgctcctagtgttgcttgtgcttgtgaaattacattgtccatctgcagcacaacaataggcagaaaaactcaaaataagactcgcccaattgaacattagatacaattttgaaaaatcaaagacttctcaaaaagcagtaagttaaaaagcccctaacccagagaaaaattaggcaatatacaaatcagatgcattgtaatagtgtaatattcc

SEQ ID NO: 7371 - DNA, 675 bp, Glycine max
ggtttgggaccctgaggctgtctcttggtgctgatcttctcacccttggccttggcctcagccttgagctgatcattcttgatcttcctaaggcggaactcctcagtgcaccttgatggcataacatgctccacacgcacgtgaatcctcttccttatgattctgttgccgacctgaatgaaacatcaaaaagtaatttcaataaacaccattcccaaaatcaatgaggcatacacataaaaccctagaaactaaaattaacacacgggcagaatcccaatcgagaaaatgccattaaaatatatatgaaggggtaacaataatgcgcagaaaagataaatcattgcctacaaaacgcacatgaaccttgaaaccgacatcaacagtacaagctaacgaacagcaaaaatcaacaattaagaagatagaatctgaattggaagcgatagtatcacaataaaaaagacataacaaaacagatcgagaagcagaaaagtaaatagagtgttagggttaaggaagagagtgcgagacctgcttgttgacttcgaccccaacagcacgtttggtgacattccagacgcgaccggtgcggccatggtagaacttgtgaggcattcccttgtggacggcgccgttaaccttgacgtcgacataatcgccgacgtggtaggt

SEQ ID NO: 7372 - DNA, 210 bp, Glycine max
cttaggcactaggtggaatgcaattgcaagctcatggtaattgtaagtagtgagctattgttgtcttcacaagaaagtttcaacctttgcaataatttgatattgaagaagcatgcaagttgtatcatctaattgtgagtaaattgtttgatccaattcagtttttgagttccatgaaagtgattttgtttcactcttcagtagccaatg

SEQ ID NO: 7373 - DNA, 280 bp, Glycine max
catctcactacttggctcatggagggtctttgattcatgtcatcttgcacacactgcaaagccaccttaaccaaaacctcaacttgcgaaacttggcattggccttccaagttgggatcaagtatctcctcaatccaaaacccactcgtgggtgcatcgtttatcttgtccgttacccacatcaccaaccgtcgctgctctatgcccctactgttctcaaggctgtgaatttccatagggctccttccagtcaccatttccaacaccacaatcccataac

SEQ ID NO: 7374 - DNA, 1063 bp, Glycine max
  misc_feature (82)..(85): n is a, c, g, or t
  misc_feature (1001)..(1001): n is a, c, g, or t
aaaaattttttttattttgtaagagtcgaatataaatattaaaaatttaaaacatctcatattttgttcaatcaaccccttnnnntgcctttgatacctaactttgagtaagtgctactccgaatcactgtccaagttttccattcctttcaagcctctgctgcgcttttgctgcatatccaagacaaccccaacaacaagttagtctcatataatgcacttagcatgatatgatcaaatactactattgtatatgcttaataaaacaagacatataataatagaataatataccaatttagcccttaaaattataagtattagttaatttagttcctaaaattacctgaaattaccatacatcaataatttgattcttattgttgaaatttcatggactcaaataacgtagtttgacaacctcaagaattaaaattatcatggtttgatggtttgatagacaaaaattattttttttttcaaatttcgagaactaaattgacttctacttacaaattcatgaactaaaatggtgaattgctgaagggacaaaattctatattattcctaatgccccaacattccaagctcaagctgaaaggcaagattaccttcttcactgacttcttctccctaacctcatatctgctctttgtcagttctgatagccacatcccagggaaacagcactgtatatcaataacaataataaaatcataagaaactaatttttcatttgttctggtttataaattagacaagcatatagataatagaattgaaagtgtgaggcaaaagaaacaaattatattttttattttctattgtgtaaattggaagtgtttctagttatagttatacctgtagaattctgtcaacattctttgctctcttctttggtctttgagggatttttgtccccttcatagcgagaaagtcatcttctttctcctttcttgagagagcaatgtagatctttggccactgaattaccccaacantgaccttgtttccattggcagcaagggatgaggtagcaggagcagggcaacacctcctcttt

SEQ ID NO: 7375 - DNA, 710 bp, Glycine max
  misc_feature (705)..(705): n is a, c, g, or t
aatacatactgtagcataagcagtagcacgactcaaaaggcataattttactcaaaagattcatcatcatcgtcaggaaggggctgactagcagctgcaagaagctcggcctcatgtctgcaaaagccacgaataaataaattatttaaagagaacaaatgaaacaaatacgggattttgtggacttcattcaaagaaactaaaacactaatacgccattctaagaaactaaaacaaggttatcattagaaaacagtttgaacttcaaaatgcaactatgaattctacaatctatgtttttatcctgctgtagaaagaattaatttaggtcaaggaagatagcttactgttgctgtgcagctaaatcaattagaacttctggtggagccaatgctggagactccacaaagtgcaagttaggatcactgcaaaatttacacaagtagcaaaacattagttaaaaattagatatttaaatttgattttctctaacctcttatgcagaaacttgtggctttaccctgcaagttttctggccaaatacaggaaaggcttctcaaaattgtagttgcttttagctgaaatctcatagtactgtaaattcttcttcctgtggaaagtaacctgctttgccttcacttgcctgttcttcacatcaaccttgttaccgcaaagaacaattgggatgttctcacagaccctganaagcg

SEQ ID NO: 7376 - DNA, 459 bp, Glycine max
cttcaacgaactagaaggaaccattgctaactctagaccaataagatcatggccaaaaaagaagctatagaacgaaatttccagtttaccaagattagaattttgtgtgaatttaattcttttttattgttccatcaatttttttccttcaaaattttggtacatcttggataaacatttctcttttttgtagatctgaaaaataatgacctagaaagagattttgacttttccacgggtaaaccataaagataaaatcccaagggcaaaaacgcaataggtactgctccacaaagtccagagagttggttagagcgtaccagacttgatattgatcgtgcaacaactcacaatacattcttgagacagttatcacaggggctagatccatacttgcagtcttttctatcaaaagattctccaaaatgtttgagtaaagtttgtctccggcattcagaa

SEQ ID NO: 7377 - DNA, 345 bp, Glycine max
gtgcaaagggtgggtccccagagtcaagattagcggtttacagagtgtgttctaactttgggtgtcgtgggtcgagcattcttgctgcgtttgacgatgccattgcggacggagtggatttgttgtcggtgtcactaggtgcatccactgggtttcgacccgacttgacgtccgatccgatttcgcttggagcattccatgctatggagcatggcatcctcgtcgtctgctctgctgggaacgatggacccagctcctacacccttgtcaacgatgcaccttggattttaactgttgcagcttccaccattgatcgaaattttctatccaacatcgtcttaggtg

SEQ ID NO: 7378 - DNA, 583 bp, Glycine max
ggttgcttacccctataacttgtaaaaaattgtttagttcgaactccaaagattgatggaaaggagttttttcgtcaggccaggtgactttgtttctccatgccgtaataaagtgtgactttctacttaaatttatttaagaaattgagtgaattgatcaaatgcatcacttttcaggagtcgcctttcatatgagcagttcagtgcatttcttgccaacataaaggaattaaatgctcagaagcaaacacgggaggtaaataaatattgaatatttatagtgttggatttggaactgaagctatttccaagtagctaataattgctccacttgttctatgttcttttaggaaactttaagaaaagcagatgagatatttgggtcagataacaaagatctttacttatcttttcaaggattgcttaaccgtaatgcacgctagtactgaaagcagcgttgccgagtattgtatgagttggtatgtaaattgccggttatcatttctgttcttgtttttctgtcaccgtgtttgtgcatctttattttttgaaatgtggaggaagttgcaccctatgttatgag

SEQ ID NO: 7379 - DNA, 413 bp, Glycine max
  misc_feature (56)..(57): n is a, c, g, or t
  misc_feature (59)..(64): n is a, c, g, or t
caatgctatcctcttgagaaaagtgaatgcagcagcagcagcagactagagtgctnncnnnnnntatcctcttgagaaaagtgaatgcagcggcagcagaccagagtgctatatacaattagacacagggtctattaattgaaattgtcttattattaaatatttcgttttatattaattttttaaattttaattaaatttatatatattatatttaagacagatatatttatttgtgattataaatgtgtcactttttcttttagtccatgtattcttctattttttcaatttaactttttatttttatttttaagtcactcttgatcaagaaaacattgttgacataaaactattaacataaaattatgttaacatgtgataacatcatattttactaatataacgtcaca

SEQ ID NO: 7380 - DNA, 370 bp, Glycine max
aggaaagaaactcttacaaaaaataataaagaatcaaactgactgcctcaacacttgactgatattgcattgtacttgatcaatgatctattttatgccacagcaggcatgtctttgagccatgggtccagtggcttaccaattgagtaaactatgaagccaatctcacgcaacttatcagcatccacaatgtttctgccatcaaaaacaaatgctggtttttgcatgttgtcaaatatcttctggtaatcaagagtcttgaactcatcccactcggttagaatgcaaaggccatgcgcatcctttgttgcttcataggcatcccaaacaacactgaccttcttcacagtagtaggacttgtgggctggg

SEQ ID NO: 7381 - DNA, 749 bp, Glycine max
  misc_feature (47)..(48): n is a, c, g, or t
  misc_feature (51)..(51): n is a, c, g, or t
  misc_feature (474)..(474): n is a, c, g, or t
  misc_feature (516)..(516): n is a, c, g, or t
  misc_feature (655)..(655): n is a, c, g, or t
  misc_feature (663)..(663): n is a, c, g, or t
  misc_feature (665)..(665): n is a, c, g, or t
  misc_feature (694)..(694): n is a, c, g, or t
  misc_feature (696)..(696): n is a, c, g, or t
  misc_feature (700)..(700): n is a, c, g, or t
agacaagaaaaaatcatacagcagggtcaataaaataattacccttnnttncaaagagaccaacaataaaaaaggaaagaaaacatacagtagatcaatctaggagggaagaagtggctgtctctcatcatgtccaacacgatgagtggcctggaaaatgcacattaacaacaaaaccttgaggattagttgaaagtataaaaaaaactctcaaatatagaacaatgagataatagatctgcacctcctcatttgctccagctgccatatttataaaggattcctttgacctggaatgaacaaaagccatttgttatcgcaaaggaagaaagaaatgtgttttctttcaaaaactttcttgtcatgttgctataaaaaaaaaataataataagacatgtccaacaactaaaattttcaggaacttccaattaatgaaaggaattatttttccattttcactagaatgagctggnggttggtcaaggaatcaaatatacaatgatcgtgaaaaaganaaaacatgaataatagagttttttggaacccaaaataaagtaaaacccatatcaatgactcagcaaacacaagggaattttttttttagatcagtaaagaaattagcaagtacctttgtttgtcatgaacatcatgcanttccagcncnccattttgttcatcttttacttttgaaangngggnaaagaactgaaaagaaaggaagcatgaatagtgtgatacaaaagatttt

SEQ ID NO: 7382 - DNA, 488 bp, Glycine max
ccaaacctaccccttctcctcctcctccatcaggaaagtgccctaaggacacattgaagctaggggtgtgtgcagatattctaggtcttgttactgttgttgttggctcccctgtctccagcaagtgttgtgcattgcttgaaggtttggctgatttggaggctgcactttgcctttgcactgctattaaggccaatgttcttggaatcaacttgaatgtgcctatcacactcagtgtgctactcagtgcttgccaaaaaactgttccttctggtttccaatgtgcataggcttccatcatgttaggttcattccatcacttgtgtcctcaaattattttgttttagttcttctttgttctatgtgtgacatgtttcattttaataataaggtaaacatatgtttgccttagttagtagtaacattttctcttttctagtaaatttggggaactttgattattattattgtgatttttacttttgagg

SEQ ID NO: 7383 - DNA, 670 bp, Glycine max
ataggaccagtgatagcagaacctacaattaaaaatctcaccaatcaaacactaaacatttcacagaggaaaaaaaatcaacaagatcacactcggatttcacacaaagaccaataatgcggcatgttcaaataaacttctctaacaaaaaaattgagctacgcttcttgtattttcatttatctcctccaaaaatttaaaatgcattatagcttataaaaaatgctaatgcatctagcttcttattttcttctcatgtaagtgcttatataaacaaagttttatctaaacagagcctaattaaaacacttaaacaaacactaaaaaaaatttaaacaaccatattctaattgcaatcattgaaaccaaaaacaccaataagagatattccatacctttcatttcacccttgggattcactatgaccccagcattatctgccaaaacgcaaacaataacaattagaaaacagaaaaaaaaattaacaaagacagagatcaataataaggaaacagaagaaaaagtgaaataccttcgaagtacatgtaaacaccgtcctttcggcgccacggcttgcgctgacggacgatgacggcggggagcacctttttacggagatcaggctttcccttcttgacggtggccataaccatgtcacccacgcaagcag

SEQ ID NO: 7384 - DNA, 622 bp, Glycine max
ctctctctctctctcaataatagtaagcaaattgatgtaatgaacccttctttactaaattcaattataactaatttgcatgttcatgttcatttgcttgaagtttaattaacgatttaaaatgttgaaaaaatatgtaaaaaaatacataataaattatttcagtcactaattttgatttttcttgtaccacatgcagaaataacaaagagaaggatgaaagatgagcaaggaaggtggttcaaactttagtgttcagaagaagggaaacaagtcaattaacgcaccttagagagtgtcctatatgtaatgttagaatttcttaggcaccgaaaagtagctagaaaagtacttcatcatctagctagggaggatgttaggttcgggcattgactttctctaaatgaaggcgaaagtagttccatctcaccttgtattagctatagatataataataactctggatttctcttgatctatctcaatttttgcacagaccttttattattgtgcagaaaacttggagaaactttctttaagtgctttctaatgttgacttctagacttgtactaatttcttcttcttttaatgttccttgtgtgcttgagaaaatcgttaaaa

SEQ ID NO: 7385 - DNA, 485 bp, Glycine max
ctaaactacatataccctgttcttaaaattgatattggaaaactaaaaatgctttttaaacatttgaaagttgaaacaccaaataaatctttcaatacaataactgttgctccagaaccctagttaataatcctagcaactacttcattcgttttccatctttcattaaattgcatttaaaatattgcacgcttggtacacaagtttatttctaaatcaaataaccaagttacgggcacagaaaggaatatcaggcgattggagaggttaggaacccgttattaaagtgacaaaccacggtggaagaacttattacctcgtaaccaacggaaatttagacaaggagttaaggctcagtaatatctcagctgaacattgccaacttaaacaatttgtttcataaaaaaagatgacagtaaacaatttggctcgcttaaaaaaattgtttgatcacctataagctcataaccgactataacgttgaa

SEQ ID NO: 7386 - DNA, 502 bp, Glycine max
tacattacataatttacatacaaaatagaaggtttaataataaaaaaagaaagaaaaataaggagaaaagaaaacagatgacgatatatcataaaataaaaccagaaacttgcttggtttgggtcttttaatttacccaacttgattgaccacgaatcgttgtaatccaattaattaactggatttgaagggaatggctctgattacaacttggtggtaaagagccgcaagagctgcaccaacgaaaggtccaacccagaagatccactgtataacaaaaatgccaagcctcattaacttattaggcttcagaaaattcttaaatttgatacttaagagagagagagagagagagagagattttagttaacatacgtgatcatcccagccaaggtctttgttgaagatgatggcagcaccgagacttcgtgcagggttgataccagttccagtgattgggattgtggccaagtgcaccaagaacacagcgaacccaatgcga

SEQ ID NO: 7387 - DNA, 734 bp, Glycine max
tcaacccagtatttaacaagcatactataaaattgcaccactacaagaacaagagcctgccgatgtcttctggactgcaatctgaatggaatctcaagacaaaattggtggaagtcggcattcacggtaattccgagcatcggatacaagcataattcaaaagcttggagacaaggctatctggttcagggatgagagaaaatgtcacgctgttccagaaatgaaatgtcaacgaattgtgcaggatattttcaagcagcacatcttgttgagctttctcagtctctgtcgtcggtgcaatgaagtatctgtttgcagtttaattcaggtaaggtacacaagcacaaaatgaaggatctgtttgcagtttaattcaggtaaggtacacaagcacaaaaaagagaggcagtgtcactctccaagttagactcgagcaataaagccaaccagtgaaaaatgccaacacatgtatttctaataaaacctacgtcataaatgtattcccgattaattgagacaaatgtaaatttaccttgttatgttctgagaactaacagggaagaagatataagagggttctactttcaactccaagtgcttaacagatttattctcatctcctaaatattttcgagcaaccctcgtcaacagatcagcaccattccctctcaaactggtatcatcatatgtcatgtagaactcttccaaacactcctttacgaacaaactgtgtc

SEQ ID NO: 7388 - DNA, 487 bp, Glycine max
aatatatgcctcgtgctcatacataccttcttgcatatgcatgtatctaaatatttgtgtacataaattagcaaaagaattagttttacaaatcagaaaaggggaaaatgtcaaaaatgggtatctaggctccggcaacttcttgaggttgtttcggcttcgctttgcttttcttagtctttctgactgcaacccctttgtcttccacttcagtttggttttcaatcctagcaaagactggtttaggttgagccatgacttggccacccttaagcccaccccacttggtgtctctctacaatgtaaaacaacttaaatcagagaacagaatagtttacgtgtaagttatgtatatgtaaaaatttatgtgtgtatgtgaggatatgtgtgcgtgcacacatgtgagagagagaggacagacccaggttgctgcatcaaattggtccctggaatagccaagttgtgcatatattctccaactcaagca

SEQ ID NO: 7389 - DNA, 738 bp, Glycine max
  misc_feature (723)..(724): n is a, c, g, or t
tgaggtgaactacggaaactgattgagtaatcatctcaaccctttattggtgaggctacctaacattagtaatgcctaatgccatagttaacaatcaattgttacaatgtgcatgcatatagtacagaatagttgttcactaattgagttttcattttccaaccaaataaagattccttgcaagtatattaggatcagcaattttcaatttatgaattatgatgggtgctctgtgtcagttaaaatttaaaaggttcctaacacgaaaagatagacaaaaaatccaatctatgtaagcaataaacagaatatcaaatggatgattacttctgcaatgaaatctataacaagaagaagaagaagaaacatatactgtaaataaggtgtaaagaagtaatataagaaagactcacttaggggtggagatgatagagaaccactcgagtccatcaggatcagcaatctttgagaccacaaagaaccttggcacaatgaacaaattaacagctttcacggttgtctccaaaaccctacggtgaagattccattggaaccagtcagaaaaaagtcagtgaattcacctgccttgtgagccttggaagtgtccccaaggaacagaataaccaactcagtttcttccttgttgtaccaccacgtcacacaacaccaaaggggagtaacaaggcatcaatcacccttcttgattgcaacaaccttctcttnngagtcagacagcag

SEQ ID NO: 7390 - DNA, 329 bp, Glycine max
ggagagggatatataaaaaaaagtcaacaacaaagaaatttcaagagaaaaggcaaaaaaaccaaaatgctgcttgcatgctcctattgtgcgaacgcctccacttaggacagcacattttccgctcccatttctcatccaagccgagaaacacatcttaaatgaagtatgtattacaccgaagctcctttattactattattttcctaacccaaaatcagaaagatggttacgagttacgatatgataaccaccttaagaaaacaacaaacaccaatgccaatgaaccaatcaagcactaggcttgagtatcttcactgtctcccatg

SEQ ID NO: 7391 - DNA, 264 bp, Glycine max
atgtcctgcaccaagttctgtagaagcaatgtgggcccacaacatttccatggaaattatagactggactctaattggtgtctacaatcaaggaaacattaaggatgatattaaattcaaaatgccgatgtcaacttttttactccctaacagagaacctccttcattacctggttgtttgtactatgttgttagtcatgtgaccgataagcttgtattggtggtagacgatggaagggagaaggatgaacaggaagagaaaat

SEQ ID NO: 7392 - DNA, 502 bp, Glycine max
cgcactaagaacttttcaggttgcctttatatgcataagaatgttcaacattttaagaaaattattttcacatgatgaatatcgagaaccaaatgaaaccattggaattcacatttgttggtgttggagactcagttttgatttggagagtgtatactcataagctcgatgtaacctttttctgaatctcctgaggtctaacatgacattttggctgtcaagatagatcttttttgtgtattcccaccccttcttgttaatgcttgtagggtctctcagaataggatcatttttatcatatttttcatacaaagtgctctctctaggcagaatttgatagccaatgtatttcaagccaagcttccttgcaggttccccataataagtttctgcagcccatgtggtaccaagaggaaccacttgaataaacacagaaccaggtctcaggaacagaaaatgtgtcatagctgctccatgaacaccaatcatgacatcacttgca

SEQ ID NO: 7393 - DNA, 549 bp, Glycine max
cagccgtgtaaaccagctctcagtttataacagaaggtaccggattgtgtttgtttagaacagaataaaaacatgtgccacatcaacctggccataaaatgaggcatccttggactcagactacaataatgagaagaccaactttcaccccgtgcacctgtccttgccaactattaattccagtatccatttgttcaatcaacactactaataacctagtatcctacaacatacgattttgaaattcaccagagccacaaagccaagaacttattacttacatttactctttctagatattagtatcacaccttcattcacaatgtaagacatccaaaataagacaaattttcagaaactattcatcaaaactttctcccatggtaagggaaaaatgcaaaaagtatgtgtttcggggttgcctaatagcaaacagcaatatcattggggaagaaccactactgaacccctagattgcagccatgatgtagctgcttcactggtagccaaaaaccagccagccttattggcagccttatgaaatgaagc

SEQ ID NO: 7394 - DNA, 598 bp, Glycine max
tgaatcttccttcacctcatccgaatcgccctcttcgaaatcgtcgagggaatcagagtcaaaggggtaattgtattcaccatcctcactcctggctgagaaattgccctcactcccctcctcctcagggcaggttttctttgccttcctaacagaaacaaactcggtcaaaatcttcacttttcgaagaccggctttgatcgtcgaaagctcgtctttctcaaccaaggtagtatctcctgactgaaccaaaggcgaagaagccgaagccacaggcactatggatttattatgaactaactctgtactctcttgaaccgctcttaactccaccaaactaatcgatatctacacacaacaaccaaaaccaaccactataaatacacaaaaacaaatcctcaatgttaaatcaaagaacaattatcatagtctcaactaaaacaacatacactgagtgaaggagaagaagactccacagagccaccagaaattgtgagtggaatgttcaaatcaaaatccttttgatcaaccacagatgcaaattcagctagattcaaagtcgcagttccaaccacaggaaccttagtctttgaactta

SEQ ID NO: 7395 - DNA, 185 bp, Glycine max
caccaggtcatgtctttataggtattttttagtgatttatcattaaccaatcaatcagaagttgcttatacttgtacgcgttgaaggatcttctgttgatttgaggaaaaagaaaagccatcacaatgaggctgaaatagtcaatgaactcatcgtaaacgaaagtaaatattttgaatagaaga

SEQ ID NO: 7396 - DNA, 463 bp, Glycine max
tcttcggatttgtattatgactcgtggcggcacgagaccttgccaccacactagaagatttaatgaaaacaaaaggaaaaaaagggtgttagagaggtaaatattttcttctctctcagctttttcttttttcttttttgttcccttctcttgatgaagggaattacagaagaaagattataaagcaggacataggataacaagatgcaaaggaaattgcttctttatatatttatattttaatattttatattattaaggggatgcttctggctagaaacaatttctgctgatggtgcttgaaaaattaatctggacataattttggtaatcctgaaatctatctaacaaccaaggagattgtgtgtgtgtgtgtgtgtgtttttaataaaatatttagttttataaataaaaaataagtactgtattaaaagagtttttgcacttttatttgcttgaatga

SEQ ID NO: 7397 - DNA, 360 bp, Glycine max
tgcaaaaggcaaatatatgtacaagaaactacatgttcctcttaacctgtaacacaacattggagaaaccttctctcctatctttctttctttctatgcatcctctcttcatgaaacacaattgtaccgactttgggaaattatcaaacttcacttattttcatcatcatcttctgtacaggccacctgcttgacagcatatcaagatgacttagcaagcacgtgactcagaaaccggcaaccgcctggtcattggtacactactgccggatacttttaaggatgcaaacagacaagataatcttgcaatcatgggcttagtcttcagcattttaggaactatcgccagttccataccag

SEQ ID NO: 7398 - DNA, 195 bp, Glycine max
tttggcattgtcctcctgggtagtgcctgggcgtcttaagaagtcatttctgtgttagtccagattaaatgaattagacttctaatccacgaaattatatgaactcttagttaacttttcaagtgtcgtttctttggtccccttttctgtaaaacaataatgaagaataaagtgtaaatgatgttcccttttctg

SEQ ID NO: 7399 - DNA, 196 bp, Glycine max
caatgctttttagagttaccacttccccaccaacaaccatattaatgacaattccatctgcacaatagcgagaaatcttagcaacaatgcaaaaataaaaactaacacttacttggacaaaacttcgatacagttcctagggtattgttcatgagaaatcttagcaacaatgcaaaattacaaactaacacttacg

SEQ ID NO: 7400 - DNA, 467 bp, Glycine max
gtttgaatctgactatggctgatcctggtccaagtaccatcaccaatgtgtgtggggctattcgatgcgtagttgttcttgtcactggccgcccagttgtgattaagccatatctacccaaaatcgatgcacttgtagctgcatggcttcctggcaccgaaggtcaaggtgtcgccgacgttctctacggcgactatgagttcactggcaagctggcaagaacatggttcaagacagttgaccagctcccaatgaatgttggtgataaacattatgatcctctatttccatttggatatgggttaactacaaacatcactaaatattgaaagtgaaacctcatgtaacatgtccaagagcacactaccttttttttccacttggagccttgaaattgtctattgatgagtgaattgttaatttatgctttcgtatatgtataactagcatcagaacccttcaaaata

SEQ ID NO: 7401 - DNA, 455 bp, Glycine max
ttatccaaaaccaatgcctatatggctggtaatattctggtcgggtgttggagtgaccattgttacatttttgcttttgtggtcttggcaactccatcgcagtttagggaacaaaaagaggcgataatttcacaattgctgcaagttacaatgctgcattattctttgattgattccttcctcatttttatgggtaacaaaccatagccatacacatggtgtaaatactatcatcaacctcataattaattgtaaatgaatattaatttctcctagcttagtttagtggatcacagtttctttgggcggcaaattatagttccagctggtagagaggtgtacttattattattattatttatggggcttgcttctgaataggtttccaccattggtataaattggccaatttcttcgcctccatcggaatgaatcattctgaaacgtgtatccag

SEQ ID NO: 7402 - DNA, 598 bp, Glycine max
taactctaggatgaagaattacaacattaaatatgttgaattggctgcagttaaaataaaataagcatctaatctactatcggtttgttagtaaatttacaaaatttcaataatcaaacattatattcaggcccacaaaaatcacgaggccagtagtgctggacttgggaagtcacaccaggccatcacttgaaatgtcagctaggccatatcaaaatcgccacaccatccaaccccactttcccaaagtaaaatgtagggcatacgtccatttattttttcttcttcccctgtcacaataccataaagtcagcttcaggaaaatcgcaatgtgacttctgcgaaatcaagataacgatgttattagcaagatatataccgagctcaaatagtcatccatggttaactgcttccgcttcttcagagatggactctcactctgtctaggcatggaacgcttcgatggggtcatgctctgttgttcgccaaacttggttaaagcaacagttgaaataaatgttatttaagtcggatattttaggttaaaatacgaaccttagcagcaattttcttctctttacgagcttgcccaggtaaa

SEQ ID NO: 7403 - DNA, 993 bp, Glycine max
  misc_feature (28)..(28): n is a, c, g, or t
  misc_feature (30)..(32): n is a, c, g, or t
  misc_feature (933)..(936): n is a, c, g, or t
  misc_feature (978)..(978): n is a, c, g, or t
  misc_feature (989)..(990): n is a, c, g, or t
tgcaaagaatgaaaatggagaccatccntnnncaccataaccatagccatagccaccaacaagcggaggtgccactcgaggattgatatagatgttggtcctgttaattgtcataaaattcagaaacaagattcccaagttaattaaatcagttgatatatatgttatatgttcatatgatccatccaattataaaagatatttcatttcttttgatatgcatgatctctggggatactccagggtacgaatatcacatatcagccatagttaaatagaataaattctatctacttttagcagaacaatagactttttttgtatttttatgtggaagccctcaaatgatattaatgtttatggagaagtttatccaaacaagaccttaatctactactagtacaatttgtacatatacaatacaaggtaaaaaggaggggaacccgcgggtacagttccataatctaaacaccaaagaattaacagcgcatgtgcatcgtgtatgattatgtgatatctatctcacgtactgtttttctttttgaatgacaattaataatttcaggctaagttatagggatatgataataaagtaaaaacacagggtgaaagatgaagcacaagtaaagtcaattaacatatataagagcatttattaattgatccttacctggaattgttgattcttggtgcggagcgtggagctgctgacttgaaggcctggccaccaattctaccaccagtcttggcagatgatgcatcatgaactgacccaagtgttagcaccccaacagcaactgcaaccactgctaactttgccaacttgttctcattattttttttcctggtaagaatacaacatacacatcgatcagcaaagtcatgaaaaaaattaattcattgtttgtttgcaattcaaacactaaaaaaaannnnagagagagagagagagagagagccgataaagagtattgatanccggagatgtnngga

SEQ ID NO: 7404 - DNA, 560 bp, Glycine max
ttggtgaacaaaataatgcacataatctacccaaaatttcccaaagagcaacaatgcatgttgcccttcatttccttttcacgccaaaacagcaccatcactacttgctttgtataaatcattagtccacagattagtactgaagaacttctcaacatcccatatcatatacagtcactgtcccaaacaataaatcaaataatcaaacccctacgctgatttagtacaaaaattattccgcaaagcttcctctagtttttggaaaatcaccgagaatgctcctgcatagagaacaacccataactaaataagctatccactagttagcagtggttctgccacttgaacttaaccattgcaattatcaacatatcaactacaggaaccaatgtgtaaggtacaaacaatgacatgtgggggagtcaacgttcatgagttaaaaataaaaacagtaatttccagtaaagtggtcagcaattaatcaaactgattgtttttattttatattgcacaataagcccatattaataatgtttatcatttcatttagccaataagga

SEQ ID NO: 7405 - DNA, 363 bp, Glycine max
ggacaacaatatctacactttgggaaaaataacgctgtacaatgtggctacaactcaatttttggggcttcattaacagatatcggctttgaaacttaaatgcttttcaagcattcgaagtcctcaaggcaataccgccataatgagatataacattacatggttatcaccattgcttttttccctttttctttctcttgctgctactaccaccagcaccagcactggcaccggcgctactactgccaggacttttcattccatttccagatttgggagatgggctctctgttgcagtgctactaaaattgtcaaatgcacccgcatgtactgcattctgtaaccactcaaataatctcatgc

SEQ ID NO: 7406 - DNA, 291 bp, Glycine max
gtcgaccaagctatatggcatccatgtccaaggccatgaccccagaaatcaagaagcatgcatgtgacaagaaagacggtgtttcgtatcattatgatcccacagcttgcgccgaaggagatgattataacgggaatataaattatgtttttgcatatatggaaggtgatgacgatgatgatggtggttatgattatgctcccgcagcataaattgggtttgctgagtagtcacctagtatatacaaagtaacaaaatgtctactccaaactttaattttggggttcctag

SEQ ID NO: 7407 - DNA, 268 bp, Glycine max
ttaaataaagttcaccaaagaatgtgctaaagttggttttgtctgctatggagcaaaataatggcagatgcaagaagtcagtgttgctggcaatttagattttgtttctgaagaaggaatttaaaaaatgaaaattcagatcaatggagtctgtctcatctaatatgcttttctttcataagaccttagccttgaagtataattgttaacccatttctctgctttctgttatcagttagcaccaccatgttatgcacctccaattgta

SEQ ID NO: 7408 - DNA, 362 bp, Glycine max
tagaccttccagaggggcttgatccccatgttgcatcaatcatcgatgactgctggcgaaggttcttctataaatacacacacttaagttttaatatgatagagattgccctctaagttctaactcaattttacttgtgttaaatgtgagcagtgatccagagcaacgcccatcatttgaggagctgatacagagaacgttgttccttgtcaacagagtaacagcagtgtcaattaggagaatttcagaatcctaagcttgttatggttttgggttttgctttctcaaaatatattagttaaaaacatattatgagaagcacaagcaacaaattgagtggcaaaccgcaaaacattcttact

SEQ ID NO: 7409 - DNA, 458 bp, Glycine max
catattctaagaatcgaaccaaagatggaatcaacaaattcttaattcataaccaattaaattggaaattgaattatgagtgaaccagataaggtaataaaaatcaatcagataaaacatgataacttacaatagaggaagagtgggtgcgcttgtgataagtcagatattgagcatttccaaacaaccacagtaaagtagtaatattttttcgcaaaaaaaaatattgttgtaacatttgaggaagagaatattttttttaaaaaaagattgactcagacttactccgattacagccgtaaaattaaacccttttacactcttcctcttccaaaatccaaatgtcaatacgaataggatgtgtttcaattacataggcatatgtattcataggcacttttacatcctattcgtattgacccttttacactcttcctcttcccttaggccctcaaaaa

SEQ ID NO: 7410 - DNA, 553 bp, Glycine max
ccaatagcagcgtcaacaagacaccttatgctggcctctgaaattctggtccgcgacttttatgtaccactatcccccgtcacaaatactggccatggtgagtgttcgtaaacattaaattaaggtctcaggttcctatgccagtaggtaaaaagtgaagttatatctcttatgattttctcagcggaatcacataattggatccatatttaatatttttgtaaattgtaacatctcttgtttcttgtttattcaaccattgactgagacatggtttgaacgagttgataatgctgggttcattacctgatgcacaggaatggtttaaatactttggcaatatagaatgtgcatgacaatcactccatctttcacgagtataatttgttcagtagttctaagagaagaacagcagctgagtctttggccttcttgacacttggcattggctctccaacacattcatctgtccatcctttatcagtagtattgacacgcactgcaaatgtaaacctctttgcatgtgctggaccaccctcattcacacacctaa

SEQ ID NO: 7411 - DNA, 611 bp, Glycine max
atactcagacatttactggcaagaagcagtccacaactcaagtttttgtcaaatcttatcaaaatgggagaccaaacagcaaactcttaacagcaggaaaggtagtagaggcacaaagctagaaacctactgtcacaaaggacaatttgtgcataaatgacggtttttgaaagaaaaaaaaataccgtatctattggtaggcaaggaagatgattcatggattattgcgtttggtgctccatcatccctgcacaggcaattacataatacttgattgataaagcagactcaaaccaagttacaattaagcactgccagaggaatgttaaagtaatatctattgcattaaagaacccaccagtatccttttacaagaagggggtgaaacatctggaggatgatgccattggctcgtctgcagaactcttacgatttatggaaagcaacgactgcttgaaggaagtaaggaacggtaacatgtgtcatcttctgttgaatcttatagacccttgaattgtacgagcagggataagccaaaactgcctaaagcaaatgaacctgcattctccaagaggcagtcaacaagacccaatatgtccatctttctccac

SEQ ID NO: 7412 - DNA, 739 bp, Glycine max
  misc_feature (57)..(60): n is a, c, g, or t
  misc_feature (62)..(62): n is a, c, g, or t
  misc_feature (655)..(658): n is a, c, g, or t
  misc_feature (664)..(668): n is a, c, g, or t
  misc_feature (671)..(675): n is a, c, g, or t
  misc_feature (685)..(685): n is a, c, g, or t
  misc_feature (688)..(695): n is a, c, g, or t
  misc_feature (697)..(697): n is a, c, g, or t
  misc_feature (700)..(707): n is a, c, g, or t
  misc_feature (719)..(720): n is a, c, g, or t
  misc_feature (722)..(722): n is a, c, g, or t
  misc_feature (724)..(724): n is a, c, g, or t
cacaaggtgtagaagtacaatttggctgttggcaaaggctcatgttattgtgaatgnnnntngctatcatcaactcataagccactggtctgaactctctctttctgatcattaattacaaacaattttaatatatgcatgaagtgattctcaatctttatatttttcacatggggttactgtaggttgaatactcatgccgtgattgagccatttgtcatagcaacaaacaggaatctcagtattcttcaccctatttataaacttctatttcctcactatcgtgacacaatgaatatcaatgcacttgctcgacaatcacttattaatgctgatggctttatagagaaaacctttttgggtggaaagtatgctgtggagatatcttcgtcaggttacaaaaattgggttttcctcgaccaagcattacctgctgatctcatcaagaggtaaccctatatgaacatgaaccgtgtaaataaatttatatctgacacaaccctacttcatgcaagagttctatgaacttaagcatgaaaaatgcaatggcttagttaattatcttattttaaactttcaatttttttttttttaaaaatgaaaaccacaaggactagtttgcaggcaactcgagttttgatcttattaaggcatnnnnaaattnnnnntcnnnnnaaaaaaaaanaannnnnnnncnaannnnnnnntttgaaaaaacnnananagaaatttctcttta

SEQ ID NO: 7413 - DNA, 626 bp, Glycine max
  misc_feature (608)..(608): n is a, c, g, or t
aatatccgaatgttagtcctacgagaaatctatcaagagtacacaccaaaacactcttgcaatcttaactttccttcccactatataaccactgcagaaaattgatgatcatcatatcatataatacatgacaactatcaatttcttggcacaaaactgcatcacatcttggaaggttctgatgctaagtttattcagaaatcaaattccaaacacgaacacaaccatcctctcctgaactgaccactctttcctgatcaataaaaaccaacccgtatactccacctatatgagcaccctttatggttctgcggcttgatgctggctttccaacttcatatataatgacacatgtatcaagggaaccagtggctacgagtgtgctatcaggtgaccaagctaggcagttaatacgtgcggtgttaaacaacatgttattaagcttcacctgaaagagaaaattttcagtcaaatgccagctcatgatcaaagcaagaatttatttagtcaaaacaactagtaagcatttcagtagctatcatccgagaagcacacgaacttcaagaaatgagccgcgtctgtgttggaaactgcgttggtaatacaangtttgttgtgttcgtgtc

SEQ ID NO: 7414 - DNA, 583 bp, Glycine max
  misc_feature (365)..(370): n is a, c, g, or t
  misc_feature (372)..(372): n is a, c, g, or t
  misc_feature (374)..(376): n is a, c, g, or t
  misc_feature (383)..(384): n is a, c, g, or t
  misc_feature (387)..(388): n is a, c, g, or t
  misc_feature (390)..(394): n is a, c, g, or t
  misc_feature (396)..(411): n is a, c, g, or t
  misc_feature (420)..(438): n is a, c, g, or t
  misc_feature (445)..(455): n is a, c, g, or t
  misc_feature (463)..(470): n is a, c, g, or t
  misc_feature (475)..(487): n is a, c, g, or t
  misc_feature (500)..(504): n is a, c, g, or t
  misc_feature (507)..(513): n is a, c, g, or t
  misc_feature (515)..(519): n is a, c, g, or t
  misc_feature (523)..(525): n is a, c, g, or t
  misc_feature (528)..(537): n is a, c, g, or t
  misc_feature (540)..(542): n is a, c, g, or t
  misc_feature (544)..(552): n is a, c, g, or t
  misc_feature (554)..(556): n is a, c, g, or t
  misc_feature (558)..(560): n is a, c, g, or t
  misc_feature (564)..(565): n is a, c, g, or t
  misc_feature (567)..(576): n is a, c, g, or t
atttgcacaacctgtgcaaccccttcttctatttccttcctgatgactccatcaggcatatcaaatgtccttcttttgaagtagagcgatgctgatcttccaccaggctggggatctaccacatcaagcattgcttccagctcatccaccattgacctcttcgcagatcttaccataatatcagatccctaggaaacaggaaatgagcaactctgttagaaaaaccaataaatggtggtattctgttcctttatggtgttaggcaactgtcaagtatttctccttactctgactggtatgcagttccttcccgtttctttggctagtaaaacatgactaaatagataaagtataaatgcccaacnnnnnncncnnnccccccnnatnntnnnnncnnnnnnnnnnnnnnnnttcttcctnnnnnnnnnnnnnnnnnnncctatannnnnnnnnnnctttaaannnnnnnnacccnnnnnnnnnnnnnccccctctctttnnnnntcnnnnnnntnnnnntcannncannnnnnnnnntcnnntnnnnnnnnntnnnannnccannannnnnnnnnntcatccc

SEQ ID NO: 7415 - DNA, 376 bp, Glycine max
atactctttctagttttgacgcaacacatcacatgtgtggcgaaaaaattattgcaaatgaattaacggatatgaagaatgcttcactcttcactccttggctgctcgtgccatgttttccaacatctggagaaaaatctcactccatgtgtctataggtcctggcaaacaccaatgaacacaatcactctgcacacgctttggaaccccattagcgaatggaaaaggattcatataagcaccaggatgaccatctggtcttaacaaagctaattttgttacatccattacctccatcctaaaccctctaaagtttttggctttagccttagcattttccacttcttccaactcaatccttctgatctcaacggaa

SEQ ID NO: 7416 - DNA, 485 bp, Glycine max
gggcatcctggcttgacaatggttcgaacctgaaattataagaaaaaatttcatgaaaactaccatgtcttaaaaaatgttatgcctgataccaactatagaaacaacatgtggatcaagagttaacttattactcaagaactaggtcctaattccaacatgccagaaaaggtgccaatgatcattaatataaaaactaattatttagcacacaatgaggacgaccagtcactggatttgaagtcttgcacaagagacattgcattaaatttgaatttctcactcaccattgaataagaaaaatatgccctaaactctagtgctgttaaaataacaaggttaattggcaagacctgttcaaggtactcctgaagtttcttaatgcggcccatgtagtcctggtcttcaacagaaagagttataaccttggcatctgcgccgggaccatcaaactgaagtggacctggatttctgtagatgtcatc

SEQ ID NO: 7417 - DNA, 391 bp, Glycine max
ctcttttgtctgaccctgtattccgccctctcgttgataaatatgcagcggtatgtgtattctcttaatttttcgcataacattgattttttgaatgttgaacatttagtgatgtttgatttgctaatgatttcaggacgaagatgccttctttgctgattacgctgaggctcaccaaaagctttccgagcttgggtaagtattgatatttcatacattttaatttataactatgattttatgaagcttttctcttagttttacttgacacgttttacgtcgttaattgggttctgattcgtgtcatgaatatgttacctcaggtttgctgatgcctaagcaacgtttaggggattgttgaagaggcatggtgcccataatatttatatat

SEQ ID NO: 7418 - DNA, 382 bp, Glycine max
actctccgaaaactcaaggaaatcaacaagggacaaagggtgagaggcgtgggcgagctcaaaagctacctaaaaaaatttggctacctaacaacaaatgacaattcttcaaacaacaaccacttcgacaaaaacgttgagtttgctctcaaagaataccaagtgttccatcacttacgtcccacgggtcgtgtggatgccgaaaccatcaaaagaatgggcctcccacgttgtggtgtgcctgatattatcaccccccaaaaccataagcttaaggggttggtgattcttgcaaactatagcttcttctcgggttcaccaaaatgggaagagtctaaaagggcactaacctacacattcgtatcaagtgctaacgtgttga

SEQ ID NO: 7419 - DNA, 344 bp, Glycine max
gcttttgttgacctttgtatagtatgtttgagcatgatgttgttcttggtaatattagggataaacactgttgttggctttgttatcttttcctactatttctatttttaaacattttatttcatccttgtttctagatatgattattttctgagtaaattttggtaatgtttaaaggtattgcttttgggaagtgtaggacatagtgcatgtttgaataaccattctgaacatacttatgggatgtgtaggacgtagtgcatgtttgaatatcggtcctaaatgtaacttttgggttctgaacacacttctggaaaataacatatgtgaatgtatttttgaaa

SEQ ID NO: 7420 - DNA, 763 bp, Glycine max
  misc_feature (542)..(544): n is a, c, g, or t
  misc_feature (550)..(550): n is a, c, g, or t
  misc_feature (553)..(559): n is a, c, g, or t
  misc_feature (561)..(562): n is a, c, g, or t
  misc_feature (570)..(583): n is a, c, g, or t
  misc_feature (585)..(614): n is a, c, g, or t
  misc_feature (617)..(632): n is a, c, g, or t
  misc_feature (638)..(640): n is a, c, g, or t
  misc_feature (644)..(649): n is a, c, g, or t
  misc_feature (652)..(657): n is a, c, g, or t
  misc_feature (663)..(668): n is a, c, g, or t
  misc_feature (672)..(675): n is a, c, g, or t
  misc_feature (678)..(678): n is a, c, g, or t
  misc_feature (681)..(681): n is a, c, g, or t
  misc_feature (683)..(683): n is a, c, g, or t
  misc_feature (685)..(685): n is a, c, g, or t
  misc_feature (703)..(705): n is a, c, g, or t
  misc_feature (709)..(736): n is a, c, g, or t
  misc_feature (742)..(752): n is a, c, g, or t
aagatactcacaaccatgctcccttccaaacaacaaaagaacacaacctatgaggacttctcttcctagcccatcctccaatgtgaaattcagtgcaggcttaatgcaaggtgtaattcagctaaagccacattctgctcattcaactcctagtcctttccaggaattatcagtgtcttctctttcatacatcaagaaacaaaagggtgttgaaataatgggaccctcttgctctaatcgatcaatagatgacggcacacttctattgaactacaaacagtgttccttcaataagaaattgatgaatgggtatttttcttttggagcacagggccttgctgttgaagattccaatagctgcgcaaagtcaaacagcagctacaaacgtttaagttccatagttgcctaacggttgtgatcaattagagcaagagggtcccattatttcaacacccttttgtttcttgatgtatgaaagagaagacactgataattcctggaaaggactaggagttgaatgagcagaatgtggctttagctgnnntactcnttnnnnnnngnntgttctgnnnnnnnnnnnnnncnnnnnnnnnnnnnnnnnnnnnnnnnnnnnnccnnnnnnnnnnnnnnnntttttnnncccnnnnnnacnnnnnncccccnnnnnnttcnnnnccncantnancctgccccttttcccccnnncccnnnnnnnnnnnnnnnnnnnnnnnnnnnntttccnnnnnnnnnnncccccttcctc

SEQ ID NO: 7421 - DNA, 622 bp, Glycine max
  misc_feature (324)..(324): n is a, c, g, or t
  misc_feature (326)..(326): n is a, c, g, or t
  misc_feature (350)..(352): n is a, c, g, or t
  misc_feature (359)..(365): n is a, c, g, or t
  misc_feature (374)..(376): n is a, c, g, or t
  misc_feature (393)..(398): n is a, c, g, or t
  misc_feature (414)..(415): n is a, c, g, or t
  misc_feature (417)..(422): n is a, c, g, or t
  misc_feature (446)..(452): n is a, c, g, or t
  misc_feature (456)..(463): n is a, c, g, or t
  misc_feature (465)..(468): n is a, c, g, or t
  misc_feature (473)..(477): n is a, c, g, or t
  misc_feature (487)..(489): n is a, c, g, or t
  misc_feature (498)..(498): n is a, c, g, or t
  misc_feature (515)..(521): n is a, c, g, or t
  misc_feature (524)..(531): n is a, c, g, or t
  misc_feature (556)..(559): n is a, c, g, or t
  misc_feature (572)..(574): n is a, c, g, or t
  misc_feature (602)..(611): n is a, c, g, or t
  misc_feature (614)..(616): n is a, c, g, or t
gtacttctggtatcaaaactcctcaaacggtaactgaaacccttgatagcaattcccttgtgccatcgcccatcgcagtccattctaaacccacttcatcgaataattctagaaaccttgtttccttactttctcagtcatttcttattttctttgtcagacttctattatccatattctcttctcctagtggaagattcatgcgcactctagcatgcatactcagacatattcgaatactttcaatgtgtgtttatcttatcatagatttttgacaaactcgcagtcatcttatttccatacccttctgtatatgacacaaananaaacgatttgtgtaatgttggacnnnatcgatnnnnnnnggaagtgannntagttaaacatttttgnnnnnnggtgaccagattatgnntnnnnnntggaaaggcttggtttcccttctnnnnnnngggnnnnnnnngnnnnttcannnnnctaagacagnnnggtatttcntggttgtttccggttgnnnnnnnaannnnnnnnaagattcttttgtggaggggaaaannnnccttttatttaannngctaaaaagggaaaggtcttttttgggnnnnnnnnnngtnnntttttt

SEQ ID NO: 7422 - DNA, 470 bp, Glycine max
  misc_feature (396)..(398): n is a, c, g, or t
  misc_feature (400)..(400): n is a, c, g, or t
  misc_feature (452)..(462): n is a, c, g, or t
actctctcagctgatcgaagatctccgtcacggcggcgaaaacactccacctccctcccattcttgattgagctatctctttctttcaaatcgttacagtgtatgtctcttccaaatttccccctaacatttttgtaactagcgttgattctcaactctttagcttgttctaagtgcaccaaacaacacagtattgcagcttccttatattattaccgttatgaattatctctattagagagaatcaggtaaaagctcccttgccttagtcatagtttgatacggttgtttgcttaatgcttcaactactttgcttgctaatgttggttttcaattttcatggaatcacttagtgaatgtttggtttgaagttaatatttctgcgacgctcattcnnnanagaatgggagggaggtggagtgttttcgccgccgtgacggagatcttcgatnnnnnnnnnnnaattcttt

SEQ ID NO: 7423 - DNA, 372 bp, Glycine max
tctaaagaaaagaatcattgggttagcattgctaggcatagaatgataactcactgcccatgcatttaagcaacatctagaacttaatcttaatgcattttaattattgaatcttcgcaaaggcatttgggagataggtagttaaaataggcttgccaacgtgaggcatcaggggcaagtagtcaacagatgtgggtagaactaacaccatttcattgataatgaatatcatacttacatgcatcgtaggccaattgggtttgtctggtcttggcatttctatcaattgttttcccttttacttatttgttttagtaatagcactctttactattcctactttcattgctactttactactttcctcccgca

SEQ ID NO: 7424 - DNA, 521 bp, Glycine max
tatgtgaggagcttccttctgatggtattctccttgtgtatttgtcagcttcaggttagatatcctctattaactaggaacgtaagcatgtacatgtatagggttatgatacttcttatgtcaactaaattcctttaggtaaagataaaatgtgtattttctacatcaaatgcaggatattgtggttctgcacagaatgaatctggctgcatacactttggtccacgtggagatagaggtacgtcttgaagagaattttcgtgtacttccattcttgtaccgcatgatatgtataatgtcaagaaacaatttgtgtcctttttcccacaaatttgccacatgcaattgaaaatgcctcagattgtagtgtatgaatctaacatgtacaagccagtagtatgctttatcctatgattctataagacataatgagtgtgatatcatgagcgtgaataacaaaatttagtatgggtaaattctccaacagataacaagtttaagggaagggagaatgaggtaaa

SEQ ID NO: 7425 - DNA, 721 bp, Glycine max
gttagtcccacctcaccaacattcagcttggtctcctcaaacccttttgccttcaaggaacatgctttgccctccagcggttcgccaatgtggactccggctcagagtggaacatgctctcctgctgttccaccgggttcttatcagaatgctgacattcctatgtctgatgccgtttcggatgaatttgcatttggaagcaacgtgttggggcttgtcaagccttgggaaggagaaaggatccatgaggaatttggatcagatgatcttgaactcacacttggtaactcaaagaccaggtactccagcattattacatgatcaattgaatttcttcactgatagtgtaaaggattttattactattaaccaatcagaaattgtcatatgtggtttttttaatctttcttaaaagtcatacttagcataatttgttagtagttgacagtctaaaaacctttacattgtcgccgtagagtagtagacatggtaatcgggcgggatggagaccgatttagtctccccgtacacttatcatgcctagtgtagagaaattcaactcttttctttaaaatatttttctcccccttttgacatgatcttttttacttcttggcagatgaagtcacaaatatgaattgaatgtgataatgtaaacattgacttttgttggttttgatcagtagatatgttagaaggtaagtgaggtggtgagtgcaag

SEQ ID NO: 7426 - DNA, 546 bp, Glycine max
  misc_feature (377)..(379): n is a, c, g, or t
  misc_feature (381)..(381): n is a, c, g, or t
  misc_feature (453)..(453): n is a, c, g, or t
  misc_feature (534)..(536): n is a, c, g, or t
ctgaggagggctgtataatttcctcaaattacagacacaaatagggaattaaattaagcccatacacactttagactaaataaatagacacatgttgccgaagcccatggtcatttggatccaagagcaaatgacaattttggtcgggatttgtttttacccaacaactttatttggtttagacgttcttgctcctcctcgtgtttcttccttcgcatggcttcttccttctgtctttgcatctcttctagctctttatatctttcttcctcccttctttgctgctctaaagcttcccttctctgagcttcttcaaccttcctccggttctcctcaagcatcctttcaagatcttctttctctttacgggcttgagnnnanagaagctgaagaaggatcagaagactgataaaaaggctcatataaagcaagctttaaagcaggaaaaaaggnatgaagagctatataagaagctaaaacagatggaaaaacccatggaaaagaccatgcaaaagaagaaacacgaggagcagnnngaacgtctaa

SEQ ID NO: 7427 - DNA, 730 bp, Glycine max
  misc_feature (671)..(674): n is a, c, g, or t
  misc_feature (709)..(718): n is a, c, g, or t
ggttaaggtttaactttcaaccataatttatagaaacactcatttttcttttagttttcatatgtaacgaggaattaaggtcttacattgctttggaagtatctgatacaatggaatcctattttttttttctttttcctccttcttttgtttaaagaaaaagcttcattaatttatactaaaataacttattcttgtttttccccctaaatttcaattttgaaaaaaaatataagctgttttgcactttgcaggttccaggaaatttgatcatctctgctagatcagatgcccattcctttgatgcttctcaaatgaacatgtcacatttcataaacaacttgtcttttggaaagaaagtgacacctagggccatgagtgatgtgaagctcttgataccatacataggcagcagccatgacaggctcaatggccggtcattcaccaatactcatgatttaggtgccaatgttactgtaagttcaatattgtatatgaaaaacttataatttagtgttaattttactatttgacttttgttagttggtatctaattaaatgtttgattgtataatgggaaatatccagtggttgtatgtgttgtctgtcgatctccttttgcaagagtgagatgctacagatagcaaggatgcccaggacctcatgaagtnnnntgctttgcttttcttccaaatgtcttatagtcctnnnnnnnnnncatgtttctgca

SEQ ID NO: 7428 - DNA, 1252 bp, Glycine max
  misc_feature (63)..(67): n is a, c, g, or t
  misc_feature (964)..(966): n is a, c, g, or t
  misc_feature (973)..(973): n is a, c, g, or t
  misc_feature (978)..(978): n is a, c, g, or t
  misc_feature (1048)..(1048): n is a, c, g, or t
  misc_feature (1233)..(1238): n is a, c, g, or t
  misc_feature (1242)..(1242): n is a, c, g, or t
  misc_feature (1244)..(1245): n is a, c, g, or t
atgagcttgcttcaggttttcttcttttctttaaaattataattatactgagcttttatgacnnnnntttgaactttggaaatactgtttgtctttgttttattgcttgcttgtcgagtcataattattacgcttctcgtttgaagctctcaacataaccatggcctcttgtttatttatttatttatttatttttgtttagccctttgtgtttggttatgacgaaattgtatgttttggattttggagcgaatgggaaggatcagtgtgtgtggtaggtggcgtaccttaccctacttgtttgtacttctatttttcacttttaaataaaaaacgaaggtgactaataaatgtattatgagtttatgactagtatgccactatacatatgattattgtaaggcttagatcctcgaaatataatttaaagcatgtgagttgtgacatctccttccttccttttcccttctctccccatatttaaatgtttcaagtctaagtgtgtgtgtgtgtggagggggggtggggtttagtgcttctgctctttccgttgcgaaattcacaacaaggggacactctatcttccctttccttctgtctgtagcattctctgggggcattgggaaaagtggatgttatgagtcccgcgcttgtgtcacgaggctctctcgcctgtttgagttgtgcttactgcttagtcataacattggagctgcagaaagtttgtgtgtgaagtcttttatttcctgaattctgaattaagatattgattctctgttttctgtgctaacttctgtaagctcactttttcttgtttatgtcttcacaggagaaaggttctaatgaaattgttttcaaagcaatggggagagctattaacaaaaccgtgacaattgtggagttgatcaaggtttgtttgcttctgcggttagcttggctgacctttatcttagtattttgtttnnnttgaggnggatnttattttaacgtttatttcttggggttaatgcagaggaggattgtgggcctccaccagaatacagcaatnggatccactgatatcactgatacttgggagcccctagaggaaggcctccttccgtaagagcagttttatgatctatgctttcttttatttgttcaatcttcttcatttcccccttctttttctctggggccctgaagaactatagggcattttcttacagttttatgtagacttttagtattcannnnnnctgncnngcactaa

SEQ ID NO: 7429 - DNA, 380 bp, Glycine max
  misc_feature (61)..(64): n is a, c, g, or t
  misc_feature (351)..(351): n is a, c, g, or t
  misc_feature (375)..(375): n is a, c, g, or t
atctgggtcgttacatttcaccccatcaccattttctgcagatgctgcttcccacatgacnnnnactgtgcctcccatggcaatggcttgaatcatttcgccattggttgattagatttacatgaaagtttgattcttttcattctttccctcaaaacccaccaacacattgccacgtcactttctttggattggtgggttttttccttcacgttttgtggttgcttgaggggcttgttgtagactacgtattttttttttttaaaaaaaaaaaaattaaaaactgaaccccccctttcaggggggtttagggggcccctttttttgttggggggggggagagtttggttnatttccttgtgattcttttgattngtgga

SEQ ID NO: 7430 - DNA, 665 bp, Glycine max
aaagttagtaatcaaagcaaaactgaatattcattctgtgctgcatatcttagtcccactgagaatgtagcccccaaatgagctcatttgcatgcatgggtgagttctagatggaagtacctgccatatatatatatatatgaataaattgttaaagggggtctgtattttgtaccataaaaaaaattgatatgaataacataaataatgtaaccaaaggacttcataaaactttctctagtttcataatattgaaaggaatgacacaaacttatacctggtattcacgcagccaaggctctgttatttgcaatccaatagccattttctcaagctgtaaattgtgcatgcaagttgcaagaggctgcattttattcaatgaacaaacaaggaagattctgttaacaatcttattaatcaattgacattgtttaatcaattgtcaaaaagcagcactccgcttctttaaatatgcataaggatttgattaatgtaagtcagaaaacaagtgacttcttaaaaattgttagtattcaaagtctatctttgatatgttcctaaggttatataaacaaagctacccagataaaacagtattacattcccaacataaaagaattaaaagaaactaaaccaattaattgataatattatcatgcacggat

SEQ ID NO: 7431 - DNA, 397 bp, Glycine max
tctctctctctctctgtctctgtgtttttgttgtgttctctttactacctcttgaaaccaaaagggtcactctctgtgctgtggcctctgttttcaaaggaaacccttgttcttttccttgcctttctttcttagcactgtcttccaactcccaactcatataatttcattttccctagtcttttttgttttcactctttccttgtgaaatctgcaaaaccagctattcagtttagttatcaaaccaagccgaagctcttacattatttttatatataagtaggcaccaaatacacatttatgatacaccaatttgaagcttgtccacacaatacaagattatcaccatcccctttccattcacaaacctaagagtaagaagcacttgtcaggaacc

SEQ ID NO: 7432 - DNA, 410 bp, Glycine max
ggtcacgaacttttgttccaattggcccagagatggattctgtgagaagaaataaacatatgtttggaaacaagttagatgacatacagctctcaagtttgtcttattctaccagtagcactccttcaaattctggttccatgcctgatgcttcaaattctgatgcaactaattcttcattgcttgtggatatgtcaaattctgtttcagaaccatacgacttgaccctcattgacttggatgtatccagttaccctgaagaagttcctgcggctgataaagctggtggtaggtgacaatgaggaatgttcagagctatttttaatgggaaaaatgttatcgcttgaggagattagagggagaggggcatcaaacatactttctgtgcttggaatgaactatgattgtgg

SEQ ID NO: 7433 - DNA, 391 bp, Glycine max
ttaggactcgctaaaatagcatcaaaatccttccactgctcattcaactgtgctctcaagaaggccacaaccaaccctcccacagtccttctcatcaagtccctaggacccttcttcccattcttgcacatacactttgacatcattgtcccaattacccctggtgtttcatcatccaacatgtccatgtgaccataatccgttgcaacaaaatatgcactaggtggtttgcactcagagaaaaactctttatggttcaccccatttggagcacatggtggaaaaagagaattagccttctctgggcccaacccagttccaattacagcaacaggtatgttcagattaaaggaccgtggcacacctgtgaggatatcaggaaagtgatcga

SEQ ID NO: 7434 - DNA, 694 bp, Glycine max
  misc_feature (671)..(676): n is a, c, g, or t
tgatgcttaaattgctgatcttggactcgctcgggcatttactgtgccaattaagaaatatacacacgaggtagataaaaaagaaaagaaaagtgagatatatagcacccttttgttttcctctgccttcgttaataatgcctttgtattttcagatattaaccctgtggtatagagctcctgaagtcctcttgggtgctacccattactcaatggcagtggacatatggtccgttggctgcatatttggtaaggataaacatcttgtttaaccaatcgctatttcatgtttgttacatgtgtttaataatgaatgtcatttgtgtctcaattgcagccgaacttgtcaccaaacaagctctctttgctggtgattccgagctgcaacaactcctgcatatattcaggtatatgtgtgtgtatgtattgtgtgtgtgtgtgtgtcacttgtttagtttgcttttgtttataattgtactaccctgattgtttatgcaggctattaggtactccaaatgaagaggtgtggccaggggtgagtaaactaaaggactggcatgaatacccccaatggaaccctaaaagtctgtcaacggctgttccaggtttggatgagcttggacttgatttgctatccgtaagttgctgctctttaactaactctttctaannnnnnctcctgttgattttttgt

SEQ ID NO: 7435 - DNA, 374 bp, Glycine max
gatcgggagatattacaacaaaatttgttaactatagtgatcagttggcagatatcttcacctagtctctaaggggaccaagaattggttatatttataacaagcttgacgcttatgctccagcttgagggggaatgtagagaatcagtattgatattctgcattcattgtaataaatatagtttataggcacataatcactgatttagaggaaatcaaatatcctccatttatttgcaataagtgcaataagcctctgttctttctcctttaacaagaccaatcaaagtccacaataatgttaatggttgatttctcctcacctacttttgcagcttgttcgagagacagctattcaatgtcttgttgccttg

SEQ ID NO: 7436 - DNA, 371 bp, Glycine max
tattctaaaaggagtgatgcatttaatgtgagttaaaaaatatgtgaagtaaaactgtaaaagtgaaacggtgagttttgttaaaattcatcctaaccattaattttaatccaacaattattatttatttaaattgagattcttcagttttttataaattgaggagatctgctcccccaattcctcgcagcaggtatgttccaacactactccaaaaccacaagccaatgctgctcaagctcaacacaatgctgctcagaacaatgattcgacctacaataactacaatggaggtaatcgtttcctcaacaatggccgtggaggtggccaccatttctttcgcggtggtcgcaatggtggtcgtggctatg

SEQ ID NO: 7437 - DNA, 457 bp, Glycine max
cttcttagtctcgcttctctctctctctcgggcgaagaactcttttgaggatcagaacccctcaatcccttccttttcccctcaaattccacacctccttctccttcaagtcttcgacctcaaccatccgcgccttctctgacgcgaggaggacgaagaagacgatgaagaagaagaccaagatccactgaatgtttcaggcgaatgccgagggagatttcgacgagcttgtagatccactgaaggtggaggacaagatcggtgttgtgcctcatggcctttcaaccaattcagatgttgtcaagagatgtgcgttgtttgatttccctttttccttttatgaatttattaattattttgacactttttcgttaaagggtatcattttctagttttggttgcgggaaaaatttgcaaatggaagaaatgaaggttgatttagacttgttggtgggtg

SEQ ID NO: 7438 - DNA, 660 bp, Glycine max
ttcgcgttttcttctctcttcgcctcgtacgttccaatttctatgactctgcctccatttaacatttgatttattgtttttccgataatttacttgtttcgtgctccgctcaaatgaaattaactcatccgtcgattttattttttttctgtttgtttcgcttatcatatcgaataatttagtcgttgaattatatgctggtgttggagtgaagataccgtcaaaattttatatcagctttggacttgtttttaattttgtcattccgaaagacatttttgtttcctgtttatatgttaaattacgagggagatttttttggtttttcctgttagtcagagtaatccatcatcatattagtttgtgtttgtctatggatgcttaggttaaagacaataataatcttgtgacattgtgtgtttggtgtagctaccctgcacttactgttaacttatgcaggccatcaaatttgattttgtgcaattaacccctagtatgtttggatggaggaaattgcatgggaaagggaaagggaaagggaggttagtttttcatttttgattttaaagaattattaaatgtttgttttaaacagaagaatgtggggtgattggaaggttacatgataatctcactattttaacaaatataaattataaa

SEQ ID NO: 7439 - DNA, 407 bp, Glycine max
  misc_feature (66)..(66): n is a, c, g, or t
  misc_feature (355)..(357): n is a, c, g, or t
  misc_feature (375)..(376): n is a, c, g, or t
  misc_feature (379)..(379): n is a, c, g, or t
  misc_feature (381)..(381): n is a, c, g, or t
  misc_feature (384)..(385): n is a, c, g, or t
  misc_feature (393)..(394): n is a, c, g, or t
  misc_feature (398)..(398): n is a, c, g, or t
gcgttgctttcggggtcctgcccgtgggcaccatcgaaccgggttcaatttttgcccaatttcgancacctgaacatgatcgccggccaccggtggcgggaggctccggtgggggttcaggagcggtacaagtgggaccgcggcgggtcggacgatacctcgtcccggaagatccgggccgaggcgaattgcccacgttgcaccaaagacatgaaccttgttttctccaatcgccactttcccaccccatcaattgaatctgaattgggtggtggagaaagagaaaagggttaccaatcggtgaacctttgcccttgttgcaaaactgcttattactttcacccttatgactctnnncctttgcaattgcaaatnngcngntanntaagggtnntccnttttctttt

SEQ ID NO: 7440 - DNA, 406 bp, Glycine max
aagaagaatcagctctcctcctctcccgcagcaagcgttcttcttccacattcacttattgcattctcctcttgatcgcttccatgttcctcctcgccgtctacttctcctcctcagcaaccgccaagctccaccaccccgtggtgatcctcatttcctccgacggcttccgtttcgggtaccagttcaaggcccccactccgaacatccgccgtctgatccaagacggcaccgaggccgagagcggcctcatccctgtcttccccaccctcaccttccccaaccactactccatcgtcaccggcctctaccctccccaccacggcatcgtcaacaacgtcttcttcgaccccctcaccggccaacaattcaccatgcaaagccaaaagagatggagacattctca

SEQ ID NO: 7441 - DNA, 340 bp, Glycine max
tgcagcactcaagcacaagaatcctgttggatgggaaatgggaagagatgtcaagcaagttggcacaaaaaatggcctaaggcttatagtttgaaaaatgtgtatagaacatgccaaactaatcatatagagaccaaatcgtattttgtttttatctgaatttaatttggtttcagtgaccaagcttttacaccattagtgaatttgatacactattgtttactatagcataaaaagttttataggattgtccatagttgcagaattctctcactgtattggtttctctttaaagaaagtcttctcattataatgtaaaaattgatgaacagcatgccta

SEQ ID NO: 7442 - DNA, 734 bp, Glycine max
cattccttggatcatggaaaacttgtccctgaggatattatttttgggctactatcgaagagattggaggatggatactcgagaggcgaaactgggttcattcttgatggattccctcgaacaaggattcaagctgtaagttgtttcatttcatctttcaaaatcatgactcgaactgctcataattttttcaattttattcactcaaaaaatgtcgtgatgtttctcaggagattcttgaccacattgctcatgttgatctggtggtgaatttcaaatgttcagaagaggagttaatgaaaaagaatctaggaactcgaaaatttaatgcttaccaagaatatattcttatgactagctccaggtcaacaaaacaattgcaggatgatcatgaccaaagtcatgcagaggaggtgactatatattctctctctctctttcttatttccattttagcatgtgtttggtttagttaaaaaaagattattttgctggaaaaaaaaatgtgcttagagtatgctggtttgagataaactttattcgcctttgtttgtttctagagtgtagtagtcactctgtgccttattatgtgtactaattttttgagggggtatctgtctcttgtagtgcaagctgttggaagattactacaggaagcagaagaagcttcttaactttgaagtagcaggtgggcatggagaaacctggaagggacttctggcagcactacatct

SEQ ID NO: 7443 - DNA, 643 bp, Glycine max
catttattgcattttgtatgttacgtttcaagtttgtatatgtattctaaatgtaaaacaaatcaattcataagtatgccattttagtgtgaagttagaaatttaatctttaagtgcatgtttggatgtctgttgtaaaaatatctccacttttccttttgtattttgtttgagttgaactattggatttgattttgaaattcgtgcacatcaacttagatggcaaaccaaacatgctctaagtatgtataaaaaaatatatgataggaattccgaaggaattagttgctagctgtcggtcaggaatatatggggaccccaagtattatatatatttgtgttttatataatctttgatttgaggttgagagattgagtttcatattaacatagggaaaggttgcagtttggttaatttaacattttcaagtgtgcagggaggcatggttgaggccttaagcatttacaagaagtggaaatgctacagcttggactacgaaggatctcggaagctggttttcagcttgagagaacccaattcttgtttggttaagaacaatgcaatcagaatcttcactaggaacagaggccgtgactttaagatcagtggctgtttcccggataagtgttgtagcattgttga

SEQ ID NO: 7444 - DNA, 482 bp, Glycine max
tcgccatcacggaaaaacaacattgtgcgtgttaagttccatgaattactcagaagcacactgaaataccaatgaacgtaattttgggttaatgtcatgttcggcttcacctttaaaaaaattgggttcaaattaatgttgaattgaagtaactttggatagctttcacattagaacaaagattttatattgaattttacttttaactagcttttagaataaaaacattcggtcataaatcaaatcatttcaaaatcaattttattaacaccagtccaaacacactcattgcagattcattgccgttgctagcatgggcaacaccaaacgcaacccaaaagacttgaaattcttctttagggggaatttcattacatattcagataggtaaatcagttataaaacatgaaaacacaagtctacctcttcaagggcatgtttgtcgccatcatcactgaaatcctcatcactgcccacctctg

SEQ ID NO: 7445 - DNA, 375 bp, Glycine max
atgatcatagagtgccccatgctagtgacaaacataataatcaatttgtaatacaaggagatagctgtaagaaaacacgtcttgaattacatggtatcagaaatagtgattatgtgaatagctacggtactcagggtaaagaggaattgtacttagaaaatatgattcaaaaagaaagaatgctggaaaaggattcatggtctcacacacctgaaggtgtgttttcttcatgtggtagtgactcaagcaaagaagccaaaaggctaacatcagatgacacgggcatgcccgatcactgcttcaagagcagtaatttagattctggtggttgtgagctctgtgaagatgatattatcttgggagacaagtgtgtgg

SEQ ID NO: 7446 - DNA, 317 bp, Glycine max
ataccttcagaattgattatcattatcgtcatctcttttatcttcaatcagcaattaggtaaatattttattatatataataagtttatgttaatttgttatacaagttaatagtttttaattcattttcttttaacttacaaacttgatatatatacaggaatggcgcaaatgttaaaggatattatgtatggtctttgattgataattttgagtggtcttcgggctatacatcgcgatttggaatgatcttcgtggattacaaaaatgatttgaagagataccaaaaattgtctgcactatggttcaaggattaa

SEQ ID NO: 7447 - DNA, 623 bp, Glycine max
ttaagaaaatgcttttgtttctcctcagatggcagaggacccgtcaatcccaaaggattacagtactacaacaatctcatcaacgaacttatcagcaatggttaaacttaattaaatacgagtttcttaattagcttacaaaattaatcatgcctcgtattcactccaaataaaaaaactgatatatttccctatttccgtggagcaggaatccaaccacatgccacgctacacaactttgatcttccacaggtacttgaagatgaatatggaggatggattagtcgtgacatcatgtgtgttcctgatctcttgtactataattcattaatttttgttactggaagaatttgaaacctcgacctatctctccctctcttcatcctttaactagtaaaccttatatctcctatactaaaattaattcatgaaaatcccctgcaccgcatattgaaattgtagctatcctaacaaatgggtgtgcatgcgttaacttttgcctagcaaacaagctccttatattattaaatcatgcacaaaatcgagaaatactaatggataaattacttggatataaatgcagaagagacttcacatactacgcagaagtatgttttagagag

SEQ ID NO: 7448 - DNA, 565 bp, Glycine max
ttttggcaagattgatatgcaactcaagcttgtacccggaaattctgcaggcactgtcactgcctattaggtaagtatagtaacagtatacaattgtattgtactcaagattaatgtatcatgtttatacatgcctcaattaatgtcaatgctactaaactttgatatttcacagcatgaattgtattaatcaatccatggtggttcatatgtatgtttcagcttctcagtggatgggaccccaataagagaattcaagaacatggaatcgaaaagagtttcattcccaaaggagcagccaatgaggatatactcaagcctatggaatgctgatgactgggcaacaagaggtggcattgtgaagactgattggagccaagctccattcacagcatcatataggaacttcaatgccaatgcctgtgtccattctggagcatcatcttgtacttccaactctgcctcctccaatgcctggttcaaccaacagttggattcaacaagccaagacagactgagttgggtgcagaagaattacatgatttacaattactgcactgacacc

SEQ ID NO: 7449 - DNA, 699 bp, Glycine max
  misc_feature (450)..(453): n is a, c, g, or t
ctctcactgtgtggaaggagctagagaaggaaaacaaggaattcttcgagccttacatgaagtcgaaagctaaagacgacagaatgtctcaggaagagacaaaccagataatacagaagatgatgtcagagttagattcctctaaagatgactaaacagccattgaaaacgatatgacctttgtgttttggtactttagtccttcaaagtctcatgcaacaactggcccaaaggcactgatatccctacgctatactactatatatctctactctcttgtcactcgtcactcctcactgtacaactatcgtacatggtgtctctacttacatggatggatgtgttatatatatatatgctatgcttttctaattacctatatatacctaactagagttcttgtgcatatgctatatggctaggttatccacgacctagcaaataacacannnncgatccatgtaagtagagagaccatgtgcgatagttgtacagtgaggagtgacgagtgacaagagagtagagatatatagtagtatagcgtagggatatcagtgcctttgggcgagttgttgcatgagactttgaaggactgaagtaccaaaacacaaaggtcatatcgttttcaatggctgtttagtcatctttagaggaatctaactctgacctcatcttctgtattatctggtttgtctcttc

SEQ ID NO: 7450 - DNA, 438 bp, Glycine max
tacgaagaacacactggagtttgagagtcagagatgatcggtcacctaggcaaaaatcatgcgagtttgagctgccactccaaatattacagatagcagaaagtacagatttgaagcagtttcgagctgctgatgaattttctgatgaggaggcatccccatgaagatttttttgtctttgctgaagaagtaatggtctcttttttccatccttttccgtttaaagcaaaactggggaggggtttggtgcagagttgtgcctcgtttccattatacagcatcctagttgttgtttattaataggaaacacggatatatacttgtaatgctactactacaaggcagatttagtgagaccatttttagatgctgatagataaacgattgtggcacaaatgttggaaatagcatttttcattcaggtcttgtgacttgtga

SEQ ID NO: 7451 - DNA, 628 bp, Glycine max
cggggcagtgaagagttttgggaagtggccaagctacatgaccgtgaattatcttttccagtggtaatttcttttattccttatttttaaaacacttaatattgagaaaaaaatattaaactgaaataatcttcgaattaattaaaatgtttattattctattaagtttcatgcaaaaatatatttataaatggaatattcttttatctgtcttgttagagattattggttaaacttcataagtccagttgtatagtgtttactagtaaataaattgtccgtaaattaattctatgataatgtttaaagatgatggttgcttgcacaaactttattttggtttttaacagttgaaattgtgattttaattcattagctctgaactcaactgaggttactacaaagaaaagaagctcttattttttactaatatagtaaatgaagcaaaatgattaatgattgtatactaatcaccttagttaatattcgttgagttgcaggagttacttgatgaccgatacttacagtcatgggacttagaaggctggtgcaagattcacacaaagagaccagagtttcttgagcagatcccgaaatcgctgtttgatttgatagacaagtgtctaac

SEQ ID NO: 7452 - DNA, 504 bp, Glycine max
tgttaactcttccatgcatgtttctgaggtgcaaacaactcttacaacttcatcatctgggggtagtttgccagcttctggtgtaccatctactgttagcattcaacctccagcactaaatactactcctgagagtgcaaggagaccaaacacttctgagatttccttccctgagtccttcaaatcaaagttttctgctgcttcagccaggtaaacatgttagcacttggattgttgtatgctccagctattatccattaatgctaatatatccgaaaatattgcaacagatataaggaatcaatttcaaaaagtacgcttggtcttaaagagaagttacttgctcataatgtctcggttaaagagctgagtaaaggtgttcagcgcgagatgaatgcaggcattgctggagttgcacggatgattgaacgccttgatcttagctcaaaacggtccagtgctcctctcattgctgtccatagtgtggctacttcagacttacct

SEQ ID NO: 7453 - DNA, 480 bp, Glycine max
agcagcgaatgagggtttatctcagcctcgcagcatgtaaagagatcttccatcaaatgaatcgcgtcaccaaggtttgttttctcttccatttattgccatagacttcgcatcaaatttgtgtccatttcggtccttagtttagttattcaactatctgtctatttcctttcttagactattgacgaaggaaggctcaatatgaaggcgcattgccctatagtaactgatgtaggcttgaagactaaggccacgagaattctcatgtgttataatcctatttggctgcggattggattgtatataatttttggtggtgactccttggtgttgaatggtgatgttgattctgatcaggatgttgtgttcttgaaaatggtcattgacaagctatttttttcacatgagggtttagctaaagagtatgcttataataagatggttgaaagtgtatataggtcgggttactatgagaatttg

SEQ ID NO: 7454 - DNA, 399 bp, Glycine max
ctcatgaaattgcaggatggaaggataagttacgacgaattttctactatgatgaaggctggcacagattggagaaaagcatcaagacagtactcacgagagaggtttgccagtctcagccttacgttgatgagggacgggtcattgcatttaaacaatgaaaaacaatgacggtagatgactactttagaaatgtcaatttttactttggaaaggaaaatttgataaagaagtctattttttaattttaacttttctcttaattgtaattcttttcccgaataccccatttttgggtgaaaaaggataggatattggccccagcagtgttgtttgtgatttgaagtatgtatttttttggtttgttgaggttgtgttaggagacaggagattaatgga

SEQ ID NO: 7455 - DNA, 384 bp, Glycine max
acttgtacaacctcacagaggaaatcaacagagttcatctcagggtatttccacttcagaagaccttcatgtgtgcgagggacatatggatcatcccaaccctgatagaatccaacattattaacaacaaacgagtacataaaccaaacagcatatatgaatatttgtaaatgggatgttctcagccagtaagtattctctataaaccaaaaaattacatccttatttagatttctcaatcgtcaatattgactcaatacaatgaaaaacaagaactgagaaatttggactgttccctagtagagcatcaattcagtacatcatcctcaaagaactggtgtttcctacaagccaagtgttcattgatccaactatcctctacat

SEQ ID NO: 7456 - DNA, 318 bp, Glycine max
tgttcgttgtcatttagctgtgagtttatctaactttccttttatgtctttgtttctttctttacctcaagatctttttgtggggtaaattatccagatagatcaatatcttaattactggtaatcttcttgaggcttgtgagttatattttgttggtgggagtgcactaattacaccaatgacacgaaacttatggttattcttaccatcccagggggtgggatagaagagtaattgtatagggtttatcgtacacatgtacattatagttcctattgtttggtgttttatgctttcaaacttccagggttgcttaa

SEQ ID NO: 7457 - DNA, 763 bp, Glycine max
  misc_feature (689)..(693): n is a, c, g, or t
  misc_feature (698)..(699): n is a, c, g, or t
  misc_feature (755)..(757): n is a, c, g, or t
gcacaaccacaacaagaaaaccctcctttgccaaaagttctgtcaggtagctgcaaattgcaaattaaatgaagaaaactcatcatgccatcaaacattcttatggacttgaacctatatcaacctcaaaaactagcttgtggagtcaatgtagaatctcccactcacacacttgaagtcgaagacttttttttatcaacaaatattagttgttaattgttagtattttgttagcggagaatcaaacccacaactttcccccctccgttctctttttagcactcaatcaaccttataactcccttcaagtcgaagactagacatctcagacatgaaatttgcaagactggacatttgcagtggttccataacatgtggcttgataggcccaacaactacagtctacagctaagatagcctatgctaaccatcttaaaatttgcccgtgacaaactgaacccaaaaagtagctcatggagtaagggttgcccccacctccaacaaacattaccaacatgggaaaaaaaaacagctattaatgataaagattcaaactttgcatggaaaaaacgaaagggtaacagaaaaaaaaatacccataagtaacttcaggaacagcaccaatgaaggcaccacccaggaatttgactatagctcgaggcttggcacgatttggggtaggtggtatnnnnnaaggnnaatccaacttggtgtacatcttgctattgactctgaaacttgtgactccaccaacnnnactcag

SEQ ID NO: 7458 - DNA, 397 bp, Glycine max
gcacacggtaccctgttctatgcgtcaagtctctgttggcctacgcaagcgtgattcgccgaagcgaccgacaactagccacgaccgctctgtcggtaagcatatcgaggagccgatcctccgcatggttggtgaagaagatgttgaaagcgagaggcatgaagcctagagaatacagagcggtgcaagactgcgtggagaacattggtgacagcgtggaccgtctcaggcaatcggttacggagttggggcggacgggcgaggacttcgtctggcacatgagcaacgtccagacttgggtcagcgctgccctcaccgacgacagcacttgtgctgcttccgccttccgccatcaacagaaacttcaagactgctataaaggacaggattgtccacg

SEQ ID NO: 7459 - DNA, 376 bp, Glycine max
cagtttgcttggcttttgctgcaaatggtgacgatagtgatgttactatatatgggaacgtgcagcagaaaacaatagaggttgtgtatgatgttggtggtggaagaattgggtttggtgctggtggctgcaagtgattaagattaaacatatgctttgggctagttagagaaaaatcaatcttaattggctctaggctttcataattattgttgttccttttattgcaaagtgtacgtaacagtggcaatagaaaaaaaaggaaaacaaaaatgtgggaattaaatataatataatttgtagcatgaagaagaatggaggggtgaatatatgactctcaagccgtgcgattgcttgccattgtccatatgtaaga

SEQ ID NO: 7460 - DNA, 332 bp, Glycine max
  misc_feature (56)..(56): n is a, c, g, or t
  misc_feature (60)..(60): n is a, c, g, or t
  misc_feature (64)..(64): n is a, c, g, or t
tagtgagtatattttttgttgtccatgttatagtacaaatgtacaatacttggagngttnattntaatttacatttgaatgcagtggctatatgtcccctgaatatgcaatgcaaggactgttttcagagaaatcagatgtctttagttttggtgttttggtaatagagattgttagtggaagaaggaactcaagattttacgacgacgacaatgctcttagccttttaggatttgtaagtttcaacaatttatttctgagtctctgactcttctacaggaacttttgccttatgctgctgaatgatacaactttcaaacgttaactttttt

SEQ ID NO: 7461 - DNA, 853 bp, Glycine max
  misc_feature (156)..(160): n is a, c, g, or t
  misc_feature (575)..(579): n is a, c, g, or t
  misc_feature (634)..(638): n is a, c, g, or t
  misc_feature (718)..(718): n is a, c, g, or t
  misc_feature (741)..(756): n is a, c, g, or t
  misc_feature (763)..(771): n is a, c, g, or t
  misc_feature (773)..(775): n is a, c, g, or t
  misc_feature (783)..(788): n is a, c, g, or t
  misc_feature (791)..(796): n is a, c, g, or t
  misc_feature (803)..(805): n is a, c, g, or t
  misc_feature (810)..(823): n is a, c, g, or t
  misc_feature (825)..(839): n is a, c, g, or t
  misc_feature (841)..(843): n is a, c, g, or t
  misc_feature (845)..(850): n is a, c, g, or t
acaagaagcatcataaggctcaatcagattcagagtatcaatcaagtgaaggagaaatgagaagaaggaaggatcgcattgaggaccaaaaatacagggaacgatcacccaatcaccatcagagacaaagaaatggcaacggctacaaagaagatnnnnntgacaagaagcatcataaggctcaatcagattcagagtatcagtcaagtgaaggagaaatgagaagaaggaaggatcgctatgaggacaaaaaatacagggaaagatcacccagtcaccaacagagacaaagaaatggcaaagactacaaagaagatgctggtgacagaaattataacaggtccaggtcagaaaggagtgtccaaaagggtcaattggattcagggtatgaatcaagtgaaggagaaaagagaaggaagaattactatgaaggcaaaaaatgcagggaaagatcacccaatcaccaacagagacaaagaaatggcagagactacaaagaagacactggtgacagaaattataacacttctaagtcagaaagatatgcttcagaaggttggtccaatatagatgcnnnnnaaggcactggtgaggacaaaaagtacagggaaagatcacccgaacaccaacatannnnnaagaaatagcagagactacaaagaagacactggtgacagaaattataacacttctaagtcagaaagatatgcttcataangttggtccaatatagatgccaannnnnnnnnnnnnnnnaatgccnnnnnnnnncnnntaaaaaannnnnnaannnnnngcaaaannnaatcnnnnnnnnnnnnnntnnnnnnnnnnnnnnnannntnnnnnnttt

SEQ ID NO: 7462 - DNA, 654 bp, Glycine max
  misc_feature (57)..(62): n is a, c, g, or t
  misc_feature (568)..(568): n is a, c, g, or t
  misc_feature (570)..(570): n is a, c, g, or t
  misc_feature (599)..(601): n is a, c, g, or t
  misc_feature (603)..(603): n is a, c, g, or t
  misc_feature (609)..(609): n is a, c, g, or t
  misc_feature (621)..(622): n is a, c, g, or t
  misc_feature (650)..(650): n is a, c, g, or t
atttccgaccaagaagctcatcgacgaccccaatggtgcgtgccctctcctctcccnnnnnncccccttcgctccgttcaattcctcgctctctgtctaattcccctgcaatcctcgccttctttgacttttgccgtcgacaattgctgcgttctgaatgctttcgccgcggttccctgcggaatcgcgttctggatttttttttaactgtttgtgctctgtgcattttgttgacttttttgtttcgctttgtaaaatctgtttgaacctttaaatgttttagcattaggctttgactgaatcgcaccgtgctttaaatgacggaaatcgctgctcgagttcgtaatatttgatgtgaaatgttgtagaattgattgcgatgatttcctgttcatctagctgttttagttcgaagattacgattcaatgtgagagttaagattccgatttatatttttttatgtttttattttccttagtagcactgcagttaggattatgtttattatttttttcttagagagattttgcaataacgaaacaatttacaatatgtttttaagcattnantatttattcatgtatctatgtatataacnnngnaacaantgtctccaaagnngattttttatttttcttttaaatttgantgca

SEQ ID NO: 7463 - DNA, 776 bp, Glycine max
gactctgctccacttgctacttcctctagaagaagcctttttcaaatctctctgccaccggacccgttttcttctgttcatttgggtttctctcttccaatttatggcttctttgagacctaccctctctcaactttccctttcccaatccaattttctcagaaaatctacatggaacaatcatctaccttgctatttacacaaaaggatcgcaaagttgcaaacttttaccacttctaagtcttccactttcagggtttgctgtagttctcaagagaccaataacaaaaacaatggcaagtttgttttgtttttaattttcattcctcatttagtgagaattattgttttagtaagaattattgttaatttgaagtaatacataagattagtaaaatttctgaactctatttgatgattcgtattcgtgatatgcactctgtttccttattagattactaaaacttcatatttcttttcacttttttatcgtgtcttcaactagtgtatgatgagtttttgtgctttcagcatgttcatttgtgtggcgtttcatgtgttgattggcaagaaaagctgtatgttattatgttttggcaagataaagtagatattgtggtgaaggagttcagattataatctacaaccgattaaagaggacatcaagtgactagctttgcactttttggcttcatgttgcttctgttgtgttttcaggtgaagagcctccagagtcattatttatgaaggaattaaagaggagaggtagaccccta

SEQ ID NO: 7464 - DNA, 395 bp, Glycine max
tgttattgttatttcttgttacttcggatgtcttcaattttcatttgctgttaagatgcattctgttgaattttgaaagttgaacagctaatgattcaaggttttgggtccttttggatttggaaggtgatatatatgttattcctgatttatctgtgatgctgactgattaactgtgatgcattaaacgcaattgttttccactttcatctcataactgttgattgtgtttgatcaggatggagtctcaggtgaagcatgctcttgttgtcaaagttatgggtcgtactggatccagaggacaggtgactcaggttagagtgaagtttttggatgatcagaaccgtcatatcatgaggaatgttaaaggaccagtgagagaaggagacattctc

SEQ ID NO: 7465 - DNA, 430 bp, Glycine max
taattcagagccacatcaagctcacgaggcagctcaattatggagcatggctaaacaattgggcgttacaggaggagatgagaatgatgctatcattgaaaaaattaaactaatggaagaaagggataagacagaatatgagagatgggagtaaagtgggcagcaattagaagaatgataaagaaggagggtgcagacatgatatgcttacaagagacaaagaaagaagctgttgacaaagctatgtgtcaggcattatggggggatgtggaggtttgttgggagatgttgccagctaataatatagtaggaggtgtattatgtctatggagtgaaacaactttcaggctacagagtaaactaattggcaatggattcattcacttggctggggagtggattaaagaggcacaacacatcaatttagtta

SEQ ID NO: 7466 - DNA, 682 bp, Glycine max
  misc_feature (35)..(35): n is a, c, g, or t
  misc_feature (37)..(38): n is a, c, g, or t
aggttgctgagggagctagactttgtggagcaacntnnttataggtgtggatatcaactcagaaaaatatgaaatcggtaatgcattgtttgtttaataatatcacaccaagcagtcagtcaaataaatttgttttgatgttgttattgtgctcaaagcctcaaattatgtaattgaattcttgggattgttcctctgctttactcaggaaagaagtttggaatcacggattttgttcattctggagaatgtgaaaacaaatctgtgagccaggtctaccctcttctaggttccaatatttacttaatttagttgcctcaagtacttaaattttcttctcatatgcggttgtggagcaggttatcatagagatgactgatggaggagcagattattgttttgaatgtgttggtaatgcatcattgatgcatgaggcatatgcttcttgtagaaaggtctgtctctcaaagtgtgcccaaactaatagctttcttttgtgctaagtaatttgaaatttcaagtacatcatgaaaatgaagtttcccatcaaatagaggcagacttgattgcaatttcctttaaagtgtgtttggatggagaaatttaaaattctgagaaattttaaattctaataatttcaaatacttcaattaaaattcttttattttcaaaattttgtgtt

SEQ ID NO: 7467 - DNA, 409 bp, Glycine max
agcggctcatgatggaaatctcgcgtttcacgttggaggttaaacctgacgagttcagcttttttttgcttatgactttaacggcaacgctatggccagtctcggtgttgcgcgcgtggtaaaccttcgcgaacgcgccgcatcctaggagccttccgacctcgtattttccaaacagggcggtgttggtgttgttctccgccgccgcgtgttcggtttctggcattggtttttcagcggagaccatgctctcacgagagagcacgatcggtttgggaaattgagggttaatgtgggtttgggctttaattttgttattgggggttggtggaagcgaagatagtaacgaaatttggatggattggttttaaggaaaggaggttttggtttttctttgctggctttgttg

SEQ ID NO: 7468 - DNA, 650 bp, Glycine max
tccaaaagttgaggttcatttgttgattttaactcactggagaagcttgattcattttacctatctatttgtctaagtgtatggaaaagtttattcaaacagtgcatgaatcccagactaaattatcttccttcataaactcctcccttggtgtttaagtttttcattcttttatttgttctttttaatctttcagagtctcaagggaaaagagtgacaaggagatcatgagagagatacaagcgattatgaggcagattgcttcaagtatcacttatttgccatgcctggatgaaccttgtaaggaccatgtgttttgccaatgatcattatgatcatgagaaagagttgtcattccctgagcatctcgtctctttctgcttttcatcttatttatttaacgtttattttatctcccagctaagcatatctatcttgtgtcaggtgtttttgatgtgttagcctatactgacaaagatgtggcagttccattcacatgggttgagagtgatccaaaactgattgcaaatccgcaaatggtgaaattgcattcctttgatactaaggtgaatttggacttgtaatttttagttaatttatctaactcggcatactttgtttaatttagctaatactaatatttctgtttt

SEQ ID NO: 7469 - DNA, 383 bp, Glycine max
tagaaatttacgtaggggatcgctacaatagctggaagcatgcgtacattggcattattggagcattgggtggcattgctgtctttttggaagctttcacatggatcattgtcttcaagaggaggaagtcagagaacaaaattccacacggagcaaatggtgttaatggctacggttctaggccacaacaggtgtaggatatgaatatatgacgtgtagccagatagatatattggtttcttttgtaattttatgcatttttactcctatacgtgtgcattttattgttgctctcctttgtataatgttgagggtatttaatttaaggatactccagctgctcagagtctcagttttgaggcaattctttcttagggaagtga

SEQ ID NO: 7470 - DNA, 375 bp, Glycine max
agtgttgtgcattgcttgaaggtttggctgatttggaggctgcactttgcctttgcactgctattaaggccaatgttcttggaatcaacttgaatgtgcctatcacactcagtgtgctactcagtgcttgccaaaaaactgttccttctggtttccaatgtgcataggcttccatcatgttaggttcattccatcacttgtgtcctcaaattattttgttttagttcttctttgttctatgtgtgacatgtttcattttaataataaggtaaacatatgtttgccttagttagtagtaacattttctcttttctagtaaatttggggaacttagattattattattgtgatttttacttttggggtatattggag

SEQ ID NO: 7471 - DNA, 400 bp, Glycine max
tatataaatatcacggcaatgtcaaattatgatcttcctccaccggctactccttcggaaccaacggtcccccaatggacaccacctttgccaacaacatatccaccaccaacgtcttatttttcatcaacatttgatgattcatcttcatcttcttccacatccacctttggcatcatcatcggagtcttggttggggtctttggacttattttgttgtacggcatttggcacaagtatcttaagaagagatgctcaaagtaattaatcatcttctagatatatatgttgagtattaattatttcatttcaacaacataaaagtttcgtttctttggttgtgtgtaggcgtgaaaattgatgttcacgtaattaatgcttgttcctgttgagtcatgaa

SEQ ID NO: 7472 - DNA, 436 bp, Glycine max
gtgtttcctttcagtgtggtgaagggagaagggaagggggagaggtcccgaattcaaatccccctactaacaaaaactaacaatattaacgactaacacactaaactaacaatgtgtgtagtgaatctgaaaatctttattgtatcatggttccttggcctggcctctctaacaaacaagtgtgggtcttgttgtgctagttattgtctacctgttgtaatttaaacaagctttcgtcgcatcgtaactgaagcaaagcagagtggatgagatttctttcttgtatctgattttccgaactatccatgatcctatttttaatgaaattttatcatgtgaatgagaacatttgtttagtggtgctcaacttccaagtatgtatttgaatacatgtttggcttttgggctatagacaatgtcctttcttgaatggtgt

SEQ ID NO: 7473 - DNA, 361 bp, Glycine max
  misc_feature (61)..(63): n is a, c, g, or t
actattcctattccgatttataagcctatatcaaaatcaattcccattattaagcctgttnnnaagataattcccattattaaaccaattccaattattaaacctgtaccaaaaccaattcccattattaagcctgtcccaaaaccatttatagtgaaaaagcctatccctgttgagtcggaggaatttctaaaaccaaagcctttcttcaaaaagcctattcctaaactaccacttcaccctaaattcaagaaaccaattctaccaccattgccaattcacaagccaattccaactccataagaggataatactctatatctcgagctaaatatatatccgttccatttctaatgccagc

SEQ ID NO: 7474 - DNA, 762 bp, Glycine max
gtagttcatttcactccctcaacatgtgttattggtttttggcatgaggcttttaagccaagtttttgtgatgatacttactgttctgggtttagctgatattgtagttaacttgtgcatttaaatatcttgtttgaacacaggaatgtgaaattaaagtaataggaaagcacaataaaggatgtcactgcaagaaatcaggctgccttaagaagtattgtgagtgcttccaagccaatatcctctgctctgaaaattgtaaatgcatggactgcaagaattttgaaggaagtgatgaaagaatagcaatatttcacaaagattacaatctagttcacatgaaacaggcagctaatgctaccattagtggagctgttggatcatctggctatggaacccatataacacccaagaagagaaaaaatcaggaaatgtttcctggaaagtcagccatggatcaaactgttaacatgactgctcaatacctacaggtgctttctttgcattcttggatttatataaataataattatctattctttatgcggcaggttcattataattggattggaaaatgaaaatgtgtatccaagtatccaacaaaaaacaatatctttgtcttgtaattatcacatcacataagtcaacatttgaatcctagttttatcctttgaaacccttgattttcatcttattttcctgttggtttggttatcagttccctccatcctcggacatccaaacttcatataatttttaaat

SEQ ID NO: 7475 - DNA, 438 bp, Glycine max
tcttccaactcgaccctccactcacccaccactcccaacaccaccttcgtccaagccaacccttccaacttccgcgccgtcgtccagaagctcaccggcgcctccgatgacccctccgcccataaactccccctcactctccccacgcgcctcgcggcagcgcagtcccaccgccccgcctccgccggcgaggtgatcggccccaagaagccgaacttcaagctccacgagcgccgcaacgccgccgccaagaggctggagctccccatcgacacagccatgagcatgatgatgatgagcgtctcgcccacgtcctcgctggttcgaagcagaacaacgacgacaacgttggtagcttcgccggtttctccactggagttgtttctggcgcgtgctagcccacgcacgccgcacgaggaggaagaagagagagcgata

SEQ ID NO: 7476 - DNA, 380 bp, Glycine max
cctcactcaaacaacaaatcatcaaatcataagttcatagcacaccaaaattatatggcctcggaaacccaccatcatgtgcaaggcctaacacccgaggaactaaccaaactcgaacccatcataaaaaaataccacttattcgaacaatctcccaacacatgtttttccataataacatacaggatcgaagcgccggcgaaagccgtgtggcccttcgtccggagctttgacaaccctcagaagtacaaacacttcatcaaagggtgcaacatgagaggggacggtggcgttggaagcataagggaagtaaccgtggtttcgggcctcccggcgtcgaccagcaccgagaggctcgagattttggacgatgacaaaca

SEQ ID NO: 7477 - DNA, 402 bp, Glycine max
gtcaaacagctacacattccagaatcacgatccttttattttggaccttatcaaggtgcaaatgttgagccaaaattgcaaaaccccaagtttttgtctttactaaatcatcttcggttttacattcctgagatttatccactacttgagaaggttgttttccttgatgatgatgttgttgttcagaaggacctaaccccacttttctcactggatttgcatggaaatgtgaatggagctgttgaaacttgtctagaagcctttcataggtactacaagtatctcaacttctcaaattcaattataagctcaaagtttgatccacaagcatgtggatgggcacttggtatgaatgtgtttgacttgttttcatggaggaaagcaaatgtgactgcaaggtat

SEQ ID NO: 7478 - DNA, 402 bp, Glycine max
ggagcaggagtaggaggaggaagggtaggtggtgcatgcgacaacgaaattagcgacggaatgcaatgcatgaaccaccctcacaacaacagcaacaacaatcccggtgggatttgcgccttctgtctccaagataaactccgcaaccttctctcttcttcacctcctctttcttcctcgtcttctccttccccttctttcactcctccacctcctccctctgttaaaaccgaccacgaccacaacacgcgctctcgcctccccttcctcgtacccaagaaaaacaacaacaaaaaaccctcctcctacaccaacatttcttcatcagctaatatcattttcaaacgcagcaagtccactgccacacccaaaaggaaccagtttctcgaggagaaggacttc

SEQ ID NO: 7479 - DNA, 368 bp, Glycine max
ctgaggtacctcagtggaactgtcactcagggcctgctattgcaaccagctcacatggatgctaaaatttctttacgagcctacaatgattcggattggggtagtgatcctgatgagatgcgttcaacttcaggatcttgtatcttttctggttcgaaccttatagcctggagctcaaagaaacaaaccttggtggctcggtctgtgcagaagcagagtatcaaggtttagccaaatccacctctgatcttgtgtggattcaatccttattgcatgagctcaatgttcagatttagcaacctactttgttgtgtgacaatctgagtgcagtcatgattgcatataatcctattcttcattcccgaact

SEQ ID NO: 7480 - DNA, 490 bp, Glycine max
cataggagctcacgaagaagcatacgatgctcaatttgattgggacagtgacttcggaattcccggtgcattttatattaagaacttcatgcaaaacgagttctacctcaagtctttaattctcgaagacattccaaaccatggaaccattcacttcatatgtaactcctgggtttacaattcaaaacactacaagactgatcgcattttctttgccaacaatgtaagctacttagtgcctaccatgagaaccaaataagacaccacttgtatcaaaaattgaagttattaattatgtaatgcagacatatcttccaagcgagacaccggctccacttgtcaagtacagagaagaagaattgaagaatgtaagaggggatggaactggtgagcgcaaggaatgggataggatctatgattatgatgtctacaatgacttgggcgatccagataagggtgaaaagtatgcacgccccgttcttggaggttc

SEQ ID NO: 7481 - DNA, 780 bp, Glycine max
  misc_feature (372)..(379): n is a, c, g, or t
  misc_feature (381)..(384): n is a, c, g, or t
  misc_feature (386)..(395): n is a, c, g, or t
  misc_feature (397)..(398): n is a, c, g, or t
  misc_feature (400)..(411): n is a, c, g, or t
  misc_feature (416)..(424): n is a, c, g, or t
  misc_feature (427)..(430): n is a, c, g, or t
  misc_feature (432)..(432): n is a, c, g, or t
  misc_feature (434)..(434): n is a, c, g, or t
  misc_feature (437)..(438): n is a, c, g, or t
  misc_feature (442)..(443): n is a, c, g, or t
  misc_feature (448)..(449): n is a, c, g, or t
  misc_feature (453)..(454): n is a, c, g, or t
  misc_feature (460)..(461): n is a, c, g, or t
  misc_feature (463)..(470): n is a, c, g, or t
  misc_feature (473)..(477): n is a, c, g, or t
  misc_feature (495)..(495): n is a, c, g, or t
  misc_feature (511)..(512): n is a, c, g, or t
  misc_feature (516)..(526): n is a, c, g, or t
  misc_feature (537)..(537): n is a, c, g, or t
  misc_feature (541)..(541): n is a, c, g, or t
  misc_feature (561)..(571): n is a, c, g, or t
  misc_feature (586)..(586): n is a, c, g, or t
  misc_feature (589)..(590): n is a, c, g, or t
  misc_feature (592)..(596): n is a, c, g, or t
  misc_feature (599)..(599): n is a, c, g, or t
  misc_feature (607)..(618): n is a, c, g, or t
  misc_feature (621)..(622): n is a, c, g, or t
  misc_feature (627)..(636): n is a, c, g, or t
  misc_feature (641)..(642): n is a, c, g, or t
  misc_feature (644)..(645): n is a, c, g, or t
  misc_feature (655)..(669): n is a, c, g, or t
  misc_feature (671)..(680): n is a, c, g, or t
  misc_feature (691)..(703): n is a, c, g, or t
  misc_feature (705)..(709): n is a, c, g, or t
  misc_feature (718)..(720): n is a, c, g, or t
  misc_feature (722)..(723): n is a, c, g, or t
  misc_feature (736)..(737): n is a, c, g, or t
  misc_feature (744)..(749): n is a, c, g, or t
  misc_feature (752)..(752): n is a, c, g, or t
  misc_feature (754)..(758): n is a, c, g, or t
  misc_feature (768)..(771): n is a, c, g, or t
  misc_feature (774)..(776): n is a, c, g, or t
gtggtttgggcatgtagagagaagaccggtagactctgtagtgaggagagtagaccagatggagagaagacaaacaattcgaggcagaggaagacccaaaaagactataagagaggttatcaaaaaggatctcgaaattaatggtatggatcgaagtatggtacttgatagaacattatggcggaagttgatccatgtagccgaccccacctagtgggataaggcgttgttgttgttgttgttagtccttttttcttggattatgatggtttgtgtacgagttatgttttcacattagatggttgatgatgattatgggaaagttgatgtaggatatgggacagatgagaaagcggtgctattggtattggnnnnnnnnannnnannnnnnnnnntnncnnnnnnnnnnnnatcannnnnnnnncannnncncnatnngtgnngttgnntacnnggatcnntnnnnnnnntannnnnagatctcgttccctgagnagctcgtcactttctnntttnnnnnnnnnnnaggtaacgccnattnttatctttcagctaatcatnnnnnnnnnnngtcaggggtttttgntgnncnnnnncanactgacannnnnnnnnnnnctnncttcnnnnnnnnnnatagnnanncaaaactgannnnnnnnnnnnnnntnnnnnnnnnnctttccttttnnnnnnnnnnnnntnnnnncttgtaatnnntnnattatttatcccnntcccctnnnnnnatntnnnnntactacaatnnnnaannntccc

SEQ ID NO: 7482 - DNA, 395 bp, Glycine max
aacagatttagcacggctgcagcagttgaggaactaatcactccacaagtttcaatacgttacacacagaacctgataaatgggcaatttgtggatgctgcatcaggtgtgtctagcttgaacaagctttgttataacatgtttgacttctagttcgaacaccccaaacctcactttgttataacatgtttggattaaaattgggaaagtatttttgtgaatgctaatgcacatttgcaaatttcaatacacaaaatgaagaggactaatttgttgctttgggagtaaaaaatacttttgaactctctgaactgtaatgcaaacatgcactaacttgtttaacaaaatcatggttaggttgtgtacttgtgtttgaatttgaacatgaatgttgc

SEQ ID NO: 7483 - DNA, 412 bp, Glycine max
ggtgaactaatggaagttcttgaaccttttatgaaaagtcctttctcaaccccttctccttcaaattcttgttttctttctacctcttactctccttcccccaacaactactctccctccctatactcaaacgggttatcatccatacccaacaccacccaaaacttaattggtttcgggcaagggcagcccacatctcttgtgggcctgaaccacctaaccccatctcagatctctcagatccaggcccaaatccagatccagaatcacagcaacacgctgagcttcctagggccgaagcccatccctatgaagcacgtgggcatgcctccgaagcccacgaagctatacagaggggttcgacagaggcactgggggaagtgggtggctgagattagactcccgaaaaaca

SEQ ID NO: 7484 - DNA, 387 bp, Glycine max
cgggacgacgcacatccacctcatggaacattgtcccacgtaattggcaatttggccaaaccttcgctggaaagaattttagaatctagttactataccgtgtttggatcatttgcgtttttgaaagtgttttcttttcttttgccgcctttttttttgttttgtttttggttgtttgctatctacaattttccttcgaatgtggatacatatggagaaaatggtagtgaacctttttgacttttgatcatgttttcgggagtggagtgaaggatcaattatcaattatcatggggcacagtgtacatcttggagagaaaatgagggtaacgaagtgtgatttttgtcgggatcaagctgaagtggctgcaaaggcaaattcataag

SEQ ID NO: 7485 - DNA, 728 bp, Glycine max
ctcatcgagcagagaggttggtttactcgtaattttgtttggtgaaaaattggttttcggttttgtttttaaaatgatgggtttggtcttcttgttacagagaatgtcctgaggaactgaaggaggcagcatcgggattactctatgcagcttcaaggtgtggagattttcccgagattcaagagattcgtgcaattttgacatcacggtttggcaaggagtttgctgctcgatctattgagttaaggaacaactgtggagtccatcctcaggtatgtatctgatatgagaatcaacaatctgttatgtctaatattgttgccttcccagtattttgttttgcctgttagactagttaaaaactaagatttatgtacaagctagaatttgtgcagagaatagataactgtcttatgataattttgataaatttttctgtggatactatggggtaactctttttatctggttgtttatagatgacacagaaattgtcaacaaggatgccaagcctggaaagcagaatgaaggtactcaaagacattgcttctgagaatggtattgttctgcagcttgaagaaacttctgtttcggttgaggtataacacctaaggcagcaaaatttgcaatttcttgtttgtatttatatttgaaaagcaactacttatggcatctgatgtaaactgttcaggaacaatccagtgtagaaaagcaaaaccagcatgatc

SEQ ID NO: 7486 - DNA, 393 bp, Glycine max
tttgtttgaggcaacaatggcatttgatttgtctaataaaggagatgttatgaggtatggttttgtttgcatgttgcatgttgtcttcttttcgtggttgttgaattaatttattttgtagttccccgtggttgatgatttgtttccatattgttaatgcaaatgaatttagttcaaatgaaaaatgattcgttgtttgtttttgatttggtgaacctaaaacaatggtttgttaattaattttatggtttaatttatgagggcttgaatcattattgttggttgtctcgtggaagcgttgtgaacgcataggaagtgttggaaattttattggttgtatctgaaagattatttcagcgtcaagaatagagaagaacattgcaaagcagaaga

SEQ ID NO: 7487 - DNA, 366 bp, Glycine max
tctctacttcattttaagcgaaaataaatcagaacaagtattagtcctctactactttctttcagcatatcagtcatgggaacattgcgaaggggtccataatgattgtcgaaacaagtcatggacaggaatcatagctggagcctcaatgagttttgaaaagaattgcattcctatgttgctatgtgtatgttttgttattttcacgtagttggacgtggttatctagttatcttttgcacccactgaatttattttttcttctcctcaaaggtttgttagtagtatttatcttttttatggtgtttgatgccaaaaaaagtagatgggattgtcatgtttgcgttctccttcacttatcaaaaa

SEQ ID NO: 7488 - DNA, 590 bp, Glycine max
  misc_feature (166)..(173): n is a, c, g, or t
  misc_feature (175)..(176): n is a, c, g, or t
  misc_feature (181)..(182): n is a, c, g, or t
agatagatcagtctctaccagctggtcttccttctgcaatcctccaattatccaatcaagaagacccttctctttgcttccaccagcaccctttgctgctgtggctgcaaagactctaccagttcgctggagcaaatgacatgatgatgaagccatatgttgctannnnnnnntnnttcanncgtcacacaagtgtgcgttgtagatttctcagtttgcaacatatggcttccatcatcatgtcatttgctccagcaactggtagagtctttgcagccacagcagcaaagggtgctggtggaagcaaagagaagggtcttcttgattggataattggaggattgcagaaggaagaccagctggtagagactgatcctatcctcaagaaggtggaggagaagaatggaggcaccaccaccaccaccactggccgcaacaagaactctgtggcagtgccacaaaagaagaaaggtggctttggaggcctctttgccaagaactgaagcagcagtgatgatttgttatttaccttacaattgtttttacctgttttcttctgaaatgcttgcactgttgtcttgtccacttaa

SEQ ID NO: 7489 - DNA, 402 bp, Glycine max
ttgggacactcattactggctctcctggggaggatccaaaaatgttagccaactttaaggatcttctggaaaaagtttttgtcttggatccagacaagaggctgacagtgtcacaagctctgaaccacccattcatcactggcaagtgaataatgctgctgaacttgactcccaaaatgatactgatatttgtacataatgatccaattgatattgaggttctaattatttggtactatttatcttctgtgtatggcccaaggagtgtcatcacagttgtcggcatgttgaagtgaaatatggtgattttgctacaggcgtacactttactggcggttctttcagtggaatgtactgtttctattgtaagacaacttgccaatggcagtttcccttagtgta

SEQ ID NO: 7490 - DNA, 413 bp, Glycine max
ctgcaaacaaaatttgaagtggagatgatgaagctgcagaagaagcttgacaactgctgttatcttttggcaatggctctgccattatatctaaatcatcaccacttgatcctactgcaacataactgtatgagcctaaaaacaatggatcagttccccatttgctcttcaagactttactaaacttcacttcattttgtaggtagtgagatcttccctcatcagagttcacattcccattgcacagtttatgtgaactacaactggtggaacccttttgccactgagagtgatgctgtagaaagaatgagactgtggatgaaacaccgtttatgatctcttcatctttgagtgactcaagtgctagtgcttcttcccctacaaaccatgacaagaggacactggaattgttg

SEQ ID NO: 7491 - DNA, 232 bp, Glycine max
  misc_feature (189)..(189): n is a, c, g, or t
ccgcatttgagtcctataagttgatcacatgcaaagacactaggtaagcacatctttcaatacattattactccgctaactatgttgttggagtgcttttgcaggtaccttccattttcatcatcacaattagaccagtagatttcttctcatctcaaagagaagcaaatatagtggccttaccaatgntttgggtgctgctagatcagctattctctatccaaaataaatt

SEQ ID NO: 7492 - DNA, 736 bp, Glycine max
acttgcacaacgtaagtgctattctgtttctattctccaataaatgtctaccttttttgttttaatgtacttatgttcctgttatatacttggagatgatagtgttttactaattagttattactaaaagccaagttcattcccttagcaatctacattttagcagttgcctgtcatcttgggccctagattggatggagccaggaggtctccaagatacatgtggaatctttgtaatattttgagttggtttagaggtttcttaggttagaaggaaagcaatcaacatctagcatatcattatagatttatcaagagatgggatgcacagttttttagcaggctgcagcttctagtttgtgaataatttatctatcttttccaccaaattgattgttctttctttctacgtacattgcataaacctaattccacgcaatgatggtgtttactctcgttttcagtatgattccagcatttgactactgatacaattgttgatattgcattagattttattaatctttgagagcattcagttgggatatttttcaattcgagccatgctttttttgacaatttaacagggtggagaaagtaaagcatggatttggcatgaaagcacctagagcagctacataagctaaatgtataaaaaaagattctgcgacaggttggagaaggagaattttgctccttccttctgattcggtatcgttatttgggacccctgata

SEQ ID NO: 7493 - DNA, 631 bp, Glycine max
tgaaatttgttcaagtcgttcacaggtgtttacacatcttcattttctttccgatcttctctttttaatttgcatgagtcaaatattgaacatttacatgttattagtcttttctgccacttcttcctagtcttctctaactccttttttgtgtgtagttctatcagaaatttagtgtagtgtctataagttggtatatttgattttctgagtctctaactttgatcttgcagaacaagaatcggtcggtcaaaatgatcatgacaaggagcaagactcaacagatgaaggaagacagacttagtggattgcctgatgaaattttgtttattattatgtctttcataatgataaaagatgctgttaaaacatgcatcctgtcaaagcggtggaggaatttgtggaaattcctccctaatcttaccttacattctaatgatttcagaagtcatagtgttttctttgaattcgtgtcgagaattttgtcttgcagtgatcaaaaccataccctgcatagtctagatttccatggtcctttctatggtaaacccattgttatgacaaatctcatgggctacgctgtctatcataatatccaacacttgaacatcaatgtcccttacaacatttc

SEQ ID NO: 7494 - DNA, 336 bp, Glycine max
acacgattaatacggacagtttggagggttggggtttctgcaattaccatttgcatcggaatcaagacaaatacaggagagagagaacagaaattaggtagagagaatgaaaaagaaaaagagaaactatatatatctatatttttgcgagaatttaatttaggttgcttggtaaaattaaaaggaaaattgtttcatggacttgcattaaaaaaaacctagccaacaacatcaataataaaaaaaataaccttaacaaatgaaaaaaagtttagttgacatcagtcaaaaatagtctcaggacctaaaaaacttaaccgacatgagtttaatgga

SEQ ID NO: 7495 - DNA, 395 bp, Glycine max
ttacttcctttgtggttgaagaggtagtccgtttggagggaaaacgggtttctcttaaccgcaatggcagcctgagcagtagcagcagtaggagcaacagcaacagcaatggaaactatgagaacaacattgcttcaaatgaactgatagaaagggaatatgtaacattaggattgccaattgtaggagggatcaattctgagttatccaatgttaagaaagcagcacaaatagattataacaatttagttggttcaatctcggccctctcaacccggttagttgaaattcgagaacttgcttccttgtgtggaaatggaggaaattttgtgaaagaaatggatcattttctgggaaatgcagaggatgagttgaaattagtgagggacaagcaa

SEQ ID NO: 7496 - DNA, 384 bp, Glycine max
gctggagctttacaattttactcgagtgggatttttacaggaaagtgcggaactgctccaaaccatgctgttactgtgattggttatggaaaagctcgtggtggtgccaagtattggctggtgaaaaattcatggggcactaaatggggtgagaaagggtatataagaatgaagagagatatacgtgccaaggaaggtttatgtggaattgctaccaatgcttcttatccaactgtttgaatgctgctatgaatccatcatatataaacctttaaccgtgtaatttagtatatgcacgttggaatgtatctctaatcatcattttgttttctggcaagtatatgcacctacgtacgtcgtgttcctaataagttgcagatgcag

SEQ ID NO: 7497 - DNA, 145 bp, Glycine max
gagcgtgagacacttttgaagtttaagaataatctgaatgatccttcaaataggctttggtcttggaatcataatcataccaactgttgccactggtatggagtcctctgccacaacgtcacttcccatcttcttcagcttcacc

SEQ ID NO: 7498 - DNA, 756 bp, Glycine max
  misc_feature (407)..(410): n is a, c, g, or t
  misc_feature (412)..(418): n is a, c, g, or t
  misc_feature (420)..(420): n is a, c, g, or t
  misc_feature (423)..(425): n is a, c, g, or t
  misc_feature (432)..(434): n is a, c, g, or t
  misc_feature (439)..(442): n is a, c, g, or t
  misc_feature (444)..(444): n is a, c, g, or t
  misc_feature (449)..(463): n is a, c, g, or t
  misc_feature (465)..(466): n is a, c, g, or t
  misc_feature (468)..(469): n is a, c, g, or t
  misc_feature (473)..(479): n is a, c, g, or t
  misc_feature (485)..(489): n is a, c, g, or t
  misc_feature (495)..(495): n is a, c, g, or t
  misc_feature (497)..(500): n is a, c, g, or t
  misc_feature (502)..(504): n is a, c, g, or t
  misc_feature (506)..(515): n is a, c, g, or t
  misc_feature (521)..(525): n is a, c, g, or t
  misc_feature (533)..(533): n is a, c, g, or t
  misc_feature (539)..(547): n is a, c, g, or t
  misc_feature (551)..(553): n is a, c, g, or t
  misc_feature (556)..(562): n is a, c, g, or t
  misc_feature (569)..(572): n is a, c, g, or t
  misc_feature (576)..(578): n is a, c, g, or t
  misc_feature (580)..(584): n is a, c, g, or t
  misc_feature (591)..(591): n is a, c, g, or t
  misc_feature (600)..(602): n is a, c, g, or t
  misc_feature (606)..(616): n is a, c, g, or t
  misc_feature (620)..(623): n is a, c, g, or t
  misc_feature (626)..(627): n is a, c, g, or t
  misc_feature (630)..(642): n is a, c, g, or t
  misc_feature (649)..(657): n is a, c, g, or t
  misc_feature (662)..(672): n is a, c, g, or t
  misc_feature (675)..(683): n is a, c, g, or t
  misc_feature (694)..(695): n is a, c, g, or t
  misc_feature (697)..(703): n is a, c, g, or t
  misc_feature (707)..(707): n is a, c, g, or t
  misc_feature (710)..(713): n is a, c, g, or t
  misc_feature (719)..(719): n is a, c, g, or t
  misc_feature (727)..(729): n is a, c, g, or t
  misc_feature (735)..(735): n is a, c, g, or t
  misc_feature (739)..(742): n is a, c, g, or t
  misc_feature (752)..(752): n is a, c, g, or t
aacttcgtgtgaatcttgaattccaatgaaataaataatctttcttttttttgttattattattattatgaacacccaaatggagatttccagtggaggttgttctcctaggattaggtctgaatattcaagaaaagagggatccgagggaaccccttttcagcacatggaactctctgatcgtgatcgcaatttccaagtccaatcgatgaacgctttggaaattctgagagaaaccgtcaggatccttaggttcaattcgtggggtttcatggcaatcgcttttatgcttatttgtcctgtttctgctgtgcttttatctaatgtaatagtggatgagtctattgtcaagaatctgtccatcagacttatgttggttgcaaaaaagattcgaggtaggcttgagnnnnannnnnnngntgnnnttcgccnnnccctnnnntnttgtnnnnnnnnnnnnnnntnntnntcannnnnnntcggannnnnagtttntnnnngnnntnnnnnnnnnntgctcnnnnngaagattnggtacnnnnnnnnnacannntannnnnnntatgccnnnnttcnnncnnnnnatagtgngaggatcgnnncggnnnnnnnnnnncacnnnnacnnttnnnnnnnnnnnnnaccttannnnnnnnntatannnnnnnnnnntannnnnnnnnggaggagtttnngnnnnnnnctcnttnnnntttctnatgatttnnncccatngttnnnntttttgtggntaat

SEQ ID NO: 7499 - DNA, 325 bp, Glycine max
attgaccacaatatacagcaggccacaccatcctccctagcagcaaattactccaactccctgcaaaagatgtgctggaagttcaggaataactgcattgtagatttcagctgatttcatccaattatcctaggtatataatataactgcagtgtcaaaaaaatttaacaaagcaaacagtgtctctggactctagctctatgaagttaacatacactatgcgctgaaaaaaagatgcatgatataaagtcataaacaaagataattcaagatgcaaaaccacctacttttcctcaatggctttggtgcagttgttagagctgtg

SEQ ID NO: 7500 - DNA, 617 bp, Glycine max
tattgatgtccacctagcctcaaaatcatgtaaaaggtttaaaatataaaaatgtcaaaaacttgtttttagatgaattaaagattgctaattaagcttttattgattggcactcaattttgcctttgaattttctgatggatgaggtgtgctatcggtgcaagcagtacaagaaagaggcttgtcagcaagattgatccgcaaggttcggtgcttctcattctcaggtatatggaggagagcatccatgattaaaatgtcccaatcacgaggaaggaaaaaggaagaccaagtgtcatctgtttcaaagaagccaaccaataataatttccattagctgtcaaactggcctcagtgttcccacttcgcaaactatatagatcttataaatatatgtcaaagtaagcaagcagatcatagttagtaatacagactaaaagagttaactgacagttaggcaaaagttgtaattcaaatcattaagatttattcaaattgctaacctccatttcgaacagccttcagctgcaagacaccattgccttgtggtccagaaacaggaaatgagcatgaaacagaacgtctttcatgagctactgcaagagatgcattgtacc

SEQ ID NO: 7501 - DNA, 426 bp, Glycine max
aacattggtaagctgacgatcaagcgcacgcccccaagcggagttcttgtgaccacaggggcccggaaggacagcccatgaacctcaaagccgtcgtcttcgacgcctacgggacgctctacgacatccagtcggtcgcggagatcaccgaagatgcgtttccgggctatggcgagatcatcacgcaggtctggcggatcaagcaactcgaatacacctggttgcgctcgctgatgcggcgttaccaggattttgccgcggtcacccgcgactcgctgggctatacgctgcgcgtgctcgggctcgactatgagaaggacgcgtttgagcgcgtcatcgagaaatacctgcatctcgatctctatccggacgcgacggccgcgctttcggcgctcaagccgcgaaagctcgctatcctttccaatg

SEQ ID NO: 7502 - DNA, 645 bp, Glycine max
tcagctaaagggcatgaaccaaaatgtaagtatttcttcctctgatcattgaattcttgcaataaaatcacctagtttaattatttttttttaattgatcagaatgcagcagaagagttgagcaaggaaagctttatggctgagaaaacaattacagcagaacaaccaagtcctgtgtctgttcttgatgcttctttctacagagaagaaccaccttctccagttaaaaagaaatcagacatgtcaaaagatttaggtatgtagcacatgtcatttctaagcaacatagattgaaggttaaatcagtctaaaatcaactgtaaaatgaatcatcacaccaaatacacttttttatgccattaaaaataaaaatgcaggaaaggaggttttgttattgattttcttcaaatttattgcaacagatgatgctctgaacacttatgatagtagtgaggagaactcagaaaatcttcagctttcatcaagcactgcaaaagccaagttcggcagtgaaatcagtgatactgacttgagaactcaaaagttggtcagaattctccaacaaattgactacaatgatgagagattcaccaatttcagagatgataaagatcctaaccataaatatatatcagaaatactgta

SEQ ID NO: 7503 - DNA, 422 bp, Glycine max
  misc_feature (415)..(416): n is a, c, g, or t
tttagctcctcctcatagaagcatcaagatcatagcatttaacaacaatattctcaccaataaaatactcttccccatttgaatgatagtaaaactacaaaaaacctcacagggaaatagtaacacacatatacacatgcatgcacacaaaattattcttcaatccacattaaaaaaaaaaatgaaagaagcatatgaactctctcaatatttgaaaacaagagaaaaggaaggcacaaggaggtagagtagaggttgtaggacgcgacaaaggccttgtaagggtggcaatatttgtcagtaggttagccacgtttgttggaccgaaactgtttgatcacggactacactaacaataccatattcaccccattattggctttcccaatgacccatctctcaaaaaaagtcaaannagaggg

SEQ ID NO: 7504 - DNA, 475 bp, Glycine max
ggttcatatggttatatggcacctgaatatgcatttgatggattattttccattaaatcagatgtatttagcttcggagtattattgttagagatagtaagtggcaagaaaaataaccgactcttctatccaaatgactacaataataatctcattggacatgtgagtgacataaatttattttatttttcatatatacaattgagcaatagataaccattatttcaaaatgtattaggcatggagtttgtggaatgaaggaaatccaatggaattcattgccactagtttggaagactcatgcattctatatgaggccctgcgttgcattcatattggtctactatgcgtacaacatcatcctaatgataggccaaacatggcatctgtggtcgtattattgagcaacgagaacgcattacctttaccaaagtatcctaggtacttaatcacagacatctcaacggaaagaaaa

SEQ ID NO: 7505 - DNA, 359 bp, Glycine max
tcttagcaccctaagcctaatcttggggtgggaaatgggtagtgaacctgtttatctctggacactacctatgttccattgcaatgggtggaccttcacgtggggcgtggctgcacgtggtggaacaaacgtgtgccttcgcaccacagctgcacgtgacatatacaggaacatagtagtccacaatgtgacacacatgtgctgtgcccccattgtgttcaacataatcttggaggcaaaacaaagtgaaaggattgacataaaggtaataaatgggaagagaaaatcaccggttgagattctcactgggggagcaccaccaccagcatcattgctagagcaaattgagtcacttgggt

SEQ ID NO: 7506 - DNA, 396 bp, Glycine max
tctaaatcataacacaaaccctatttttttctccacaatggatctccttcaccaatactcagacggcgacgatcccgactccccctctgaaaaccctagctcccctccgcgcctcctcccgggacgctccgccgcgcccaacgtcgacgacaccatgctggccctcaccgtcgcctcctcctcctcctcggccctctcgcggcccatcgaccctacccagcacctggtgggcttcaacccctcctacgaccagctctgggcccccatccagggcccggcccaccccttcgccaaggacggcatcgcccagggcatgcgcaaccacaagctcggcttcgtcgaggacgcctccatcgaacccttcctcttcgacgagcagtacaacaccttccacaa

SEQ ID NO: 7507 - DNA, 278 bp, Glycine max
ctgctgcagataggaccaacaattcttttgttcttttctttctgttttccccaaattaagcataagattgcgtgccatagttatttccagcatcatcatcatcatcatcatggcattgggaagagtaatatacgttgctcacaccgtatgtatcagatcagagcttcaacccatggcacctgaccgcattggttcttcctcttcttctcgccaaagggacctcgttttcgtcgtcaaccctctaggtatgctgagaaaatatagaaagattttttttt

SEQ ID NO: 7508 - DNA, 838 bp, Glycine max
  misc_feature (67)..(70): n is a, c, g, or t
  misc_feature (770)..(776): n is a, c, g, or t
  misc_feature (806)..(808): n is a, c, g, or t
tggcgagagttatccgaagcagaggttttgagcaaagcccaaaggatcgtaattgagctcaacaacnnnnacacagagagggttgttaatgggaacgagttcgttcttgttctggggtatgcaccttggtgtccaaggagtgctgagctcatgccccattttgcagaggctgcaacttctctcaaggaattgggaagccctcttgttttggccaaacttgatgctgacaggtattccaagccagcttctttccttggagtcaaaggcttccccactctgcttctctttgtcaacggcacctctcagccctactcaggtggtttcgcagcgtaagatgctctaactcctttcacttgtaattggcttatcggatacgaatctgatactgatactcttggataaagttatgaaaatccaatagggatatagaaagcatgtatagtatggatacatagaggcattttcccttgatgaaccaaatgaaacttgttctctttatggatggttttaagaaaggaatgatattgatttgtagacaataggaactaggaagtgatttgtgataacaacgatttataactttttgtttttgtttttaataatgtccaagaagtatgttcataatttgaatttgcagaattgcaattatatattttatgaatttttatacatatctagatatgtatcttgcactcttacaccaattgtatcttatatatttttgggattgttgtatcaccatatcggatacatattgtatttgtgcatcnnnnnnntgcttatttgttttcgtggtgctttcagannntgatatagtgatatggcacaaaaaaagact

SEQ ID NO: 7509 - DNA, 353 bp, Glycine max
  misc_feature (314)..(316): n is a, c, g, or t
tgcgtttattgttttatcattttgggtttaatataatttacattttttaaaaaaaatatattaccgctttttccaacaagtaaaagataatagacatgcagttcaattgaaattcttgtttcaggagtttatgttatcgaggaagatgttgccacttataccataaaagcagtggaagacccaagaaccttgaacaaaactgtgtacgtgagaccccctgccaatattttgaccttcaacgagctcgtgtccttgtgggagtacaagattaacagcacccttgacaaaatctacattcccgatgatcaacttcnnnctcctcaagcttcaatctttcaagtggggaagtggcg

SEQ ID NO: 7510 - DNA, 295 bp, Glycine max
cagcagattcttcagtacaaggggtgctttagttggtaataatcatttagatgatgttgacattggtaatatgcaggttggaagatccaaccaatcttctgttgctggcccaaataactgggccggttttgctggtgctaatgaggcttcaaagggacctcctcaggtctctgctattcaacatgagttgcctatagaaagaagagagaatattcctagtcagtttcaaaatgttggtaacaattgtggttcacggaatcaaaattctgttaatcacttgtctttttctttaaaa

SEQ ID NO: 7511 - DNA, 488 bp, Glycine max
catttgtttaatcttcctttcttttctctacccattttcttcttcttcttctcccctccttttttccttcttctaccagcttctagaacaaggatgtgcccatttcctgcttacttgaatctcaaacacaaaactgaatctttgacaacaatttcaagattttcccaccaacccaccacagcaaagcacctggtcgcttcaaagatctgatttttagttctttggggtggggtttctaccgtttttccttccaccattggcacctgcagcagaaccaaattttgaacaaccagaatggtcaacactttatggtcactttgtgtggtttaaactgtaaagtctctctctttctctcactcactttttttctctctctgtgtgtgtgtgtgttgcattctttgtgtgtctcaatctctggctgtgtctttcagtgttggattcttggtgggtttagtttaatttttgactgaacgaatgagatcttgctc

SEQ ID NO: 7512 - DNA, 379 bp, Glycine max
tcttccttaataactccaaaaactttggtacctttcaatcaaccaccgaaaagttagggactttaatttttttaatttttttttttatatgaagatgtgtgattgatcgattccctagtgaaggggtaaggggggtcatgtctttcggtgggttaagtattgctttgagtcttgtctttgggtgtcttctgctggctctgtgtgctcagctttactatttcttatggtggaagaagagaaggacacagatggatattgagatggatgcaaagggtgcgttttattgggggtgctggaagaccccttgtgccatgcatgttgcaaacaacactggaaaagggggtgtgaatagggacataaaaaaaacaacaacaagtcg

SEQ ID NO: 7513 - DNA, 537 bp, Glycine max
gatctcgtttacactgttggtgtatctgactatcacaatgactggttttatgctcaagttaccaggtatttgttttttttggtcaatatatagaatttgttataattgtcaagcatttttagttttctcctctaaaatgcactaatgtatgcaggagcacaccagaaaagacattcgtgccaacgacatggcaaattcaattccaacttaaaaatatcataatgccaggaaattacacattacaagtggggttggcatccgccaataatgctagactggaggtacaccaattcattttttccataattgatcttcttttttttttcagttatgagtatgactatggtggcaattggctaacatttttttatatgggtgatcaggttaggttcaatgaccagaatgctaagcttccccacttctcaacagggctaacaggcgatgacaatgccatagcaagacatggaattcatggattgtataggttgtatactatagctgtaggcagcaatcatttggtgaaaggaaaaaacacca

SEQ ID NO: 7514 - DNA, 590 bp, Glycine max
  misc_feature (403)..(406): n is a, c, g, or t
  misc_feature (416)..(419): n is a, c, g, or t
  misc_feature (421)..(424): n is a, c, g, or t
  misc_feature (434)..(436): n is a, c, g, or t
tctcctgtaaccatcacaatccacaacaccaacaagatcatgtctccacctatgcaagtggagtaactgccacatctattgaaatcccacttccacagcatcttggtttgaacatgggaaactcctacatcaacaacaacaacaacatggataatcatttggtgcaagaggtcattgatgcatttccctatcagcagtccacttgggaccctactattgttcaggaattacaagacatggcctatgctaatcacacagaacaaacacaacagcaacaacaaaatgaacaacaatttcagcaatttgagactcaaaactgcagccaaagctacaacaacccctcttccatactagaccctccttacccttcaccagatctcctaaaccttctccacatgcaagnnnncagtaaaccnnnncnnnnttcgtgaaannntggacttggcaccttggatgactggtactagagatttgcctatatacaggctatatggggtagttgttcacctggatatcatgaatgctgctttttcgggtcattatgtgtgctatgtgaagaatttccaaagcatgtggttcaaggttgatga

SEQ ID NO: 7515 - DNA, 350 bp, Glycine max
ttgagaggggtatgctttgatctttgtgatgttgtacttcatgctgatacaatccataggggaggtggccaaatcattccaactgctagaagggctttctatgctgccatactttcagctaagccaagactacttgagcctgtgtatgtgatggaaatacaagcacatgaaaaggctcttggtggcatcaatagtgttgttaacaagaaaagagggcatgtgtttgaggaaattcagaggcctggcaccccattttacaatgtcaaggcatatataccagtgattgagtcattcaaattcagtgaaacactgaggactcaaattggagagcaggctttcccacagatggt

SEQ ID NO: 7516 - DNA, 772 bp, Glycine max
aggccgtgctattggcgtggaacatattcctgagttggtttctttttcaatcgagaatattcaaaaaagtgctgcagctcaaccattgaaagatggttccctttctgtgcatgctggtggtatgtttctatgttgatctgaaacttttaaactctttaaattttttgcacaacaaaaatacaattccatttgatataattgactgtgactgtttaatctatagtccatttgtcggatgagtgtcaaaggcttaatgggaggtgagggattggataattttaatttttacagtccttctgttaaacagaaaaccataactcagatggtcaggatttgagatttgtttgaagtgattgagtcaacttaatctgaaactagagttgatccataagcattttatatgatggccatccatgattttgtggattgtgagtgtccatattcactttcttgaactcttccctctgctctgctgtgataactgcatagctatattaatgtttcttgagaagtaaaataatttgctatgtcaagttggtggatcaaatatttcaaatgtttgagtaattgttgtgttgacagatggaaggcaaggttggcctgagtttgctccttatgatgccattcacgttggagcagcggcacccgaaatcccccaaccacttattgaccagttgaagccgggtggtaggatggttattcctgttggaaacatatttcaagatttaaaggtcgtggataagaactcacgatggttctatcagtatccgga

SEQ ID NO: 7517 - DNA, 412 bp, Glycine max
tattatgtatcagataaacttaaccttttgtttgtatagtccttcgtagttatagattttaagagtttgccaccttttgcattttgcttagtcaaatttaaattttcttggcgcggtatctgttgtatgattgaaagttattgagctaaatgtaatgtgtcttttctttgagcaggtcaaaatttggtgcactaatcaggaagctagtgttctaaatatagacatgaaagcaaacatatgttgtgtcaaatataatcctggatctggcaattatattgcagtaagtacctttcattcagttaaaacttagaagagaatatctggatttagttcactctagatatgatcctatccatgttttatcttgtgtctatcattcagcttagctgccaacttgtgacactggttggca

SEQ ID NO: 7518 - DNA, 391 bp, Glycine max
aaatgagatgtagaagctgcaggtgtggaatcagttgcagcaacattcccatcatgagttgaatttgtattgacaccatttgttgggtgattatgaatatatgactcaaggtcctcaactaatctttcagcagaatccatcgcagaatttaatgctgatgaaagggatgaaaacgaagcagctccttgcactaacaaggttgaaatcggagtctgagaggaaccagtaccacgatcattgcctgtctgcaggcgagattgagcaagcaaaccattatttctatcagttgcagcattgggggtttgtgattgtgactgaacccgcgctcctaacccaccaataaggtgatgaaaccgccagatattttggattacagaagaagaagctccca

SEQ ID NO: 7519 - DNA, 521 bp, Glycine max
tctcgctggcctattgtacactcactagaaacggcccatttagcaatgtgcccaaacccagaagccaggaaaaacctatcggtcttgtgtggatataaaaaccgaagttagggttttgttgtgcaccagcggagcaatagcaacagagccagcgagagcaaaaccctagttcatccatcaccagtcgaggaagaagatggtgaagttccttaagcccaacaaggctgtcatcgtcctgcagggccgctacgccgggcgcaaggcggtgatcgtgaggaccttcgacgagggaaccagggagcgcccctacggccactgcctcgtcgccggaatcaagaagtaccccagcaaggtcatcaagaaggactccgccaagaagacggccaagaaatctagggttaaggcgttcgtgaagctcgtgaactaccagcacctcatgcccacgcgttacacgttcgacgtggatctcaaggatgctgttacccctgatgttctcggcaccaaggacaagaaggtcactg

SEQ ID NO: 7520 - DNA, 374 bp, Glycine max
tgatgtgaccttgtttcctgcatgaattgtaccagcaattcttctagcctagtgctttcttcctgtgggctgggctcttggtcacgtagaatgacataatcattggccgccatattctctattagctcaatagcttcttctggagtctttaacttgatcttcccaccggctgaggcgtcaaggagctgcttggaatggggttgcaagccatcaataaagatgttgagctggactggctcactaaacccatgtgtaggagtcttccaaagtaacccatgaaagcgatcaagggcttcactcaatgattcatgagggtgttggtggaaggatgagatttccacctttccctcaatggtcttggactctgggaaata

SEQ ID NO: 7521 - DNA, 230 bp, Glycine max
gctctttttgtctttacgctgaatctgtttgttccccttcctcgaacgtttttcattgggcgtttcgacccactatgttggagctcaatactaagttagattccttttgattttcatccattatctgtgattaggaaaacccatgtcaccattttcacatcttgtgggttttagttggatgttttcaagagtttgattctagggttacttatgcaaattttgggaatttt

SEQ ID NO: 7522 - DNA, 372 bp, Glycine max
gttcaaatctcctctcagacttggttgatagtagtagtagggagggtgttggaagaggaacaaggtaatgtgttgttatgctgatgagaaggccaagaaattcgttccggataacatggagcaggatgcgcaataaatgtaggaatctcatctccaggcattagaactgaaacaccactggcatatacactcatctgcaaaagttagaagaaaaaataaagagaggatgaaattcatatataattattacaaaaatgaagttatctcctgcaatagattagtcaaattctgggattcagtatgtgtaagatgattgaagaaacttgttataccaaaagtggaccagaaatcaaaccgttgtccactgtaaac

SEQ ID NO: 7523 - DNA, 577 bp, Glycine max
tttccagatgacaaaaatttccatgctctttggtctgttgtgatattgatgccatcacatttccagtgtccctgcccttattttataaaaaaaataaaaagttacatttaaagcatagttggaagttggatctttgccgtaagccaggcacatgaatggagcctgatagctcatctgatacagaattgtttttcctacatctcaatttgtttattattttctctacccttgctccctcaccttttgtgataacaagtagtaggagagaaactcaatttaaaaaagggggtgtgaaaaatatcattattacaatactattagatatggaatgttaactatctgatttcactaagccttatgtgataatacaaatctgattttctaacaaaaccattatatgttatcctgtagttaacttggtaaaaaatcctggctttgaggagggtccattccccattttcaactcaaccaatggtgttttgctcccgcctcaacaacaagatggcttctccccactccctggttggattattgagtcactcaaggctgtgaagttcattgattcaaagcatttcaa

SEQ ID NO: 7524 - DNA, 432 bp, Glycine max
ctcggctgtgagaggggctatgaggattcagtggtgttccggtatgaggttcaagatgccttttgagactgaggattcttccaggataagctggttcatggggactattgcttctgttcaggttcttgatcctattcgctggcctaattcaccttggaggcttcttcaggtacacactatttcaattcatgcttgtctttgccaatattctaaagtttgaattttcatcgcaacaggttagttgggatgagcctgatttgctacataatgtgaagcgagtgagcccatggttggttgagttggtatctaacgtgccaatcatccatctggcagccttctctccaccaaggaagaagcttaggttcccccttgacgttcagtttccgataccatcgttttcaggcaacccctttgggtcttctagctctagca

SEQ ID NO: 7525 - DNA, 610 bp, Glycine max
tgaaattctcagtctcaccaaggggaaataaaatgaaaagtaatcaaaagcagaacttagtgatggaattggtaaaaacagaaggtagctaacaagggatctgagaggtgcaccactccataacatgcagtggagccttcaccaactccaacgcacactccactattacagttatgcacaagcagcaggggcatatgcatgtcaacaacaacctgcgaaaattaccaaccaaagacaaagttttaaccttttcgatattttcactcaatcggaccagaacccatgttccagaattgcaaatcacaacaaccccaacacacaaaattgaaatcaaattacatggtactaattaattttatattttgaagaagaaaattgatgacagtgaaaagggtgtgttttttgttcttacccaacgatccacacgacgaggccaacgaccgagacgaggagggcgagaaaagcgaaggggagacccaagagaaagcccaagggtctgcaatcaccatctgagttgcacatattttgtgtgtttttctttcttttttgtctgagaaagaagaagtaggtgtaaacccttgttgtgtttctgtgttattaagaagggaag

SEQ ID NO: 7526 - DNA, 693 bp, Glycine max
aggagcattccccaactgaagctaacattttttagttataaacatatttatgggcatgactacacaaaggtatatcaataaaaagaatatgctactagtcttttccccatcttacccttttttttgcgttgtcattatttgaaggattttgaattttattgtgtgtcattctatggactgtgtttcagtctatcaagagggggaaatatggccaatttggtaaagctttaatggtggttgtgaaatgcatttgtaatccagcacactattatgcaaaggtaatcattttagcttctttttttttccttcacagaaccaactggcatagggtagggtgcagttgtttgttcctaacttcttgttacaaatcttaaaacagtaaatatagtttaggaagagattttattttttaggtgatttggaatgaaatcattgttttaaaagttacaatttgattaataatggaagatactgtactcaagcatcaaaggggaaacaagggacagaagagttttggcacgaacattggtaagcagggctgagatagacatagatgaaattagaagggttttcaaagaaaagtatgggaaggaacttgctgatgctatatgtgaaggctttccatctggtgactactacagagactttcttgttgccttggctacaagatctaagtagaccctgttgcatctg

SEQ ID NO: 7527 - DNA, 610 bp, Glycine max
  misc_feature (49)..(49): n is a, c, g, or t
  misc_feature (383)..(383): n is a, c, g, or t
  misc_feature (392)..(392): n is a, c, g, or t
  misc_feature (397)..(397): n is a, c, g, or t
  misc_feature (399)..(399): n is a, c, g, or t
  misc_feature (466)..(466): n is a, c, g, or t
  misc_feature (596)..(596): n is a, c, g, or t
  misc_feature (607)..(607): n is a, c, g, or t
aagaatgattactccaaatgcgtatatgtcacttttctcagtaaagcgntttgtggtgatgtattcaggagctaagtatcccattgcggcactaacttttagagctgagaaaacaacatcatctgcaagaagcttaggtagtccagcatccctgatcaatgggttaaactgatggtctaggagaacattttccactgaaatattctggtgaactattgtaggtttgctttcttctttgctatgaagatatccaatgcctggtcataaatgaataacaaatattaaacaaaaaaaaaaacaaaaattgaccaccatttttttttttttttttgaaagaccaaaaaatccttggattttaaaacctcccccctcatacatcctancaaaactcnttaanantaggtcgaccctacattttccctttttccagaaataatgtttttcagttttcctgaatttttgattnattaaacagcctcatttgtttgaccactaatatgggactttttagccccctccaatgaaggtcctttctttaaaatgattattgctggagtttttttgtctgtttaatgtaatttgcttaagggaaatanctgtttttttnttt

SEQ ID NO: 7528 - DNA, 535 bp, Glycine max
attttgtgtgccgaaatcggttgcctccaaggttaaaagagcagatcttggcttacatgtgcttaagatttaaggcagagagcttgaaccagcatcagcttattgaacagcttccgaagtcgatttgcaaaagcatctgccagcatttgttttttgcaactgtagagaaagtctatcttttcaaaggcgtctcaaaagaaattattttgtccctggtatgaaaaactaaactttattctaacaattatatgaacttaaaattaacagttaacatttgccgataaaaaaaataaaattgtatggacggacttaaatcaaccattgggcaattaaattgatgggataaattgttaatgtgcaggttgcaaaaatgaaggcagaatacataccacccagagaggatgttatcatgcaaaatgaagcaccagatgatgtttacataatagtctctggcgaagtggagatcctcgatactgaaacggagaaagaaagaattttagggactctacatactggggaaatgtttggagagttt

SEQ ID NO: 7529 - DNA, 412 bp, Glycine max
  misc_feature (407)..(407): n is a, c, g, or t
atatcaagaccaagactcgtcatttgtcatttacgaaattcaattcttcagtcttggacaactttgatgttgttggtagagcaaaatttctgagaactttcttgtccattatcaattttgaagctgctccattcaacaatgaggaggcacaatgtatcatagtgtcgaagcttatgtacttgagagttttatcatttcgtgacttccaaagtctggattctttgcctgattcaataggtaaattgatccatctgcgctatttagatctctctcgttcaagtatagaaacactgccaaagtcattgtgtaatttgtacaatctgcaaactttgaagttgtgtagttgcataaagctgactaagttgcctagtgacatgtgcaatcttgttaacttgcgtcatcaaaangagtt

SEQ ID NO: 7530 - DNA, 509 bp, Glycine max
gtcaagaactcctcgctggctcttccgactcctcaaaggacaaagccaaaaccaaagacatttttgacggaagcttaaattgctccatatgcatgcagttaccggagaggcccgtcacggtttatttctttcttttcttttattgatttctgaatagtcagtcagtgtttttactcatgatatctttcagacaccttgtgggcacaacttgtgtttgagatgtttcgagaagtgggtcggacaggggaagcgcacctgtgccaattgccgtgctcaaatcccggcgaagatggcgagtcagccgaggatcaactctcagctggcaatggccatccgattggcgaaggcggccaagtcgggagaagggtcctcgggcccacccaaggtgtaccactttgtccgcaaccaggaccgccccgataccgcattcaccacagagcgagccaagaagactgggaaagccaatgcttgcagtggtaagatttttgtgactgttcctcctgaccatt

SEQ ID NO: 7531 - DNA, 365 bp, Glycine max
aattcatgagcctcatggacagaaaacaggaacagaacatgcaatagaaatcaagtactctgatgaagaagaagaagaagaagaagaaggagaagaaagtataggagacataattttggaaggtgaaaaagaagaaaaagggaatgcagaatcagttttgacagaagagaataagaagctatatggagaaactggacaatttggtgctgaagatgaagacagggagtcagaaattgatgagtttctgattggagaaagtgttgaagaagaggttgtagaagaaccaaactgggtgttaagtactgaggagttgaacaaaaaatttgatgacttcattagaaagatgaaggaagatttgaggatcg

SEQ ID NO: 7532 - DNA, 756 bp, Glycine max
acctggtgttggaagactgctatttctgaagggtaagcacttaggtcttcacccttgctgtttcctatgattggatttcatttccatttgttgaacatcatttctgttaaaatcttttagaacttagaattaagcttaactagcaatgccgtttgttacacaggttatgatacaaattttatctaaaacatatggttttatacattatatgaaaaaagataatgaaattttattgaaaacatacaatatgtgtaaaattaatcttttaatgatatgtttcttaaataggttggcctaagtgataatttaaaatgatgacttttccagttttcccttctagtagtataaattataatgacagaaacaatattggctgtatgctcagtgcttagtttgagcatgaataccatagaaatatttaagtagccagagcttcgggcttttctgataactttattggaaaaaaatcaggttaactaattttattctcgcttgcaccttatttggattcttttgttagtattcctttgtttgctctgcatattgacctaattcttcctttgaaacagactggctcagagaatagtgcacggagatgttcctcaagctttgatgaaccgtagggtatgtgctttatccaaatgcttgggcaattcttgatagagctgaaaatggatgaaactggttttcaagtgtctgttcccgttttcaatttcactattataatctctgccagcttagtttaactgccatttt

SEQ ID NO: 7533 - DNA, 455 bp, Glycine max
ttagatatggcaccacatggagagttagatatggcaccacatggagagtctttctctaggaaaagcaacatgtcaaagccacaaaagctttcatctgagaaccttcaacgaacggtctcagacatctctttcgagctgaccaaggaagagatcgatgatttgaagctgccaacaatatctgaggttgagaatgcaaagtgtgagtgctgtggcatgtgcgaggagtgcacaccggagtacatagaccgtgtgcgtgagaagttcaacgggaagtgggtgtgtggattgtgtgctgaggctgtaaaggaagagttggagaaaaatggagggaaaaaggaagaagccgtaagtgcacacatgagtgcatgtgttaggttcaacaaatatggtagggctttcccggttctgttccaagcacaagctatgaaagaataccaagcacaagctatgaaaga

SEQ ID NO: 7534 - DNA, 421 bp, Glycine max
cctactttgtataaatggggttgtctttctaaacaaccccatcacatcattaagagggggggatcgatccttgatttgtgaatttgcttgcattagcaagatcatatatattcattcatatacacaattacatatcaagatcacattttttttggtgttcttgatctcataaacaacatggagggtcagaacaagaagtacatctcatctgaggagctgaaggagcacaacaagtcaggggatttgtggatttcaatccaagggaaggtttacaatgtttcagattgggcaaaggaccaccctggtggagaggttcccttgttgaaccttgcaggccaggatgtgactgatgcattcatagcataccatccaggctcagcatggaagtatcttgatcccttcagcctctccctatatgtgt

SEQ ID NO: 7535 - DNA, 473 bp, Glycine max
cttgaatcttttatgtcaactcggatgcaataacttttaaagcgattatacccctcattttatccaataacttttgttttagtagttgagctaaatgaatctggattttgttgtttctttctaaacagattctttctttattttcctttatcgtaagacattaattttgttcagttcaggtacaaattctggcttgtttaatttaaagcctaacaaatttgtctttcaggatgctttctaatagggagtcagccagacgctcaagaagaagaaagcaggctcatttaactgagctggagacacaggtgtgcatattttcttttcccgtctccataataattccctcaaagaattgtatattttcttacctaatattctatcttaggtctcccaattaagaagcgaaaattcttcattgttaaagcgcttcacggatgtgagccagaaatacagtaatgctgcagttgacaaca

SEQ ID NO: 7536 - DNA, 421 bp, Glycine max
tcgcaagacatagggagagagagagagagagagagagaagaggtggcaatcaaagatgctccgaacatgcacaagcaaacgcatacgcatgtgtggaagcggatcagagacagggaagctgggaaactgcatgcaagccatttcgccaaccgcataaaatggaatcgcatttcgcaactccaattatccaatcacaaagacatcgtctcacctcacaaaggcgccatcaactcccttcagattgattccacggagggaagatatttgctatccgccgcctccgatgcctcggtagcagtctacgacgtccaacgacccaccgtttacgaagccggcggcgtcatttcgaaacacagctctatatttgtcgttgacaagcagcaccagcaagcccataaatatgcggtgtccacagatataa

SEQ ID NO: 7537 - DNA, 757 bp, Glycine max
tcaatgacagacacaggcaaaacatctgataatcctccaatactaaactagagattcacaacctgtgtagcaggaaaattacaagacaaatcagagacttcttccttgatagattatgtcaatgggaataacctaaaattaaataccaaaatttgagccaccagtgtcactgagagaaagctaaacctttacgttttcacattgaataacctgagaataaataccaaaatttgaattagaaatataaaaaaattatcaagaacaaaactatgattaataaggcaatggtataagaatgatagagatactaatatatcggagctttacatattaacattaacattcatagctttaggtaatatataaggcaagtgcatatttttatccaacttctttcacaaatatttgcagcatgctagaaaattaaaaaaaaaaatactatatagcaattagcaaagagaaaatttggatgaccccaaaatggacaattttttcaaaccctaaataaaacattgaccttgttaaaacaataaacgtgtgattcatcaacatttaaagagttacagtaaacgctttaacgaaaattgtgtggaaattaagaaacaactattttgcttttgatatttacatacatggatttaattgtaggcatccatttgccatggcaatttaacgagctttgaatccattagtggtcctcaaccttgtgttagaaactggtaacttgtactgatccactatcaagttgatactacta

SEQ ID NO: 7538 - DNA, 364 bp, Glycine max
cgcctcctccgccgtctccggtggccaattcgccgccgctcaaagcccaaagtagtagtgatcaacaagctcggaaagaacgccccaaaagcccaaaccgaagcaagcacaaatttttccgccgcggttcatccgaacgcgcaattgggtactccgaaacccattcgggtcgcgaccttcaacgccgccctgttctccatggcaccggcgctcccaaaacccacgttcgaggaccaaaacggcatcgcttcgaagaaccccgaaaacctgaattcgcgatccaggtcgacgaaggagcgtcccagaagcatactgaaacaatcgcagtcagtgaagaacagagtaaatgacagcgacaacgtga

SEQ ID NO: 7539 - DNA, 370 bp, Glycine max
ttatttgattggggtgatataatactaaccatgtttctgttgtgctttcatgaattatccaaaagttagaagagggattggaatgttgttgcactttgtggttatgctggcaatgatgaatgaaccttttccagttacgggggactttaaccggtgtttttttattgagctcacttgtatgaaggttgtaaaggggtgcgattgatactgtgtcatagaagatgtgatgatccaattcacctttgtgttgttgaccttaattgcttggagtaaatccaaatgttctggctatttaagctgtttgtaagttttttttttatatactttttatatatattattattgtcatccaaaccaggaaaatgaaaaa

SEQ ID NO: 7540 - DNA, 207 bp, Glycine max
  misc_feature (156)..(156): n is a, c, g, or t
  misc_feature (197)..(197): n is a, c, g, or t
  misc_feature (200)..(200): n is a, c, g, or t
gaggttggttcctttctttatagcttattatattgcctacttcttttgttcatttattcaagatttgaagaaatttcactcataaagatggatatataaagttctcgtttagatctttcaactctcatggctaattttacaaaaaattaatatatnatgttaagtttcctaatttaactggtagctctctttaactnaantttgaca

SEQ ID NO: 7541 - DNA, 765 bp, Glycine max
tcagaaacccaagaatcaaatcaaaattgggtttcatttctctctttctctcccactgtagagctgctagctaggcttggttacttcaaaccctctctgcttttcttcacttttctgttttgtgacttttgtccactgattccaacattaaacaaaaattggtccaagttcatttgtatatgcaatatctggttcaacagtaaaaaggtctttaaattttatttatactatagtatcagagtagcctctgaagaactctgaatcaagagaaagaaaaacaaaggacaacttggaataccaaaacctcaattttgagtgagtgagttcattctttcttcttttttctttctctctgttctttccctgcttttgcggcttctcgccgcctttgccgttcggttctgcctttttctgcgccaattggtggcgcgcattaaagtggtgctccttttattttatataataaatatatattttgcacagttttcaagctccattcatcaacaacaacaacaaaaacaagtgtgtaacttaacttcattcattatctcattgcatttatagcttcctttgccatttccatggatagagaattcttaggcatattaacatttaagtgatttaacacatctctgccactgactctgctgaatagcattgaataacaaaggccatttctttagtttttgaagatagatagagtcaaagagagatcaaggggtagcttaaatttttcagcttttggagaaagagacatcactcacg

SEQ ID NO: 7542 - DNA, 636 bp, Glycine max
  misc_feature (511)..(511): n is a, c, g, or t
  misc_feature (513)..(516): n is a, c, g, or t
  misc_feature (541)..(541): n is a, c, g, or t
  misc_feature (544)..(544): n is a, c, g, or t
  misc_feature (577)..(585): n is a, c, g, or t
  misc_feature (588)..(589): n is a, c, g, or t
  misc_feature (631)..(631): n is a, c, g, or t
atctatccacttattatggttatatacatccttttggttgcaagcaatttctttgatagggtatttgattctcttgggagctggaagagatatgttttcgaaactgaaactgaagatatggatggttttgatccatcaggattaattatcttgcagaaaggtatgcaagctaaaaattctgtaattgtcaaaacttcagttcaaaatattaaatgaaaagtcatgtctaaattagtgaactttgttcaaatgtaggatttgttaattacttatgctgattatcaattcatataaatttgtagaaagatattggcttgagcaaggaggcaatgtaggcgagcaagttgttccactagtgaggaattttaatggaattgatgttgaatctagtgacaatattatggtatgtcaacgtcccactgaaaagaaaatggaagcaatcttctctcactattttcatttttcatgcaacattatcatgaattttatggctgcaagatatgacatttgntnnnnttcttgttgtggtcaaagttcaaanagntcactcactttatagctgatatggttcaggtgnnnnnnnnnggnngaaatgaagggaaattctgctttagttaataaagaaacaganggaaa

SEQ ID NO: 7543 - DNA, 418 bp, Glycine max
ctttcttgaaggtaccaataggaatgccaacaacatatggtgcacatggcgtggtctctactagaaaccttgaaagttgatagtgtttgtggactaagttttagagatgggaaatgcttttgtctgggttctcttctcaagatgtgcttattttagtacatctttactttctggtttatatttttctcttatgaactaacaggatcatatatttattttggatcagcaatcagctgaagaacttgcatttatgctacaagcagaggaacagcaaggttagcagtttgcaatatcaccaggacctgtttttcaccgattaatttccaagagtattgtggaatgtcatcgctaatacaaggaccttagaaattgtagttggctgatcagtggtgcagcagaataagatctgatcatgttg

SEQ ID NO: 7544 - DNA, 526 bp, Glycine max
  misc_feature (57)..(59): n is a, c, g, or t
cgaggttgagatgctgagaatgattctatgcataggagttctactacagaagctgannnatgtttttggagtcactcatgtctggtagcaagagcagttccccactcagtagtctcacattatcagaaggttaatgatgttttttttgtttgtttgttttctattttataaacataagtgtactgtcatgcattatcattcctcttcataatatcttttatatatactgtattgattatgttttgagatggtctgattttacgataaccatgatatgtatttttaggtttacaagggtttcttggtaatgattctggtaatttgggcccatcaggagtagatagcggaatcaacctttacttactggccaagaggatggcacttgaacgtcaaagatccttgcccaatgcttatccatactggccagggagggatgcagcaccccttccaccaaaatcagatatttttccagatgcatcgccacattcaaatatgttgtcttctttgagtgacaattctcgtcagc

SEQ ID NO: 7545 - DNA, 426 bp, Glycine max
aggcgtgttaattgaaagatagcgccaccgccatggctccatgaacaaatttttgttgctcagtttggtgttgcacataaatattgctgattgccaaactcaaatgtgatacaatacaagcctctaaaggtcagtcagtattcataagatcaattgatctggaaatcttaaaccttggaaaattttccccttccaataaatagcagatcagtgaattggttacgaatgtctggttggacgatcaagttatgccttgatgttatttttcagcaaagttaacctgccatatgagcggccgtgccctgccataatgtgatcatccaatataaggttcgtgaataaccgccatatctgacccgccgattccagtgtcttcttagtgacttctctggaacaatactgttgcaaagtaagcaatgcacttag

SEQ ID NO: 7546 - DNA, 833 bp, Glycine max
  misc_feature (773)..(775): n is a, c, g, or t
tgctcttttggcttctctctaccctgaattccaccctttccttcaattctcgcatcctcactctctccccaccatcgattggaccgacttcaacgccactcgccaactcacgcgcgtcttgctccatcatcgccacgctctcacctggttttctctctctctcatcacacagtaatactaacactatagtattattgagtgtatttgaatttgatgcatgcccatctccttgccaattgtttttctgttgtttgagccgtatgggcacatacccggtttagaatagccactttttatccatttttccttgcaaagctgtaatttttatgccaaacctgtgttataaaattttccacccaagattactgatggaatgcattttgtaggtggattcctgatggacacctctgtccaactgtgcccaacaggtgcaactacattcattggcttcaacatcttctctcatcaaacatcattcgaaacaccgtttcaagtgatggcaagttcaggggatttgacattggaactggagccagttgcatttacccccttcttggtgcttctcttcatggatggagttttgtaggatcaggtatattgtttttcaacaaaacttagatgcatctctttgattgattctggtgttattctcctataagaattagagtttctcataggttatcgttatcaagataaaattttaattttgatcagaaaacaatatagaaaaataattaagaactgtttggtaggctaattaatttctgcaaatnnngttgaaattgagatatagaattgcttacaaaattacaatgactgactgcagatgtgac

SEQ ID NO: 7547 - DNA, 779 bp, Glycine max
aatggcaggttgtagtcagaatgttaatggactaacaattgagaacaaattcaaaacaactttatgttgatgggtctgcctgcctaagttgctgttgcaaatccttcttcagagtcagcaaacaccttgttcagaatcatggctaatcgaattccaccttgagcaattcgtttcatgacaaatggcatccttgagtcgaagtaatcatctacaaaagcatcatatgtgcacaaagtcactacacagagtcctttaacttctaatgagtctactcatctcatgctgatatactaaaacctcaaactaatcaatgttggtgcagtttcatgaactagttatttagcatctaaaccggcaatcttgttagttctgtgactatatgtccttaaataattggtagaattgttcacctgctagagttgttccaggttgaactccttcgtaaccccatttgcaagctatttgtatgctctctttggcccaactacatgattccaaaaatgtgaggaatgtgaacattaacagccagagaaaaagagatggtgggaactgaaggtggaagagagggagagctcacttatttacacactgagagatatcattacaatgtttccaagatgtaacatcatctgaccagatcccctgaatagaagaaaattgattttgttgatttcatttggaatcaatcaaacgtgtttaataaatacaatgaagggtgtcagacaaattgtaattagtcttacatcagtgtagttcctctcaatgtcttggagaaggaa

SEQ ID NO: 7548 - DNA, 363 bp, Glycine max
atcaaaaactaaaaaaggggtgttgtgttgtgctattaaagttatcatgaatggctatacctgctctgggaaacatcatagatctggcccttgatggccatgaggagaggcttctcgggatcggagccgtcgtaggccttgagttcttcctcggtgacctcgccgatttgaacagggggtcgcagaggctccatctgaggctcgaagtcacgcgaggcggtgttgtggcggtggtcggaggaggaggggaagaggcccgaaacgacgtagtagagggccaggatgagggccagcagggtgaagaaggtgttcggagagagccccgtgtacgcttctatggcctccttcagtgtctcccatagt

SEQ ID NO: 7549 - DNA, 380 bp, Glycine max
tttggtgacttgcaccgaaatggtgccttgaattttgattgattttacgatgttaaattgcaggagagttgggacaacatatcaggcagtgcatatggcctctggagggtcgttacgctagcaattacttgtgtcttcttcattttcttattcttactaattgtaaatgtgagaagaagaacgtccaaagttaagaagtgaaagtaattaaatcataatatgtgagatcacagagtctaaaagattttagagaacagatattttagacaaagccatggtttgaattgaaccatcgatattctcatccccggtcgtatagcttatacagttaaactggattttgttctaagttttgtccattgatgagaaacccagttctt

SEQ ID NO: 7550 - DNA, 386 bp, Glycine max
  misc_feature (61)..(64): n is a, c, g, or t
  misc_feature (375)..(375): n is a, c, g, or t
tactactggaaaatatataaaagatcgttggggccatgcaggttctccataataattatcnnnnattcccttagccaatttagctcttaatacaggatcattcaagtcaggtttttttgttattgggataggtgaattcttatagatccatcctccgaaagaaccggatatgataatttttcatcatccggctcgagcactaatcaaagatttcgaatgtatctatagaaaaaatgtatgtgttattcacacatatatgaggattctatgtaagaaaataaactagattctctttttccgaagttacaaactattctttattgaaaaaaaaaaaaaattaattttttttaaaaaaaattttgaaaaacgctcaanacccaagaaaa

SEQ ID NO: 7551 - DNA, 401 bp, Glycine max
gggaggtaggacctgaggcactagaatcacaagagaggctggatagagtacttgatgaagagttttgggaagaactattgtttagtgagaaatttgagggtcgattagatattccaactgctgaagataaagatgaagatgttatcaaagtgttggccaatcaacttgatcttttggattcaagtcattaagtgccccactgaatcatttaaccctttccattccgttcactactaggttcaagacttcaagacctgccaaagtcaattataaaggaggcgcatacggtggagtcatattatataatgctataatctttggtgtttataattctagctaactctattatatgtccttttgtagcacatggtgaaaccccggattctcacttctctcacttc

SEQ ID NO: 7552 - DNA, 360 bp, Glycine max
gagggtggcagtggagggaaaaggacgaaaagcaaggggcaaaaagggaatgttgtaatcaacggcggcaacgagggtgttactgtggtggaacacgctggtggagattggaaccagatgcctggtggtcatggacatgggccacccaatgagagtcccccacggcatcagtacccaccgcactatcatgcgcccgcatctccagtatacactggaacctaccacacagcgtatcccactgtcacccgctacggtgctgcgtattatacgtccccgcaaccgtattcgtattctcacgtgtatcggtgcgttgggtccgagtcagactcagaaacttatacatcaccttcaccaccgtca

SEQ ID NO: 7553 - DNA, 771 bp, Glycine max
tagacactggccaagcatgttcaagtccaagccctgcagccctcaccaccaatggcagcatgacatcaacgcctccctcatctccactagctgccacagaagcccttactcttcaggttagtttaatttctcacactcatcaaaaaaatctctctcatcacactcaccttctacaacacgaaaccctttccagttatataattctaaccctacctatcataatcttcacattccatgcactttagttaatatcagtttgtatactttaggttaggtctcttctcttcgagtcacgacttaacgataagaacaattacatacataaaatataagtagctagctagacatcatatatatcatgcatgatttctaattaattaattgttatttatatgtacaaatatatgtgtcctttttttaaatgttgttgtgggttaatttttaaactttataggaggtggtggttgtgaagagagaagtccagagccaaagccaaggtggaaccctaaacctgagcaaatcagaatactggaggctatattcaactctggaatggtgaatcctccgagggatgagataaggaagataagggcacagttgcaagagtatggccaagtgggtgatgccaatgtcttctattggttccagaatcgcaagtcaaggagcaaacacaaacttcgccatctccaaaactcatcatcaaagaacatgaaccaccatcaccacatgaatgttgatcaacaaaatcatacaattcccactaattcttct

SEQ ID NO: 7554 - DNA, 761 bp, Glycine max
  misc_feature (754)..(756): n is a, c, g, or t
gagagcaaaaggggtaatggaaaatctcttagttggcaaggtgatgaaacaagtcctgagtgctggggagagtttgttgaagtatgagatccctgcggttataaaaggtatgctagtgaagcaaatgcaacacaacctttgaattcgccaaaaacaacatccattcacttgttcctttttgtatggttccaggggataaattttgttggttgcgggacaatgaatttgcaagacagaccttagctggggtcaatccagtgaatattgagctgttgaaggtagtttttcatacctgtataggaagaaattattgtgtggtactgtccatagttcggtcaatttccacgtaacacgccaccaaactcatcaatttacgacaaattaattatgtattacgtggagattgtctgataacatggtaatcctagatcatgtaataatttctccaatttaggaggttataggagtattagtttgttttctttgtcatttctttagcagttctctctgttttccataggaatttcccatccgcagcaagctagatccttctctctatggcccttctgaatcagcaataacaaaggaacttctagagcaagaacttggtggaatgaacttggaacaggttttctctattttctgttgttacttgagcttgacctatttatctcccagaaatttgttagctctgctaccatttatttttatgttggcaggctattgaggaaaagagactgtttatccttgatannnatgat

SEQ ID NO: 7555 - DNA, 322 bp, Glycine max
atcatttttaccctttacaaatgttgctagtttcttttatcaatgaatgaccctagctcttaatgttctccttaattccttgtaaccgtcaaattcaattttgtaacatatatgattattattattattattattttaaaaaatgttttctatctgccgaattcaatgataccctcaatgtgtctgaaaatttcagaactctggcaattcgattgactcccctgatttgatgaatatgtcataccagaaatccatgccatcatgatcatcgtttgaaccattataatcaacactttgttgttggaagctttccactaaataa

SEQ ID NO: 7556 - DNA, 679 bp, Glycine max
ttttttattgtgtgacttcagccaaaggtgctgctgaaaccctcaagttcaacatggctttgatccttttaccagtttgcagaaacaccatcacttggctcagaagtaagaccaagttaggcatggctgttccctttgatgacaacatcaactttcacaaggtacatatgtgtgtgtatatatatatatatacatgcatcaatggagatattattaattattaaatgatttttgaatagacgattactatcttctcgatcaatcttcacatgacacatgtgtttaataattatggatattgattaagattatgtatagtgctaattgtttaataattattttatgcaataatttactcttaaaacttttttttatttttaattaattagctaaatatgcatgactttggtttctataggtgatagcttttggcattgcaattggggttgggatacatgcaattgcacatttaacgtgtgacttcccaaggttgttgcacgcaacggacgaggaatatgagcccatgaagccattttttggagaagacaggcccaacaattattggtggttcgtgaagggaaccgagggttggaccggaatagccattgtggtgcttatggcaatagcctacactttggctcaaccttggttccgacgaaacaggcttaacctccctaaa

SEQ ID NO: 7557 - DNA, 615 bp, Glycine max
  misc_feature (59)..(62): n is a, c, g, or t
  misc_feature (65)..(65): n is a, c, g, or t
  misc_feature (600)..(600): n is a, c, g, or t
cgtcctcgggatcatcaccattctcagcttccttctggatctggcattgtcaggaactnnnnttnaggcacttcatcctctaaatctgctaagtcatccatttgctgatattctacttgagaggaattcatggaatcaacacgatattccctgccagtacaaattcaattcaaccaccaatcaaattagtccatagaaaaggctgagataactgtatcggtatatttctaattccactttgctttatagatattactgcattatgttagatatgaagacagacagaatatactatatcgacttggtcatctcttcagaaacaatctgcttgaccccactacaattgaacagaaaaatagaaaagtagtaataacttatgttttatacaccaacaaggcaacaagtgtttagtccaaggggcaccgggactaggtttcttaagcacgtggtcaagggttcaaatcctgtacaccaacagaaaaaaccttattgggaggggagcagctcacctaagagtgccaacagatcccccgaaggagattaaaaatctaggtgattatgctcctttgcaatcatatgcaccaccaaaaaattgatctntatttccataaagcc

SEQ ID NO: 7558 - DNA, 630 bp, Glycine max
cagaacaaactcatcaaagaacggaaagtaagtgcttttttgtttccaagaaatgctagcaatactctatttaatacagttttagacacactattattgattgaaatttattcaaaagtacaacataaattttaatttttaaccaataatagtgttaaaatgaatgtattgctagcgctcttcttttgtttcctctcccctctaaggtcaatttctcttaacaacactatcatcattttctgcagccatatcttcatgagtcccgccatctacatgcactgaagagagctagaggttccggtggacgctttttgaatgccaaaaagctccaagagttgaaactcacttcagcaaaccgtggcctagatgtttctggctgtactcaattgaatctgagtggaaatatgtcagaatcaaaggttcaagcagtagaaaacttgaactacagaaatggtgcttctacaaccacgtgttctgatgtcattagtacatctaatagtgatgatgtcttccagcaacatgagtcagactttaggttatgtggttacccttctcatattggaaggaacatgcagggttattccgcagacattggtggtggtggtggtggtggaaatcaacaccgtctat

SEQ ID NO: 7559 - DNA, 377 bp, Glycine max
cttctctaggttttatgcgactgaatgtcgatggagcgtgtggaggggttatcggagatcatacaggaaagtttcaaggagcttttgcttgcaacctgaaatcttgctcaattactcaattggagttgtgggccattcttcatggtatcaacatggcaagggaacgaggttttatggcgttggaagttcattcggattctgaagaagctattcaaagagttcaaggtttacaagtttctcacaatcttgacaagaatattgtggactctataaagacaagaatagcagccagagattggaaaatgatgcatactaataaattcaaaattcatgaatgaaaatttcatggaaatttatctatggctgccagtgacaaa

SEQ ID NO: 7560 - DNA, 581 bp, Glycine max
acctcgtcctccaattatgaagagaacaacaagcatgtccgaaataaccttcgatctgaacacgaccttggacgatgatccgaacaatcccgtgaagggaccaggaggaaatcagaacagggtttgggccatggtttcacccagaaaccattccgaggatactacccctgacttcttgcgcgtttgctttctctgcaaacgccgtttagtacccgcccgagacatcttcatgtacaagtaattatttttacccttctctgccttaacaaggattccattcggtgccttcgatgtgtcttttaatttatgttttgttgatattggacataagcttagttttggtgtctaggcaattttcattaattgttgttaatttggattggaagggtcagcattaattgaaaattattgcagaggtgatagtgctttctgtagttcagaatgccgtgaacagctgatgaagcaggatgagagaaaagataagtatcgtgtgggatcaaagaaacaagttgcggaaaagcctaattctgggtctcaagttaacaaaggcgaaaccgtggttgccttgtaactaattgtgg

SEQ ID NO: 7561 - DNA, 562 bp, Glycine max
aatgtagtagccttacaaacatgttaaactatatagtaggagtttaatttttataatctgttagtgtaaagatttatattatcaactatttgttttttttgttaccatgttattcgtatggagtatctacggactaattttttccagagaatctgacagaccacctttagtggaattctcttttcccaatcacgtttttcctatctacaagatttcaattcaaaatcctatttaaggagattgagttcagtatccttcggactaattattttttggtacattatcaactaattataaactaacttagatatgacttttaaaataattgttacaaaaataaataatcttattatatatcactatctatgattagctgaaagaaaatccatgcattctaattaaattcatatagtgaatccaagtacattatctgctttttgttgtaacaatgaacatgcatttgctatcataggtttttgcattgaggcggagaagaagggcaaatgagagaactgaaacgtatgtgctactagaaccagggcaggatgagagatttgtttct

SEQ ID NO: 7562 - DNA, 411 bp, Glycine max
tgagacaggagattcattgcttcatgtggcagcagataaggggaaagaaaagattgtagagttgatttgttgtcactttcctgagcttcttattaggagaaatgtaagaggtggcactccacttcatgttgctgtgaggtccaagaactctactatggtcaacctcattctctcccaatatgcatcaatgaagtcaacacatgatgtgatgaaagacaaagagataacaagagagaaagatgaacttggggatactcctttgcatgaggctgtcaataatggagatctaagtgtgcttcaagtcattttacatagagataaggatatggtccatgaattgaacaagtctaggtgttcaccactgtttttggcagctgcgagtggcaatgtggcaatcgtgaatcttctatt

SEQ ID NO: 7563 - DNA, 544 bp, Glycine max
  misc_feature (287)..(287): n is a, c, g, or t
  misc_feature (311)..(311): n is a, c, g, or t
  misc_feature (315)..(316): n is a, c, g, or t
  misc_feature (318)..(319): n is a, c, g, or t
  misc_feature (331)..(331): n is a, c, g, or t
  misc_feature (343)..(343): n is a, c, g, or t
  misc_feature (350)..(350): n is a, c, g, or t
  misc_feature (356)..(356): n is a, c, g, or t
  misc_feature (360)..(360): n is a, c, g, or t
  misc_feature (368)..(369): n is a, c, g, or t
  misc_feature (376)..(376): n is a, c, g, or t
  misc_feature (381)..(381): n is a, c, g, or t
  misc_feature (383)..(386): n is a, c, g, or t
  misc_feature (388)..(390): n is a, c, g, or t
  misc_feature (418)..(418): n is a, c, g, or t
  misc_feature (422)..(422): n is a, c, g, or t
  misc_feature (425)..(426): n is a, c, g, or t
  misc_feature (428)..(428): n is a, c, g, or t
  misc_feature (441)..(441): n is a, c, g, or t
  misc_feature (443)..(443): n is a, c, g, or t
  misc_feature (448)..(449): n is a, c, g, or t
  misc_feature (451)..(453): n is a, c, g, or t
  misc_feature (457)..(457): n is a, c, g, or t
  misc_feature (462)..(464): n is a, c, g, or t
  misc_feature (466)..(466): n is a, c, g, or t
  misc_feature (469)..(469): n is a, c, g, or t
  misc_feature (473)..(473): n is a, c, g, or t
  misc_feature (478)..(478): n is a, c, g, or t
  misc_feature (480)..(482): n is a, c, g, or t
  misc_feature (485)..(485): n is a, c, g, or t
  misc_feature (487)..(487): n is a, c, g, or t
  misc_feature (490)..(490): n is a, c, g, or t
  misc_feature (501)..(504): n is a, c, g, or t
  misc_feature (533)..(533): n is a, c, g, or t
  misc_feature (537)..(537): n is a, c, g, or t
  misc_feature (539)..(539): n is a, c, g, or t
  misc_feature (541)..(541): n is a, c, g, or t
actaggtttctcctgccagaggggttcacacaaagtgttctaccaaaaacaccatttcttctactgttggagtcggaacacaaaaacaaagacgcttgagatgtagacttattacaatttgaatggcaatcaacatagccaggattttggatatcagaacaaaacctgaaaataaagagtgacaaagcattttagttagcaaactctacttacaagtgataaatccgaagccagtgtttgctgcaggtagacattcacaaaaagaaagaaaaaaaaaaaaaaaaacnttattgaatttaaaaaaaaggggngaanncnntttttttttttnaaaaaaaacccnaaaaaanattttnttgnaaaaacgnncaaaaanaaatntnnnngnnnccttttaaacccaaaaaaagcaggggcncccnttnncnccccccccggggnangcccnnannngggnccccnnnanaantttnaaaancnnnatntnganaaaggggcccnnnnccccccctttctttaaaaaactttttttntttncncnccc

SEQ ID NO: 7564 - DNA, 422 bp, Glycine max
gtcccacctctacgtcctcggtgggtccctcttcgacacgcgctccttccccatcgatcgcccctcgccgtcctccgccacgttccgcttcagcttccacgacttttcgtgggagccacgcgcccagatgctgtctccgagggggagcttcgcctgcgcggtggtgccggcccgcgggagcatttatgtggccggtgggggctcgaggcatacgatgttcggggcggcggggtcgaggattcggtcggtggagcggtacgaggtggggagggaccggtgggtgccgatggagaatctccccgggtttcgtgccgggtgcgtggggtttgtcggagaggaggggagggagttctgggtgatgggagggtatggcgcgtcgaggaccatatcgggggtgtttccggtggatgagtattataggg

SEQ ID NO: 7565 - DNA, 611 bp, Glycine max
  misc_feature (593)..(600): n is a, c, g, or t
tgttgggatgagagagaatatttgaacactgaacattatgtctccaaacatgtgctatatggcaagggcagctaagtcaacatgaagttgcatttgtcatagcctgcgcaaaaccgtggatttgagagagagaaaaagaaaaagggtcagtgtacagcaagtagcactagcccacaggttcaaattgaagccataaaacgacgacctaaagtgaaatatgtactgaaaacaagtgacgcgtttttgtcatcaaagcaaagcaagcatgggatgtgaaatacgcgacaaatacttagatttatctactcaatttatatttatatgaaactatttagattttcctaatgctacttaattacatattgttcgttaattaatcttttcatttttacgtaattatctctaattaaggtataacatgcttttagtgcgaaaactttcgagtcgcctaattaatgaaaatgtacaaattaagtgacgttaaagggatcccaagtaaaatttttaagaaaaagaagaataaaaaaacattgtgtacaaatgatttagtttcgatgacaccatattgtcacaacaacatctactttcaatannnnnnnntattatactaa

SEQ ID NO: 7566 - DNA, 396 bp, Glycine max
tctcaatcctctctccaattcctaagtgggtcccaacccaattcggatttcgtttctgggtttccccaattcgaagctctgcactttcccctttgaagtggaattttttttcgttcctgtgaagttccattccatattctgggaatgggtctataaaacaagcttccaaattggagagaaagtcccaaacttttcggttcaattttgagttttcgcaattgggtctgtgatcttcttgtgtgggtgagcaaggtttgaaaaaactttctgtgatcgtgattttggccccaacttcaattgtggctgcatccgctgtaatttgttcacaattttccgcaatatcaaaggatcgtgacgacgaaaccacaactgcaaccgcaatttaaacctagtgtg

SEQ ID NO: 7567 - DNA, 745 bp, Glycine max
ctctcaaaggctcacaatctcctcttcggttatgtcttgcgggagggtggacaagtggatcatctttgttggagagcagcaataccggtagttcttagcagcattacgattgaatcgattgagatttgaattggcgtactcgtgtgtatcagcaccttgggttatgtttgcatgctttgaatagttgacctccaatcgctttccaaacaacatggctccctatatttcaaattgacaaggttttagtgaccagttcaaaactagagcagaaaaaatacataacgattaatctgcatgccacaatgaaaatatatgcagaataaataatataacctagtactcctatttatactaacatttaggtcaagtactagtagtaaaaccataattataaaaatagtaaaaccataatatatcttcaggcacaattataacaaacaacaataacctttcacattagtaaagatatcacatgatccagcataaggtgtacaagaaacaaaccttcagaaaatgtactgccaattcagcttgaaaaccatctcccatctggataagtgcatgatctggcttatttcggagaagtttaattctgacaatgttcccataaatggagaacaagttgaacattttatcctcatctattctctggaaaaaaattcaagccaaatatatttaataaaaatggagagaactttctagaaaaaaggcagaaatatcaaggcagcatactcacatcgggatt

SEQ ID NO: 7568 - DNA, 403 bp, Glycine max
ggcctcagcacaatccaaaggtgcctactttttttgtcccttaatttcttgattttactgttatattcaacatctctcatcaataatttcatgagaattattcgcatagatattattagagttgatatttgtggaaatttttttaaagatgatatttggggaattagacaatataacacctatgttttttctttattttattttctaaggtgagtgggaccttgttgtaatttgttttcgctgtcacatttattgtttttcattttcttttgttacgagtgtggctatttgttccaatcatggggatttttgcttataacaattccatgtgatttacagtattttttctttgttgtgattatctgcatttattgaaaatggctctcattgatatgtctgttca

SEQ ID NO: 7569 - DNA, 463 bp, Glycine max
aatcttagaccctatttttcagcattagaagcatccaggatttcaatcattgatctctcccaaaatttcacgtcttccttgtggtgccttgaataacttgtcgacatccttcagtgtaagaaaacaaagaaccaaccagttattccaatcttttaccacatggatccctcccatgtaaggagataaactggtagttttaaggagggcctggatgcatataaatgtcagttcggaaaggactctgagaaagtacggaagtggaagtcagctttgtctaaagtggccagttgtctggatggtgttttggatgtagacgcaggtatggctttttttttttaatttagctagtaccgcttcttaatttgggaaaactaaacaaaaaaatgaataataattttttgtaggctttcaatacgggtttacacgttgaaaaaaaaaaaaaacacaggaaaaacaagaatta

SEQ ID NO: 7570 - DNA, 350 bp, Glycine max
caaaatactatttctgatacgaattttgacttgtctgtcagttggctaagcactagattttctcataataactggtggcaagaggtcattgcatctgtatggtcacttctattttctgatgccttggatgctgttaagtgttaacttgtcagtgactcttaaagacaaaccacctatcttttgtgggccacacacagtaatgatttagatgcttgatttctgctctttagtcaatctgcttcaaagttcttatttgaagtatggatttcttttgtttgttttatttcttggtgtgtagtttatgatcaagctggtcaatactatccttttggctataaggatctcttatt

SEQ ID NO: 7571 - DNA, 339 bp, Glycine max
caagtgcatcagtgtttgaacagagtccacatggatatgaaactccattggattcaaagtgaagaaattttgaacacttacacgtcctctgcaccttttatatatatcaaaacacttaggacttttgaatccaaaaaattcaccgaaacaccaaaacaataaatcgggcggagaaaaataaggaaaaacaaaaacgaaatgtagacgaggaacaatcgattcgccaatcacagaaagggcgaccgaaacgatgactcgcccaataggtttgttatacctcaatgttcaaacgatggcagagacactttcaacagtctcgtcactctcatagaaaccatc

SEQ ID NO: 7572 - DNA, 611 bp, Glycine max
  misc_feature (564)..(564): n is a, c, g, or t
taatttacgtggccttggcatctttaaggtaccagtagtgtagccttttcgttctttctttatttttgataaaagaaaaaacacattggaagggatgtttcaacagttgtcgcccccaattgcagatgaaggaaaatgaattagttctaacccatcatgttggcgaagtaatcaatattctgcagatgaccacccatcacctatttgatccagacgatctattgacagtaagataacttttactatttcctatcttaacatccttcctttccatgttatcacaagaagaaaaccatttgaaggtgcatgcatttgttgaattaaactttccttatgtttttgcaggtggcatttgacaagataggttccatgacaacaaataccatatcaaagcaaagaaagaagcaagaacctgaagtgatgaaggagcttgatcagaggatcagaaggctaaattcccttagaatggaggacaaatagcatttgcttttttgtcttttggtttttttttgttttttttttgggaacccacgttgcttccaaagtctaaatgtcgtcctccantgcctcgagcaaaatgcaaaattatgcattaccttaaattcttcccc

SEQ ID NO: 7573 - DNA, 736 bp, Glycine max
acgttcaaagaatgagccaccgctgtgtccagactctgatgatcctaatgcagcatggtattttatcattaactgacttttttcttcttcaaccaaaacagaaaagaaagagtttttgacttagttaattgctgaagtaatctttgactgtgacattatgagaaagccttaaaataaagtggcatattcattttatatccccctgccttctctctaaagtttcattatacatacatgcaatctaatctcttcggtgtgacaggaacattaaattgcaagcttgcatgcacaaagtgccagctagttcaaaggaacgaggctcaaaattgcctgagctgtggccagccagactgaccaaagtgccttattggttgttgagttcccaagttggagtttatggaaagccagcccctgaagatttcactgctgattatgaacactggaaacgtgtagtgtcccagtcttatctagatgggatgggaattaaatggtcaaatgtgcgcaatgtcatggatatgaggtctatctatggagggtgagctaaagtcactgttttgattttcgattgttactctgacttatatttgcacttgctaatatgtcctttgtttgacatctttcaccgtttgtggtttccagatttgctgcagctttgagagatttgaatgtttgggtcatgaatgtggttacaatagactcccctgatactcttcccattatttttgaacgaggtctg

SEQ ID NO: 7574 - DNA, 380 bp, Glycine max
catgctgtttttgttgccaaaaaagaacatgtctttggcaagaaaatgtttggtaacaaggctgtgttttgtgacaatggtcagattcatgatcttgtcatagaatgtgacacctctggggtgtctgatccgtgccttataattcgaatcgatagcaaaaccgtgatgcaggtgaagcggctcaagtggaagtttagggggaaccacaccatcttggtggatggtcttgcagtggaagttttctgggatgtctataattggctctttggtggaacatcgcttggaaatgctgtctttatgttcagaacatgtatctctgcggaaaaattgtgggctggtgaacccctttctgatgcaaatgtggtgcagtggtccttctc

SEQ ID NO: 7575 - DNA, 443 bp, Glycine max
atcttgttcatggaacgaattaagaacttaattgaaattacccgttgataatatatatggtgttcatatttaatttcaggtgcttaacatccctaccaagattaataagggtactgtggaaattatcacccctgtggaactcattatgaagggagacaaggttggctcttctgaagctgctttgctttccaagcttgcgataaggcccttctcatatgggcttgctgtcgtttctgtttatgagaatggttcagtttttagccctgaggttcttgatctcactgaagatgacctcgttgtgaagtttgctgagggtgtctgtatggtgtcttcactttccttggctatctcctacccatccattgcagctgctccacacatgtttgtcaattcctacaagaacatcctggctgttgcagtggcaaccgaatattcgttccctg

SEQ ID NO: 7576 - DNA, 719 bp, Glycine max
  misc_feature (350)..(354): n is a, c, g, or t
  misc_feature (366)..(369): n is a, c, g, or t
  misc_feature (389)..(390): n is a, c, g, or t
  misc_feature (455)..(470): n is a, c, g, or t
  misc_feature (472)..(474): n is a, c, g, or t
  misc_feature (479)..(487): n is a, c, g, or t
  misc_feature (499)..(503): n is a, c, g, or t
  misc_feature (505)..(508): n is a, c, g, or t
  misc_feature (515)..(519): n is a, c, g, or t
  misc_feature (553)..(554): n is a, c, g, or t
  misc_feature (556)..(557): n is a, c, g, or t
  misc_feature (559)..(561): n is a, c, g, or t
  misc_feature (564)..(577): n is a, c, g, or t
  misc_feature (593)..(598): n is a, c, g, or t
  misc_feature (609)..(613): n is a, c, g, or t
  misc_feature (616)..(625): n is a, c, g, or t
  misc_feature (648)..(648): n is a, c, g, or t
  misc_feature (655)..(659): n is a, c, g, or t
  misc_feature (667)..(687): n is a, c, g, or t
  misc_feature (692)..(702): n is a, c, g, or t
  misc_feature (709)..(710): n is a, c, g, or t
  misc_feature (712)..(712): n is a, c, g, or t
gggtttgcccgagggggattttcccctacgaggtcgatgagtatggaggggtttttcaagacaaaattgttgcggatgaagctgtttctgttaagaagcatcattggacttgggttagtgctgattccatgcacacttgattcatatcaaacttgttttatttttttttatagtgagtttaagctgacatttttttcctgggttatgttggaagtttttattatggatgaaatattgataccattaccaacagtttttttttttttttttatttgttttatatttttaaggaaaaagggggggggaaattataaaaggaaactgcctcttttttgaatttgatgcaaaannnnncccaaaaaaccnnnntaccctaaaattaaaaaccnnggtaaaaaaaaaaaaaagtgggggggggggggtatatatttttcctctaaaaaaaaaatccacannnnnnnnnnnnnnnngnnnttttnnnnnnnnnaaaaaaaaaaannnnntnnnnttttttnnnnngggggggggggacaccccaccccagggggggggnntnntnnnaannnnnnnnnnnnnncccccctttttttttnnnnnnccccccccccnnnnnccnnnnnnnnnnaaaaaaaaaaaccccctccctcnccccccnnnnnccatctcnnnnnnnnnnnnnnnnnnnnngcccnnnnnnnnnnnacaaaanntncctcccc

SEQ ID NO: 7577 - DNA, 671 bp, Glycine max
  misc_feature (11)..(12): n is a, c, g, or t
  misc_feature (60)..(62): n is a, c, g, or t
  misc_feature (292)..(292): n is a, c, g, or t
  misc_feature (296)..(296): n is a, c, g, or t
  misc_feature (312)..(312): n is a, c, g, or t
  misc_feature (316)..(316): n is a, c, g, or t
  misc_feature (324)..(324): n is a, c, g, or t
  misc_feature (326)..(326): n is a, c, g, or t
  misc_feature (360)..(360): n is a, c, g, or t
  misc_feature (363)..(363): n is a, c, g, or t
  misc_feature (365)..(365): n is a, c, g, or t
  misc_feature (372)..(372): n is a, c, g, or t
  misc_feature (377)..(377): n is a, c, g, or t
  misc_feature (379)..(382): n is a, c, g, or t
  misc_feature (386)..(386): n is a, c, g, or t
  misc_feature (389)..(389): n is a, c, g, or t
  misc_feature (393)..(393): n is a, c, g, or t
  misc_feature (412)..(413): n is a, c, g, or t
  misc_feature (429)..(429): n is a, c, g, or t
  misc_feature (603)..(603): n is a, c, g, or t
  misc_feature (635)..(635): n is a, c, g, or t
  misc_feature (658)..(658): n is a, c, g, or t
  misc_feature (661)..(662): n is a, c, g, or t
  misc_feature (664)..(664): n is a, c, g, or t
gctttagatcnnctgggtcttgaccgcaaaaggttagtgtcatctgaatttcttcaagcnnnttactattggcattttacatcatacttatgtgcatatcaacaactgattatggcatctaaaattcaaattaatataatgtctgcttgatcttctacaggttagggcgatatgcagttgagtcttacttggagcagattttatcacatggattcttccatgctgaccctgtgcgttcttgttctttgaattgctgagtggtttttgagttgtctctcatcttatggttgtntganttttctctgtgtttcncttntcaacccnanacagaattttagagactcttttggatatgtctantancnggaaatngtatngnnnngccnacntgtnatgtgtcactatctttgannttgctctctatactgnaaccttcaagcatctgttacccgaggtacaagaaacaatgctgcttgtgccatatagattatcatctgttgtcttgggaagcttccctagggcttattcacaagggcattagattagaagtaacttccttaccatgataaggaatagtgactgataagcatccaaaacactatnttaggaactcattaaaatattgccatggcatntcttttttcctttctctgggganganncngtgttaa

SEQ ID NO: 7578 - DNA, 678 bp, Glycine max
  misc_feature (641)..(642): n is a, c, g, or t
ctgtcttctggaggatattacctcgcaactttcctccaccaaggtaagtatacaatgtaacaccaatcaacaaatacaaataatcaatgaattagtgaccaaattcaataacaaaaatcacatcacttgtttagtgacattttttttaaattacatataaactattctgtcattaattttaatttttgttacaataagtttttctgcttggactggttgatgctttaaatgagagagatttttgggtttattttatgtctgtagccttataattgatgttttacaggtgggaatttggaggaactgctcttgatctctccaaaggaaataaaaggaactggtaatggtaattttgtatgcaactatgacaaaacaaatccatgtctcatgtctggtttcaatagttcttttttgaccaaccgaaaagaggtttccttggttaggatccttgtctgggaagatgggttctgcgattttaacgaatgcgagcaaaggaagagtggtagtggttacttgaacggtagatttggagctgacgtattcttcaaaatgtcgcatgaggtttacaattatggagaggggtaagcgttgacattacatttacattttcttgccataagaagattcattatcttttcctnngttttcctaaagtagcattgcaaaattcaagtgaag

SEQ ID NO: 7579 - DNA, 726 bp, Glycine max
gcaatcatgaagctcgataccaccggtctcgaatcgtttcccacactgcttgcgcctcaaaacgacgtcgttggagaactctccgccgctccatccttcgaccttccgaattccaacgatgtgagtaccctcaagttttgaatttcacgatttctgaaactgttcgaacgaaaatcagaagaaaaaaaattgggttgaaattggtttctcaaattgcgggggggatgggaataaaaagctagggttttgttagagaagggttgaagatttatcatggttttaactgaagtgctgtgtgtgtttgtggtgatagttcgatgggtttgtgaaagaagctattcagatggtgaagcccgcgaagggtactacgactcttgcttttatatttaaggagggtgttatggtagctgctgattctcgagctagcatgggaggatatatatgtgagtgtttgttaattttaactttaatttcactattctttgttcctttggtgaatgctgagtttttatgttacttgttacttttatctatttgtggttgtgtctttgttcttgaattttgagtgttggctgtctccagcatcgcagtctgtgaagaagattattgaaattaatccgtatatgcttgggacaatggctggaggtgctgctgattgtcagttttggcacaggaatcttgggatcaaggtaatctatgcaaccttgaaccttgtatattgcatgg

SEQ ID NO: 7580 - DNA, 637 bp, Glycine max
atttcatttttttttattttttttttatttagttacttactcctcacactttctctatcgttttcatctctgtttcaaatctgagctctcgtatattccccagccatggccgaaaaggtataccatgtagctaggatatgcgttcattcttaattatcctaatcatcatattctcttctccaaatttattaattcaatactctttcgctcactttgatatataagtatttcattttttgtgttcattgttatgtgctgctgcttctatcacatgcaattgaattctatgaccagtattatatatatgcgcaatcttcaagttttgatcaacatttctcttgataatcgattgatcaggtcaccataatgaggctcaaggttgatcttcagtgccacaaatgctacaagaaggtcaagaagattctctgcaaattccctcgtgagttctcaatcaattacaactttagttttattgctctggtgctgcaggaaacttaattgcatgcgatatatataactcacaaaaattcaagtaatatacatatgtatagtgctaaatgaaaagagaatcaaattgagttgattttttttgggtgatgaatatttttgtgaacaagagaaatccgagaccaggtgt

SEQ ID NO: 7581 - DNA, 411 bp, Glycine max
ggtatctccaaatcaatgataaaaaaaaggcatagatttttcgcaggaatgttgagtcacttcgccttcgtctgttttctccaggcgcagtgaatgattagactgctaaatcaactttttcattttttaatcttcaaaactttcgattttaaatgtaattactttttctaccatgtctctgtttttttctttcttctttttagacttgtgggatcctatgatggcatgaaatctttgagacctgattgtctaacttgatgacaaccataagcataatcgctgaggatcttaaccaaaccttagtagtttgtctttttttctgtggggaggggtctgttattatatgtagcattgtaatttgggataaagaggcaaaaggaaatagatgtgaatgatgaaataagcactggg

SEQ ID NO: 7582 - DNA, 454 bp, Glycine max
  misc_feature (435)..(436): n is a, c, g, or t
attttgatgtgtgcacaaggaaccctcctttgactttccgtgccggaggactgaagcatgggctggaaaatgattcctattttcttgatgcattcttttgttaattgcacactggcagcgagtaatgagtgactcattggttgccttgatcttaaactgtttggatggtgactcttgctgcaactgattgtcttgattttttactgattggaaggggaacatctgttggtactgccagattgggggtgcagctctcaccttgtgcgtcgtagtaattcatttagacaacagagaatttgtacaggttgtggagagggggaggggagaggtacaagcttgtgcaacttgtttttctttttttgctgaaagctgagctgctctttctaattgagaatgggaatttgtaagtgaaactgtggtctttgcaactcaaanntgtggtctttgcaactca

SEQ ID NO: 7583 - DNA, 552 bp, Glycine max
tattactgaaaatatcgtgcaaagatattgttttacacattgaggtaattacttggaagtttaaacatattcatttcaaaaacttagaaatgcactaattaaatttactctaacattgtctcaagggtccatatgctcaggagttaccagcactactgtatgatctaaatggattggacctattatttttagtagacacaagaattgaaggatcagctacatcaagtagcaatgttagcgatcatgatgggtactctgtgtctgaaatatgtcatgagaaggagattttgagaatgctccagagaggggaacactatttccaatttgatgaggttacctatatttttgtgctatatatgtatatattccttactagttgcactatatatatatatatatatatattccttaccagttgcactatacaattactaacttataagacaatgatttttaggggcaagctaaacgtgctctctgtctatctgtcaaggaaaacaaattgaaggtaaccaaacaacatcatgctcctggttgtattgattgagatgg

SEQ ID NO: 7584 - DNA, 780 bp, Glycine max
agtcagaacagttagttacctcttcataacatcaaggtatatcttggattcaatttattttgttctagaatttacttgttttttcctttcctatttttgaatagcatttcattttgtgcatatctttttggttagccattaatagcatatcattcttccatgcgtttctttaggacataacgcatcactgaaattaaaatattattctttcaagtttcacagtttcatctgtcatttctttaggaaaaggcaatatacacaagtgtctaccactgatgcaattgattgcatattatgataaattgggaatattacataagtcaagataacaaaatatcctgatataatgcacattaatgcataatttcaatttctactacatatgatgttattatctccttatctcctgaagcagtttggaggaattccccattgcattggcatctactattgaagtgtttgatgaaatgatggagctagaagatataaaactaaagaccgtcttggagtcctatggacaaatggatttggccagaaagggtcctttccgagccttacaaatagtttccatactcatatttaccctaaagaatctgattgataaacatgagaaagatgaatcaaaagacaaaaatgattgtcagcaacttgtgctgattcaactggcattagctgctgcattcattttcatgggccgttttgttgaaagatgccagaagtctagtcctttgaattattgccccttattgccttctgtacttgttttcgtggagtggtgtg

SEQ ID NO: 7585 - DNA, 747 bp, Glycine max
gagcagcttcatgtatgcttctccacatttctattctgatatttttttcattgctctgtttttaatttgttaatttaatcagtctccctctaaatatgcttaatactaatgcaggggtattttatggctctatcagcggcaacctggaaatggtacaataaaatcacctctcgattaaataactctatcatagtatcatgcatttgatttatgtactttttgtctcggacatgtgattcataattaatgtgctttcctacccttttaaggcttgattacttgattttcattccccaaaccaacttatatatataattattttgcagaagaagcacagctcactcctattctgcgtctaggagctggcgcatgcgcgggaatcattgccatgtctgccacttatccaatggacatggtgcgaggaaggctaaccgttcaggtaagttgttttggaatttttggttcatttggatttgcttctacaagtgttgtttgtggaagataaagatgcttcattgaatcatttgcttggctgttggctgtaacttcaatttgattttcaatgattctgtagacagaagcatctccttgtcagtacagaggaatttttcatgctctttcaacagtcttccgggaagaaggccctcgagctttgtataaaggctggctaccatcagtcataggagttgtaagtgaaaaataaatttagattcttgtcctgaaaagatgtgtatttggtagtaacat

SEQ ID NO: 7586 - DNA, 585 bp, Glycine max
ctccttattttgcgtcgcctcgccggaaagacagaaaacagagagagagagagagagattcgtgtaaattagggtttctttcgccaaagagaggcttcaaacctgacctcttttttcttatcttttttccctttcgcagagcgagcgactcgcgaaaagaagatcctgctcctgatctagttcgcaaaatcgtagaatcattcgaatttgcgattcagatctccattttttactaccttgcttctcaggaaggatgttcggttcaaaccgtaagttttgcctcctcttctgttctattatgctgtgcgtgcattgattagctttattgtgggttcatttgttgaatttggagaatgactgttttatcatttagtagtattgttattattctttgttgtttttgttattattgagtgtgtatgagggtgaggattttgattcttggattgataaatggaaattattctgtcaacagcttttgggcagtcatcgtcgagccctttcggctctcaatcggtttttggacagaccaattcgagtagcaatccttttgctcctaagccgtttggtagtacagctcccttt

SEQ ID NO: 7587 - DNA, 325 bp, Glycine max
ctggattaggtttatttttaactgaccaattatttcaatcactttgtaagtgctttacctttctgcaatcatgtttatctttcccccttacaactgggagctgtaaaggggattgtaggtctcaaagatacttaatggaaatataaaaaactgagtttaatttattacttgtatgggagaatatgtgcatgctgttgctttggttcttgggagtttttcctttatagaattcccattctcattggttttctttctcaatcatttttcctcaacagtcaacatctgctctataacgggcatatggctccatccttctattgatggt

SEQ ID NO: 7588 - DNA, 443 bp, Glycine max
tgctaaacttggtgaacgtcactttgggtcaaccaccagttaccccttgctgcacccttctcgatggtctcgttgaccttgaagctgcagtgtgcctatgcactgccctcaaagcaaacattttgggcatcaacctcaaccttccaatctcactcagcttgcttctcaatgtttgctcaaggaaagtcccacgtgatttccaatgtgcctaagcttatactatcacatatcatcttatatccttcttctgcttcgggtttgctctagttgtgcttttccattttttatttttatttttcaaattctattcatcagtgtgtgattctgattaatttgtacgtgcatggagggttaacttccgatcgttattccttcctttttggtggtattttaattgtatggttaattggagtgttgcgataaataaagttcccgatgctgga

SEQ ID NO: 7589 - DNA, 730 bp, Glycine max
  misc_feature (645)..(651): n is a, c, g, or t
  misc_feature (653)..(678): n is a, c, g, or t
  misc_feature (682)..(690): n is a, c, g, or t
  misc_feature (694)..(712): n is a, c, g, or t
  misc_feature (714)..(726): n is a, c, g, or t
ggcctctgctgctaccatttcattatcagaagcagaaccagaagcaccaaaggttcatgcatccgacatttcaagcatcaaagccttggcagaatcaaagggagcttctcacattccttcaaccaaccactctatcacagacctccatgatgatgtagctgatgagcttgcagcttccatcccagtcattgacttgtctttcctcacttcacatgaccctcaaattcacaccaaagctctgtaccaacttggcaaggcctgtgcagaatggggtttaatcatggtaagtaactttctctttcaaaatatttttttccctacagaaagtagtaatgagattcactttggaggtataaggtgggttagatggttaagggagaaggggagagtggagaggtcccgggttcaatctcttctgctaacaaaaaataacattctaacaaacactaacaaaaaataacattctaacaaacactaacatttgccgataaaaaaaaaaagaacaaaggcaattcattttcaattgtctctcatttgcggctcagctcactaatcatgaaatcccgaaaaacctggggaagaatgtaaaaaaaaagtcccgggagtttcatgattttccggggaaaaaaaaggatttaagggacnnnnnnncnnnnnnnnnnnnnnnnnnnnnnnnnntttnnnnnnnnntttnnnnnnnnnnnnnnnnnnntnnnnnnnnnnnnntttt

SEQ ID NO: 7590 - DNA, 386 bp, Glycine max
gggacagcactggccatggaagccacacagcctccatagcagcagggaggtttgtggcaaacatgaactacaagggactggcaagtggaggagcaaggggaggtgcaccaatggccagaattgcagtgtacaagacatgttgggattctggatgctatgatgtggacttactagctgcctttgatgatgccataagagatggggttcacattttgtctctttctctgggtgctgaatcaccccaaggagactatttcagtgatgccatatctgtggggtcattccatgctgctagtcgtggggtgctggttgttgcgtcagctggaaatgaaggcagtgctggctctgccactaaccttgctccatggatgctcactgttgctgcc

SEQ ID NO: 7591 - DNA, 391 bp, Glycine max
gatgtttgcttttaaaagcagaactctgtgaagcttgaattggaaattacgctagagacctcttggaacttactgcagaagacaactccacatggtgttagatgaatgtggatattgtcattatagaagggaaaggtgaatgctcccacaagacaacctttggatcctcgaggcacacgaaacaggatttgaagccatggatgcttcttgttattaccatgtaatttggtctcgtgcatctgtctatagaactagtgtgccatgggatgggagttcgtagtcatcatgctcatattttgtatagtatatacttaattgttatagtcagatgtttcttaaaattagggctgatgcttgttgcactttggggatggtattcagcccatattgt

SEQ ID NO: 7592 - DNA, 362 bp, Glycine max
tccttgtactcgattagctaaagccgtgaactgcacgtaatatgactgaactgaaccaatttgagcgagtttaaacaactgagatctaggacattcatacggtgatgggccaaattctgtctctaaggctcgcgtaaaagcaatccatgttttgaatgaattttcacgagtcatcatttggtaccagggcacaacctctttatccaagtgaattgaagcaataatcaatcgttgctcacccggtgttttatgatagttaaaaaactgttcagccttgaatatccattgtaaaacatctgatccatcaaatctgggaaaatcaatcttaacattcctaacctgaaaagggtgattgttcatag

SEQ ID NO: 7593 - DNA, 512 bp, Glycine max
gaaggagagagaatcgtgggcccaacgagacggcccgacggaaccctccgcaagcccattcgaatccgcgccggttacacccctcaagacgaagtcgccatttaccaacccaaaggagcactcgtccgttccctaatttcttcttcttattgttattattccatttctctttctctgactcttgttctctgcagctgaaaaaggagatgggctcggctgggcctcccggctacgaccccgacgccgattccaagcccaagcccaagcccaagaccaagtccgtcaagaggaacgagagaaagaaggaaaagcgcattcaggtataaaattaatgctctactttactttgtttaattgataaatcttgattaacgcgaattctataatatgtgttattgcaggctgcgcttgaaaaggaaaagaatgtgagtgaagttgaagagagtgggaagcaggaatttgtggaggcattgacctcgcaggtaaatgaactcgctgtgcaagattcccaa

SEQ ID NO: 7594 - DNA, 511 bp, Glycine max
gaaggaagagaagaagaagcatggcggtgcgggccactgtgtcgcgtttcccgatggacacggacgcccgcgagggctcgggcctcctctggggagtaaccgtcacgccgttctccgccgccgacgagaatgcccgcgctccgtcgtacggctccggcggtgacctcttgccccggtgcgagaactgctgggcctacttcaacacctactgcgagctggagcagtggtcctggtcctgctccctctgcggcaacctcaacggcctctcctccgacgccatcgaccgctactctcgccctcagtcctgcgccgagatgatgtcctccttcgtagatctcgaattgccttcgcgtaattatcggcaacgttattaattgattgaattggaattgaattgctcttgtgcacggttttcagatttgactgtttttgaattggaattgttgcagaggaactggcggaggaagcggcaatgcaggcgtgtccggtttatgttgctgctgttgactta

SEQ ID NO: 7595 - DNA, 729 bp, Glycine max
cttgggccggatatgatagtatccaatacctttggatcctttgccatgttggttgtaatggctcttggcggatatataatttcaagaggtcgaacatcaatttcaatatttttgtgtttctaaattcggtttggaaaagtaatttttctgactttatatctcatttttgggcagaccgtatacctgtttggtggatatggggtttttggatttctccattgatgtatgcacaaaactcagcttctgtgaacgagttccttggacattcttgggataaggtataagccttcatgttattataatgtgtttctttcagaaccattgtaaatatttgggaaatgcagatgataatgctaatttccttactgcgttgaaaatgtactcactatttaatttctttacagaaagctggaaatcagactacctattcattgggtgaggcagtattaaaagagcgaagtttgtatgcagaaaactattggtattggattggtcttggggcaatggttggatacacaattttgttcaacattctatttacaatcttcttggcttaccttaatcgtaaggcacattctgtataaagcctttttctattgttgcggtgccatatatctgtgcttcataggccaaaattaacttttgtttagaggagtatttctatatatcttatttccctaatattttcttcagccttgggaagacaacaagctgtagtttcaaaggatg

SEQ ID NO: 7596 - DNA, 391 bp, Glycine max
cgtgtgtggagtgcttgcacggcgaaggacagtgaggaaaagatgctcactgcaaggaatatagagctttgaatctgcaatgaaatcatactcatccttagcttgatccagcagagtcttgaagagtggatgattgagtaaggtaatcttgatgacatatctcttatggtgctctcccacgtacacaaccaagtgaccctttggcacatcgttgggaatggagtctccttcatcttcatgcatggatgaccccagttcccattcacagcagtaaccgtaggcagcacaatggaacactctacttcccattttcttccacttgttaaggcaccctcttagaaactttcccttcatagtgagagagagagagagagacagagactgggaaagg

SEQ ID NO: 7597 - DNA, 764 bp, Glycine max
  misc_feature (673)..(699): n is a, c, g, or t
  misc_feature (701)..(708): n is a, c, g, or t
  misc_feature (711)..(715): n is a, c, g, or t
  misc_feature (717)..(720): n is a, c, g, or t
  misc_feature (723)..(725): n is a, c, g, or t
  misc_feature (728)..(739): n is a, c, g, or t
  misc_feature (742)..(760): n is a, c, g, or t
ccacctttctaataagctaaaagtttcagccctcaaaagcaacgaaacaaagccaaagcagttctcactgtgtcaaaacggatggctccccgctttcccccacgttcttgttgcttcaatgtctaattttatatttgggtatcacattgggtcagtcagtttccctatctttgtattctcttaaatcaataataaggtttttgattttctagcctcttgtggattgcagagtcatgaatggtcctattgtttccattgctcgggagcttggttttgagggaaactcattcattgagggactcgtggtcagtatatttatcgctggtgcatttattgggagcataagctccgcttcattgctagatagacttggttctcgcctcacatttcagattaatagcatacccttaatccttggggcaataataaggtactgtacatttcttgtgctttcatgtacaaatgattatgattataacatgattggcttttccaattttttgatcatcaatacatattgcctacagattgcaatcactttcatttgagattgtagttgcttggctggtagtcatattgttaacatacttctttataatttgtgacagtgcacaagctcactccttgaatgagataattgggggaagatttcttgttggccttggtataggtnnnnnnnnnnnnnnnnnnnnnnnnnnncnnnnnnnnccnnnnncnnnnccnnnctnnnnnnnnnnnnctnnnnnnnnnnnnnnnnnnntcct

SEQ ID NO: 7598 - DNA, 408 bp, Glycine max
gtgctggaaatggaactactccaccagtgcacccttatcacattacagaatcagaagaatcagaaaatgcacatttcaccaaagaaaaaatggtggtgaatgataatgatgatattgcttctgcccctggagtggtggcaaggctaatggggctggattcacttccaaaccccaaatgggtagtgaaatgtggcaccccagattcggttcctagaagcaggtcagtgaactttgtggattacttgcttgagtttgatgcaagccatgttagtagccataggagggtgaagacctcggcatcgttcagagaggttcctagtttggttcagaaccaaaagggtaatggttatggtaatggtaataatctctttgtgttttgcatggctggtgacaataacatgagggaag

SEQ ID NO: 7599 - DNA, 369 bp, Glycine max
gtggttgaactacgtcgttataagacatacttccagatcatggtgtaacctcgtcgccaaagttcgagagaaaccctctttcgtttcggtaaagggaactaaccacttttgtcttgttattgttacaatgatcttctctaagtttaagtaagggagatagatagctagagagtgtgttggatcgatctcaaagggtagagaagataatcaagaaatgatgtcaacaacatcccaaactaatgttaaccatagcttgtttgaagagcaagatcagatccctacgcagatggggttgttcaatattcctttcccaccaaaccaaacataccctcctttgggttgccaaacaggcactttgaaatccatcag

SEQ ID NO: 7600 - DNA, 439 bp, Glycine max
actaggaaagagtggtggatcttcaagatgtcttcaatcgcttcaccttcgataacatatgttctatagttcttggaaatgaccctaattgtctttccattgatttttctgaagttgccattgagaaggcttttaatgaagtagaagagtccatattctacagacatgtagtgcctaggtgtgtttggaagatccagagatggcttcaaattggtcaagagaagaagatgacagaagcatgtaaaacccttgatcaattcatacatgcatgcatagcatctaagagagagaagctaagcaagtacaacgaaaatgaaatgggtgaagctcatcatgttgactttttaacagctttgatgagagaagaaacagcacatgacgataaatttctaagggatgctgtgttcaatctatttgtggctggaagagataccataaa

SEQ ID NO: 7601 - DNA, 411 bp, Glycine max
ctctaaaatctaaaacaccatgatggggattacagatatttcatgtccacacttcctttctcatggaaggcattactcttctgttttcttctcataaattgcagtgtgcttcaacactctcaaacaaactttttcaatgtaccaaatgtggagtgaaaactgatatcggttgaagcaaatatagctggatgatgaccaagctgggcagtgtcacaacaactcttaattaggaataggatgaggagcctcaatggggaatgcatgctgtatgtgagagaaaagagatggttgaagttacagaaaatttaaatttgaaaaaaaatgaaaaggcagttttatcaattaatcagttatttaactgagtatgacggatttttgtctgaaagaaaaatgaggaggatgctaacccat

SEQ ID NO: 7602 - DNA, 403 bp, Glycine max
ggtgacttggtcataacgtgtgttccttgctaaagaatgatgttacattagcaaaagaagaaattagtaacatatttgattagtttgcattaattttcaccgtaaattattaactcaagcataacattttggagaatgtaaaatagatgttcaatcttactatatcctaaggtggtctgttctctgagtcccaaagattgaccactagttcttttttatcccccccttcagcttcacattttatgagtagatggttggatctttgttttatctttatttactatagttatcaacagatcaactaggtgagcacctcattgaatctgcagcacctcaatttgaagagggatgaccctttttggagatcttcagagtactgcttctgatcactgagctctttcaa

SEQ ID NO: 7603 - DNA, 379 bp, Glycine max
gtataagcagctcccgaagctggagccacagacacgtgtcgagccgctctccatgcaaacgtccacgtaatcatccaaaccgggttgcagggaggctcggaacgaggcttggaggatcgggagaatcaacacaaaggggcgtccgagttggtcgtttttgtcgagaagcatcatctgtgtctcgtgctccagttcgtgtccgttgctaccgacccagtgagtggtccaccacaccttaaaccggaatatgctcatgaattttattcctctgagcttccccagggaagccacgtgtcggcttctgggctcgtccgcgtggaagcccacgaagcaacctacgacgtcgtcgtcctcgttgttcttactactcttggcgaga

SEQ ID NO: 7604 - DNA, 647 bp, Glycine max
cttatttgcctttagactttaacatccgggtgaataaaatggcagccttttatgcatctgaaataagaaagaacagaagtcaggcgatctaggtttttaaagttcctttcaggttttgggactcaatttgtccatccaatggctcagtcaaaacactgtctcacgaaccagatttgtacataaaagattgcttcaatcttcagaacacttatcacacatcatcattgcaatctgattaaacaaaagagaacagtaaacacctcaactatcaattgaccctagtaagtacgatgtgtgataatatttcaaacagttaaacatagaaggaagagaaaataaactacattctagagaaactcttacaagaatgttgaggggtatttatcttaatctttttatgtatagaaaaagtcattatatttctatatataaacagaacccaccaaaatttatgccaaccgattcttttattccagacaattctactcaagatgcataaactttgaacaatatgattcataaataagagaccaatattattttctaaaatacaaagtaaacctataggaagaatccagcttaataaaattcaccatgccaacttaaaagaatccaagagcaacaaactttttggtgatagatatcta

SEQ ID NO: 7605 - DNA, 673 bp, Glycine max
  misc_feature (618)..(619): n is a, c, g, or t
atctagctaaatttgtcgtttgctttcagcaagagctttagcttaattatcaccaggaacttttttggcagtcatggattattcatcatggatgattaacacttccttggatctcaacattaatccccacaggcttcatgaagaacttcccgtaagtataaacatattgggcggaagatcttctgtgaaatgtttccctcagaataataattctttcttcttttcttcttgtgtgttcatttcagaaaaaggaggtggaaaacaactttttgtcattgaatttggaggtgaagaaatcttctgtaaaacaagaggttagttgtgtctgccaattctccgatccttttttaagcggttcttccaattatggagttgatttaatggaattactgttctgtaagacttaaaaattaaaaacatttatttctatatccaaaacctgactcttttggtttagggattattctagctttgatattgctgcctgttgcaccattttgttgaatgattctcttgttagtctgtccatccattatggatattagttataagcatcttttttttttttcccttattaaaagctgcataaatgatgatatatatgtgctgccttttcannctgctggtgccttggcggaggagctgaagcgggtgagtgcagaaaacaagaagt

SEQ ID NO: 7606 - DNA, 438 bp, Glycine max
  misc_feature (377)..(377): n is a, c, g, or t
tttcgtttatgaaaaacttgaattctatgtggcttgtatgttttgtgctatcatctgagcaggaatcctttcccaactctgctactctggttggatatggcattgttgatgtgcgatattctcccagccctttttcttgattatgttgcatttgttgcttcctttttgggtattgcatttctcactttcttgttagaatccaatttgatgttatattgagaactgctcaggttgataggatctgtcattaatgtcaccagctgaatgtgagtgtgttaacaaggtctgttagttcttgtaccagatatagagtccatcttcactatcatctgcaatcttgttacaaagaccgagaatccagatgaagtgatgggagnttgtattaatctggggtacgagatctaagagaccgtgataacacactcatattgaggggga

SEQ ID NO: 7607 - DNA, 340 bp, Glycine max
  misc_feature (59)..(60): n is a, c, g, or t
atctccctctccctccacctcctcggcgacttcccctccgacaccccctccctcctctnngccttcctctccgccgccaccaccaccaccacccacttccacgtcatcacccccttcgactcccaccctctctcccacaccctctctctctcccacactctccatcttctcgtcaccccctcccaaaccctaacctcacttaccaattctctctcccaaaccctaacctcacacctccactccacaccctcctccctccgctcccctctcctcaccatccctcactcctctattgaccaaatcatccaaaaccacttcatcacacaaaaccctaacccta

SEQ ID NO: 7608 - DNA, 1221 bp, Glycine max
  misc_feature (1168)..(1175): n is a, c, g, or t
ttgtggatttgccagggggtaggattacttcccttcatggtttatctacataattttattttattttattttagacttggttatctcatttgtaactaatgatcaaagggatgttttccattggtgctatagtcttaatcttaaagtgcttgctccatggacatatatttaattcttggatcttacagttgcatatagggatttttctatataatctattaattggacctttgatgtccttagtgcctctaattgcacattttagttctgttttcgatatatctcttctgattagattatataatcaaaacaatcctttgaatactgattgaagagtacctagattagtatttaaatgttgtgatatgttttttggcttttgtgtcatcaacctatcctttttgtctaataagtacaaaaataaattagatgacaatggccacttatgtatacctttttctaatatggtttttattactgttaactgttttcttaaatactttatacacaatttcttctggaccctgccatttctgatttcactgctattgttctttgactcgtgtgaacaaatttgttagcttttgatttcttgttaattttatattttcatctgatctctaattaatcagggtcctcgtggttcccgggaaaacttgggtcggggtctacctcctggatctggacgatgctttaactgtggcattgatggtcattgggcccgagattgcaaagctggggattggaagaacaagtgttaccgttgtggggaaagaggtcatatagaaaagaactgtaagaacagtcccaaaaagtcgaggtaggccatgatgtagtttccaaacttctgctacagtgttgatttgctcttaagatggttattgatctcttatggattttatgagctttaaatcattgatttcaatgttgaattgttctaacagccgacatggacggagtctttcacgttcaccggtccggtcacattctcctcgtcgtggcagaagccgggatcgaagctacagccgagaccgcaactacaggtttgattttaatggtgtccctaatcttagtggttccgataaaatgacactgcattttcaattggctgttgtttcagttgtcagaatttataatatctttgcttgtaagctgagttttggttacnnnnnnnnttgccagccgatcgagatctccagtcagaagagaacgaagcccagt

SEQ ID NO: 7609 - DNA, 1315 bp, Glycine max
  misc_feature (63)..(64): n is a, c, g, or t
  misc_feature (66)..(68): n is a, c, g, or t
  misc_feature (408)..(408): n is a, c, g, or t
  misc_feature (679)..(682): n is a, c, g, or t
  misc_feature (686)..(686): n is a, c, g, or t
  misc_feature (1207)..(1209): n is a, c, g, or t
  misc_feature (1211)..(1211): n is a, c, g, or t
  misc_feature (1213)..(1218): n is a, c, g, or t
  misc_feature (1229)..(1231): n is a, c, g, or t
  misc_feature (1244)..(1259): n is a, c, g, or t
  misc_feature (1290)..(1290): n is a, c, g, or t
  misc_feature (1308)..(1310): n is a, c, g, or t
atttgacagaaaggtttcactggcggcctaaactactatcgcgctatggacctgtaagtttcnncnnnttcgacgtaggaaacattgctatacttactacaaagtaacctcctgttctgtagattcaactttaaagtttattttagtaagacttgagtttttcttagaagcaaagcatgaacttaaatcaatactactacgactactgcgtgatagttctttcttttatcctctcaaatatcccaatcattttaacctgtagtttcttctctggttcttaaattccttttgcatgaactgattatgaataaattgttcctaatgattctatttagagcactgataaacgttaccccaaatgggtacatagggtgcaaggaagagagatgaaaaaaaaagtgtgcaaanaaaactaatgtagtccgaataaggcttgagcatttcacaccttcaggcttgttttgtgaggttaagttagactttaactctaaattctaagatggtctaagagtctattctactttctgttattgtgtcaccaatatttgtctatgctctaaaagtttattcctaggcgtgaggggttgttattgtgccaccctcatttttccgcactcctcatatgcaatccttggcctgggaatgatatggctaatgtaggcttggacactctttgagnnnnacanatctcataagtgatgcgatggaaaataaagagagacaagaaaaaaatgaagtagaaaatgatatagaagaataagtgagtgtatgtttatatttatttttaatgttcaacaacaattgagtttgtaataaaagggtatgtttgggagtagctttcataagttatttttgatgcagtaactgaacctgacttgtagtaccgtatgtatgtaccaagaaaataagttcagaatataattgttttctttttcgatgagattatcagtttgttattaggtttttgctaatttattttgttgaaggatgtgtatgtagtctggtaaattcttttttttcttttttctgcagaacctgggagctcacagcagcatggactggagtacagattaaggtaccggtcaagtttattgtgggagaccttgacattacatacaacactccaggtgttaaggagtatatacataatggtggctttaagagagacgtaccattcttgcaagaattggttgtgatggaaggagtnnntnannnnnnaatcaggaaannnccgaagagatcannnnnnnnnnnnnnnnttcatcaagaaattctaatccacgttatttncttcagaagtataccgtnnnaatca

SEQ ID NO: 7610 - DNA, 594 bp, Glycine max
  misc_feature (436)..(437): n is a, c, g, or t
  misc_feature (441)..(441): n is a, c, g, or t
  misc_feature (453)..(455): n is a, c, g, or t
  misc_feature (536)..(536): n is a, c, g, or t
  misc_feature (566)..(566): n is a, c, g, or t
  misc_feature (569)..(569): n is a, c, g, or t
  misc_feature (571)..(572): n is a, c, g, or t
agtgtctccaactgaaacttcatcgtgtcgattcggtccattgccgcggcctcgtgaagaaccgattcgtcgattttgcagccggaggcttccagaagcttcaccgcttggaggctcccaaccctaattgcgagcggcatgagggattccgccgtcgcgcagcaaatccgcgacgacgtcggcgctgccgcattccatggcgacgtgggggccgacgagggagacgtgggggccgggtttggagaatagttggcggaggtgttcgacggtggcctttcgggtggggagcatggtggctcggtcggttatggcgtcgggagggtcggagagagggtgttgatcagagggctgagagagttgtagtgtgtaagaaacagaagagagtgggggaattgtggagaagggtttgtggtggttaaagacactgcacatggtnnctcnaacggctctggnnnctggagggacagagagagggggttgatcacagggatgggagagttgtagcgtgtaagaagcataagagagtgggggaattntggagaagggtttgttgatggtgaaaagancangnnttgtggtggttaaagacactgc

SEQ ID NO: 7611 - DNA, 477 bp, Glycine max
cactttcgtctctcaaacatttgaagtcgccggacgactttcctcttcctccccaatttcgctgccccatttcaacccaattgatgtccgatcccgttatcttatccaccggccaggtttcttactttactttcgttaccattttcaattccctttatttctaatcactctaattactattccttttgaaattagaaagaaagtatcctaatttcgttgtatgcttgcttcttcagacttatgataggccatttattcagaggtggttgaatgagggtcaccgaacatgtcctcagacacagcaggttctgtctcacactattctaactcccaattacttggtccgagacatgattctccagtggtgtagggaccgtggaattgacttacctggccctgttaaggacattgatgaagctgtcaccaatgcggatagaaaccatttgaattctttgcttcgtaagttgcagttgtatg

SEQ ID NO: 7612 - DNA, 987 bp, Glycine max
  misc_feature (68)..(71): n is a, c, g, or t
  misc_feature (924)..(928): n is a, c, g, or t
  misc_feature (976)..(978): n is a, c, g, or t
ctatactctttgatggttatgcacatctctcctctggtcttgcctgtggcttggctggcctttctgcnnnnatggctattggtattgtcggtgatgctggtgttaggtataatgcttttttactttgtttttcatatatgatttgtttcttatttcttgatgtgtttaaggtcttgttgaattgcaatattgcatagtgacattcaactcttgatcctgtttggataaatttatcataagtacttatagggaagataacaagaagataaaatgaatgaagtttctcccaaaagtttaaatcagtttatgtacaagtttaaattagcttttgcagaaactcaatggttgagcttctttaacttagctcatgcatacgataaaagtgatgtctgtttcaatcggtattaatgcataacttatgggaaaacttaattcattttgctttcttatttctttctcttataagtgcttattaaaatgtttatccaaactggaccatatgtgtgtgtgtgtgtttttactttttagtaaagcaatcaattattcaaaatatatttgtttgaggacatctttgcattgctgaacaattctttcaggaagtacagttatgtctctagccttttcaactgtcagataacatatgatccttcatggaacatatatctttttgcctttactagcatgcatttgttgtgaatttgacggtggattttccttttacaataatactgattaatcaatctgcttctgcagagccaatgcacagcagccaaaactttttgttggaatgattctcatcctcatttttgctgaagctcttgccctttatggtctaatcgttggtattatcctgtcttctcgtgctggccagtctagagctgactaagaaaggagttgtgctgcaaaatattctttgaccacccnnnnnttttaacctctttttagagggggtgagggaggtaattattagttttcnnnagctagcaa

SEQ ID NO: 7613 - DNA, 479 bp, Glycine max
atgttaaccttagctgcctttgctgttatttttggagagttttggcttgttgctcagttgagttctgaaaacacacttgccaagtctgtggccctacttaagcaactacctgacattgctgagaatttcatgtccctgaagccccattttgaggcactcattaggctcgtgaaggcggcaatggatgtaaccatgtgcattgttgaattcaaggagctaccatctgaatacatttcagaggatactcctcccatgtctgttgcaagtactcacattcctattgcttcctattgggtcatcagaagtattgtggcttgttcctcacaaattgctagtctcgtaggcatgagaaatgagtaagcatagtgtagatcatttacatcaactcaattgtttttttgaaaaagtagtgacccccattttgttgattgcagatccatttcatcaaccacagaggcatgggaattatctagtctagc

SEQ ID NO: 7614 - DNA, 751 bp, Glycine max
gtcgttgcttctgaattctcagagatgccaccaaagctgttgcaaaaatcatcggaaaaccccaatccgttaagtcctcttttacccttttactcactctctttcgacattgttcaccagttgtttgatcaaattactctataaaaatatctacactttatctaacccatgtcatgaaacttattaaggttactacttacctttggcactcattactatggttatctgttaacacttctttctgtttggttttttagtaatttgatgggctacagctgaataattgttttgctacttcaatttttagtataattttgacatagatttgtgtctattttttggggggtgctatatttcagtatgtgatgattttgttgaatgggggagtgcctattgcatttgctggaactgaagagccagctgcttatggagaactgatctcgattgggggccttggtccgagtgtcaatggaaaactgagttctacaattgcagaaattcttgaaactaagctatacattgacagttcccgtttctatatcaagttttatgatgttcaggtaattttctgctttgtcctgtaatggcttgtgcgattctgagaagattgcaaattaatgttggttaccaccctttgataatattgtctagctatttgaagtacttttatgtgggtgaagcgatttcatgcattctataactaatttaattctctgccacaatgtattgaaatggttttatacttacatgc

SEQ ID NO: 7615 - DNA, 385 bp, Glycine max
acatcggttttctgaacaatagatcatttaagcataatagtaagtttagtctcaattgagaaaaactaaaacagtcgttttctttccattttaaaccattaattaaaacctacctcaggtatgaggagaggttaataatcacatatagttaaaaccttttccattgtgcatatgtggggacgggttcagtagttggtcgtaaatctgacaggcaacccctgaagatgttggccttctggccatctgttctacagcagcctgattgtgacttgttaagtaaagagtattgttgagcttggtatctactatctaagttgataatctataatttatagttgaattgcatgtgagcaagaattatccagttaaaattatgtgactgaag

SEQ ID NO: 7616 - DNA, 406 bp, Glycine max
aagaaattaaatacatgttggaaacatattcttcagagattctctaaatcgttccatttgtagagtactttgagcatccggttcttcccatgttgtaatactaggaccaacttcactttcatcctcatcactatctatatcttcattatcttcatctagcgaatcaaattctccatcactcttgtcatttctttgaatgaagttatgtatagccatgcaagcaacaacgatttggttttgtgtcttcaaagcaaaaggtggcatattacccaatatcttccatcttgctttacataaaccaaatgcacgttcaattgtacttcgaagactggaatgataataattaaaaacttcaactcttcccctgattctaggcccaattctaaattgcgggagatgataccta

SEQ ID NO: 7617 - DNA, 430 bp, Glycine max
  misc_feature (397)..(403): n is a, c, g, or t
tcctcttcttagagatggcttgtgaaaccaagacatggttggttatggttcttcttttcttggctgctaactacttgcaagattgtgttcatggggtatcccaagttccttgccttttcatctttggggactctttatctgacagtggaaacaacaatgaacttccaacctctgcaaaatctaattacagaccatatgggatcgactttccattaggaccaacaggaagatttaccaatggcagaacagaaattgacataattagtaacatttctttacccctattaagacctctaatctatgtgctgcaatcaaagatttcaaattcatgtctggttatgaattttaggtgtcaaatttatgagttggtgtggactaccttctgttaaccgaagtnnnnnnntgatgtggattaccttctgttaaccga

SEQ ID NO: 7618 - DNA, 409 bp, Glycine max
tttgatcgacccataaagattgaagttaaattacaactggttgttagtccacctccacaaattatacaaaaattgatttgatttacatcatacattccaaaattcgctgaacaaggcaacgcacaaaaaaatggagatcagggcttgaacttttgagtgagcttctcaactccttctctacaatcacctgcaactcgctttgcctcttctttgatagtaaatccaaattcaagagcactttgctgcacctcatgagctgacttgcctgcctttgagatggcagattgtttcaattcttcagcttgttttccagttttgcatgcccattctctcaatcttgatacaaattgggaaattatgtggataatcttgtcaatcatatctctggctcttcctcccacctcaacta

SEQ ID NO: 7619 - DNA, 364 bp, Glycine max
gtggaggccagggttcctctggcctacagggaccagtgcgcccacttgctcatccctctcaacaagtgcaggcaggccgagttctacctcccatggaagtgccaggaccagcgtcactcctacgaaaagtgccagtacgagctcgttatggagagaatgctccagatgcaaaagatccgcgagcaccaacaaaaccccaacgccaaacaaccccttatcgcgcttcccaaacccgccaatgcctgattcatattcactgtatgctcctctcttctttctttttatttcttcaattatctcgctttgtcactaatcgggacttagggttgctggattcgagggtgagcgattgatgctgttatac

SEQ ID NO: 7620 - DNA, 757 bp, Glycine max
  misc_feature (284)..(287): n is a, c, g, or t
  misc_feature (291)..(293): n is a, c, g, or t
  misc_feature (295)..(297): n is a, c, g, or t
  misc_feature (302)..(311): n is a, c, g, or t
  misc_feature (315)..(325): n is a, c, g, or t
  misc_feature (327)..(332): n is a, c, g, or t
  misc_feature (340)..(341): n is a, c, g, or t
  misc_feature (347)..(349): n is a, c, g, or t
  misc_feature (351)..(352): n is a, c, g, or t
  misc_feature (358)..(365): n is a, c, g, or t
  misc_feature (367)..(367): n is a, c, g, or t
  misc_feature (369)..(369): n is a, c, g, or t
  misc_feature (374)..(377): n is a, c, g, or t
  misc_feature (386)..(403): n is a, c, g, or t
  misc_feature (407)..(408): n is a, c, g, or t
  misc_feature (413)..(415): n is a, c, g, or t
  misc_feature (422)..(434): n is a, c, g, or t
  misc_feature (436)..(438): n is a, c, g, or t
  misc_feature (442)..(451): n is a, c, g, or t
  misc_feature (455)..(456): n is a, c, g, or t
  misc_feature (464)..(469): n is a, c, g, or t
  misc_feature (473)..(476): n is a, c, g, or t
  misc_feature (485)..(487): n is a, c, g, or t
  misc_feature (497)..(498): n is a, c, g, or t
  misc_feature (506)..(521): n is a, c, g, or t
  misc_feature (537)..(539): n is a, c, g, or t
  misc_feature (546)..(555): n is a, c, g, or t
  misc_feature (562)..(565): n is a, c, g, or t
  misc_feature (568)..(576): n is a, c, g, or t
  misc_feature (579)..(585): n is a, c, g, or t
  misc_feature (587)..(589): n is a, c, g, or t
  misc_feature (594)..(596): n is a, c, g, or t
  misc_feature (598)..(606): n is a, c, g, or t
  misc_feature (617)..(634): n is a, c, g, or t
  misc_feature (648)..(665): n is a, c, g, or t
  misc_feature (670)..(672): n is a, c, g, or t
  misc_feature (675)..(676): n is a, c, g, or t
  misc_feature (682)..(686): n is a, c, g, or t
  misc_feature (689)..(691): n is a, c, g, or t
  misc_feature (693)..(700): n is a, c, g, or t
  misc_feature (705)..(705): n is a, c, g, or t
  misc_feature (708)..(717): n is a, c, g, or t
  misc_feature (719)..(732): n is a, c, g, or t
  misc_feature (734)..(745): n is a, c, g, or t
  misc_feature (749)..(753): n is a, c, g, or t
agcagaagctaaaaaccacccatacaccagcgaaacagggccgccataattcaacccagtgttgtaaagagtggtcactccagtcaacaccgatataatagaaaacgaaaacgcaaaattcgaaataaccctgccatatagtataaataaacaaattgaaaagaaaaactggaatgaatccaacaagagagagcaaaaggaagaaaataagaggtttacgaaagatcacgcttgagttcttgtttgttaccaagagttcttgtttgttaccaactcgtaactcnnnnagannncnnntttgnnnnnnnnnnggtnnnnnnnnnnncnnnnnnttctgganncaggtnnngnngccctnnnnnnnngntnccctnnnngcgccgccnnnnnnnnnnnnnnnnnntatnntatcnnnctccccnnnnnnnnnnnnncnnncctnnnnnnnnnnactnntccccccnnnnnnttcnnnnttccccccnnncacttttttnnattttccnnnnnnnnnnnnnnnntcccccttttgtgttnnnacccttnnnnnnnnnnttattannnnccnnnnnnnnnccnnnnnnncnnnttttnnntnnnnnnnnncccttcccccnnnnnnnnnnnnnnnnnnccccttttttcctnnnnnnnnnnnnnnnnnntcttnnnctnncccctnnnnnttnnntnnnnnnnncccanctnnnnnnnnnntnnnnnnnnnnnnnntnnnnnnnnnnnncccnnnnntccc

SEQ ID NO: 7621 - DNA, 360 bp, Glycine max
gtgtgggctgtgtattgcaatgggaggaaagttggctactccataaggaggaagcaaatgagcgacgatgagcttcacgtcatgcagcatttgagaggggtttccatgggagcgggggtgctccccacctcatcggatcataaggattgcgatggggaaatgacctacatgagggccaggtttgagagggtcgttggctccaaggattccgaagccttttatatgattaatcctgattctactgctcaaggccctgagttgagtatcttctttgttagacctcactagaataatcataatcataatcatatcttgtatctacctcttcctagcttacattgtatcattattattctaccc

SEQ ID NO: 7622 - DNA, 745 bp, Glycine max
atcaatttctctttaatctcattcttgtcatccatgggaccagataggtacagatattgaagatttcaagtgctcttggttaattgtgaaagccttggaacttagtaatgaacaacaaaagaaagttctacaagtaagtgagcatcttattatttcccgtttctttccttattgtctgccatgattagactgcaataagtcactgtttttttgtggtttgcaggagaactatggtaagccagatccagaaaatgttgctaaagtaaaggccctgtacaatgagcttaatcttcaggtttgaacttcatttgtatctagctctaataattataatttgttgggaaaagttactactaacatgcatctttggaatatcaacgtattaagatgacctattagccaaaacaataaggaaaacagaattaagatgccaaaagaataatagcatttccacacattttgcaagaaagtaatgcaaatgaagttgcaaaaatttctgcacatcatgatagatgctgattttctttggataattcactcttaatccgaatgaatagggtgtatttgaggagtacgagagtgggagctatgcgaagcttgtatcctccattgaagctcatcctatcaaagcagttcaagctgtattgaagtcctttttggctaaaatttacaaaaggcagaagtagagtcaacttaaggcgaggaccaaaattgtttaacatgcaatagaaactagagttctgat

SEQ ID NO: 7623 - DNA, 407 bp, Glycine max
ctcagcagaagagaagaagaatgctgaggaatggatgcttgactatgcacttcaaaaggttgtttctaaacttgcacctgctcaaagacaaaaagtgacacttctagtaaaagcttttgaaacaattctgccatttcaagttgctgaaaatagtccacggttttctccaacaatggaacctcaagcaaatccagttcaaccccttgacaattcctcaaatcacagcgaggaagaaacatcattttctcatgatagcagtatggaactgacagaaaatactagtgatgatccaatgccagaactgcacaatcctactacgctcaaagaaagatgtcttgagtctcttgattttcctggaaccgagacagtcaagaatatgcctgcctttggagctactgaagaagaca

SEQ ID NO: 7624 - DNA, 399 bp, Glycine max
aaacgcgttggaagcgtcgctgagggtagccttcgagtctctgcaaccatccctgagaccccctttctccttatccattcccacccccgaccaatacgccctcctcaacggcgcaattcttcacggcgctttaacggagccccatttctccaaaacacacatcaaacacttgcacgcaatcgtcaccgacggctacgccaccttcgtcaacttactcctcgacgccgtccttcaactctaccccaaacttctccactccgccaaaacgcagttgctctggctcaccgaggaaatggtccacgttttggccatcggctacgacgccgttttggtctcccttttgcgccaaataggcgccgccgattgcaccgaaggcaacttgaacctctgctccgaatt

SEQ ID NO: 7625 - DNA, 402 bp, Glycine max
catctcaccaaatcctttaatatccctcctgcgtcgcttcagtcgattccttacattttgctcatcgttttagtccctctctatgacaccttctttgtcccctttgccagaaagttcaccggccatgagtctggaatcccacctttgcgccgaataggctttggtctttttctagctaccttttccatggttgcagctgctctgttggagaaaaagagaagggacgaagctgtgaatcatgacaaagttttgtccatcttttggataaccccacaatacttgatctttggcttgtcagagatgtttacagccattggccttcttgagttcttctacaaacagtccttgaaagggatgcaagcattcttgacagccatcacatattgctcctactcctttagc

SEQ ID NO: 7626 - DNA, 1094 bp, Glycine max
  misc_feature (1032)..(1034): n is a, c, g, or t
  misc_feature (1036)..(1036): n is a, c, g, or t
gtccctgttcacagcatggcttcattttacatatcaactggagagtggcaatggaggtgatctatccagctctggtgaggtaagttctcacatgaaattgctcacaggatttacttccaaggatatttcattagcaatatagtaatctcaaaattaaggctctaatttgttgagacagtacgttcttacgtgtttttgatggcgccgatgccagggagtactggttgagacagtatactgctactcctactgtttctgacagtacagttctggttccatgaaacagagttcgcagcactttccttcaacctcttgtgattaatatgtgaagcaactgaagaaaatagattggcatttggaatttcttttttatcctattttgtgattgatttcatgaaacttggggtttgattggtaaaggtgataataaaacaggtgattttattttttgtaaaaaaaagaaaaaagaaaagggagaggggagtgaaaatggagaggctttaattttgccttgttggtacatggtagggagggtgaaaaatgaaaggtgcatctcactttcaatattcccttaatttttgtatattacacacatgcaagatgatttgcagatcaaatttttatttgcttcagtttcctctcttcacccttagcatatacgaatctaatacaatgaaattgtccggcagagtattatttgtttttcagtcttgccacagtcatcatcctagaattattccctaggaagccacatagctgatgaagtttgtgtgtttcaaaacaagttcatttatatttcttgaaaataaacaggctaacacatctgtcacaatcacatatccaggtctttacaatacctgttgccccaggagatgttgtcgttgctggaacagatggattgtttgacaatctgtacaatgatgaggtcactgaagttgttttacattcagttagagctggactagaaccccaagtaactgctcagaagatagcagtactggctcgtcaacgagcactggacaggaataggcnnncngcattttctacggctgctcaagaggctgggttccgttattatggtggcaaactgatac

SEQ ID NO: 7627 - DNA, 837 bp, Glycine max
  misc_feature (84)..(84): n is a, c, g, or t
  misc_feature (105)..(105): n is a, c, g, or t
  misc_feature (114)..(114): n is a, c, g, or t
  misc_feature (117)..(117): n is a, c, g, or t
  misc_feature (135)..(135): n is a, c, g, or t
  misc_feature (141)..(141): n is a, c, g, or t
  misc_feature (145)..(145): n is a, c, g, or t
  misc_feature (149)..(149): n is a, c, g, or t
  misc_feature (160)..(161): n is a, c, g, or t
  misc_feature (165)..(165): n is a, c, g, or t
  misc_feature (174)..(174): n is a, c, g, or t
  misc_feature (190)..(190): n is a, c, g, or t
  misc_feature (192)..(192): n is a, c, g, or t
  misc_feature (204)..(205): n is a, c, g, or t
  misc_feature (207)..(208): n is a, c, g, or t
  misc_feature (210)..(210): n is a, c, g, or t
  misc_feature (220)..(220): n is a, c, g, or t
  misc_feature (232)..(232): n is a, c, g, or t
  misc_feature (236)..(236): n is a, c, g, or t
  misc_feature (259)..(259): n is a, c, g, or t
  misc_feature (261)..(262): n is a, c, g, or t
  misc_feature (267)..(271): n is a, c, g, or t
gtttctgtatctgtgttataaccattgacttcagcaaatcaactttttgtttgatttgaattcctttctaaatgttattaattntctgatttcttatttctgatnaactttgtnccnttgtttcacccccaaacnacttantttntgcncccaataatannaacngtataacanacatgcatacacaatntntgtaaactactnntnntntaaaagtatnaaaaaatatatntagnaaagttataacaaaaatatgagntnnatatnnnnntcaaaataatttgtacaagcacaagattctatttaaaatgaaattttcgaacattgtggtataaggttttgcaataacagccccatttgtttaagttacatctatagaaagttgactccattttttttcttttaccagtcattagtggaggtcttgattcaatgctcatgttgtgggacttctccaaagggcgcccctacaaagtagtggattttggtatattttttcataaatatcttaccttgtctttactaagtatcgtatgagattacttgaattatctaaattagagcctttgattttttttatttatttcacatttgcaatgatattaagtccacacatctctactaatttttcagaatgcatttagcaaaaaacttcaaggataacgattgtttttaattatgttcaaaggcttttgcaaccatagtcacctttgaccatggttctgcagcagacaaaaacaaaaggtttggccacttaaaaatattttaccaatgaaaaaaaacatgaaaatgctgcttgggtactattgactatggagaatgcaagtcacaagcagg

SEQ ID NO: 7628 - DNA, 409 bp, Glycine max
aactatttagccatatattataatactttatttagggttacaaacactataattagtaactaggtaatagggacaagtagtcaatttctctctttcatttctagtctaatacttgtgcattgtttggttactttggtattttaattgcgtgatgaataacaactgaaatgcacgatggcagatgacaccgtgggcacaggagttaactttttggtgctggcgttgtccccatcctcttcactctgatgaaccacagcttctgatgctattgggataacttgatgtagaccaacttttcaaaacaaattttgtaggaacatcctttttcctctttatgttgatttgtaatcctccgtggtagaaagatattacatttttcttccgtggctgatcataatggatgagtacg

SEQ ID NO: 7629 - DNA, 435 bp, Glycine max
tctcgtgctatacaacaacatatcgcactaagaacttttcaggtgcgcctttatatgcatataagaatgttctagattttaagaaaattttaattttttttcacatcaatgaatacggagaaccaaaagaaaccattgaaattcacattggttgatgttggagactcagttttgatttggagagtgtatactcatacgctcgatgcaacctttttctgaatcttctgaggtctaacatgacattttggctgtcaagatagatcttctttgtgtattcccaccccttcttgttaatgcttgtagggtctctcagaataggatcatttttatcatatttctcatacaaagtgctctctctaggcaaaatttgatagccaatgtatttcaatccaagcttccttgctggttccccataataagtttctgcagcccatg

SEQ ID NO: 7630 - DNA, 560 bp, Glycine max
  misc_feature (542)..(542): n is a, c, g, or t
  misc_feature (544)..(546): n is a, c, g, or t
  misc_feature (550)..(553): n is a, c, g, or t
agatgatgatgctttacagctttgaaatagcatatgtaggcagattattaaaccctttaggaagctccaaatctttccatcctttatcatcaagtttagagaagtaacgattaacatcgctatcactaagaagctccaatttggaaggttcccactgaaaaagacaccaagaccatgagaacaaaaattaaatttcaataaaaactaatttacgagtagaaatgttcatgattaaatgggaaaagattaaacaaaatcaaagtggctacccacctttgggtttctgtctttatctatcagtatagccctacaaccctgcagtaaagggtaacattaaccatagggcatgaaagaaaaataattaaaagcataactatgtataggaatcatcagataacctcgaagaaatccttgctgtagtgtccttttagaatatgacaaacaactctataatcagaaacaaggcattgtccaacaccttggagccttccttgtctaatctgaaaaggccaaaataaatttaaaaaaaaaaacagttatantnnnaatnnnnatagtaa

SEQ ID NO: 7631 - DNA, 384 bp, Glycine max
tctgaaaccctaatcatgccgccattagcgtctctgcaacttcggaggctcttactccgttctcgttccttaccattcacatctccctctccgattcatcactctcctctgtttccccgacattcctcttcccatttctattctcgaactctcttcaccccttcgttcttcataacaagacatttctcatcggaaacccaaacggatgagattgctagctccctctcctcagagcttctcaaagagccagactcggacgctctctccgtctcgcagcgcctcaacctgagcttctcccacatcactccaacccccaatttaattctccaaaccctaaacctctcccctcaagctggccgcactgtattagggttccaccaatgg

SEQ ID NO: 7632 - DNA, 385 bp, Glycine max
ggtatcattgattgaccagactaatcattgtgtaataatgttttgtccattctcttttctgcttgtgtgattatcaggctttacaaaaagcatggggagttgcatgctctacaccaaaatctgttttgttaattcctcaaggacgccgttaccttgttaatgcaacaagattcaaagggccttgtgcagacaagctcatcatccaggtgatcaaaacacacaaatacatagatttaatagttttcctatgattattgacatagtatctgcatttccagattgacggtacattggtggcaccagatgagcctaagaactgggatccaaaactgccacgggtttggcttgatttttccaaattgaataaaactgttttccaaggttc

SEQ ID NO: 7633 - DNA, 473 bp, Glycine max
  misc_feature (423)..(423): n is a, c, g, or t
  misc_feature (426)..(446): n is a, c, g, or t
  misc_feature (448)..(454): n is a, c, g, or t
  misc_feature (456)..(467): n is a, c, g, or t
ttcatctttggttctaatccctgtgaatatcagcttatgttttatgttgggggtttcgatttgaactcaagggtatctgttcttatcgcacatccaacgttgaagcttgttatgataattactagttagtgccttcgcttatttcctatctgcggattatgagctttattttgattttgaaatgatgtgtgagcataagagatggctttccagttttgtggtggtgccaggcttagtcaactggtaataaatagtgttccaattgagatttcagtttctgttctagcgtgttttttctatctgcatatttaaggattagggtttgggtttgtgttccaagaatgagcagttcgggtttgggtggggggattttggacttgggagtctccatttcataaacaaagtctccatttcataaacaantgnnnnnnnnnnnnnnnnnnnnntnnnnnnnannnnnnnnnnnnaaaaaa

SEQ ID NO: 7634 - DNA, 531 bp, Glycine max
aatcacttagttgagtattttaccaaaatggcaaaagaaagctaagatatatatgtagtaaaagaatgataatatgaaacatccttggaaattggaataatgcacaattaggaaatattaggtgtacttgtcctctttctcagaagattctttgcaggactctttcactttttcttgcattgcctgcagctgtaatttcacaaacttatcctcctttgcagctatggcttgttgaatgtcttggatttggctctggaaatttttttctagtgcatccatctagaaaacagtatttcaaaatgatcatcattcagaaagctacaaccagaatcaagaaagacaaatttataaaattcctccccagaaaagatcacactaaaaaagttgtacagcaataaaggcttgagcagacaccaaaaaaatggaagtgagaaaaacaggaacaaataaatgaagttgtaagaataagaaaaatagccttatcttatcggtttggtttctcgtaaatatcatattttcataaagacagcc

SEQ ID NO: 7635 - DNA, 400 bp, Glycine max
gagaaagaaacagaagctgtccatggctgctgagaggaacaagaatttgattcatcaacatgattaagctgggacaaaatttcacttcccatttcctagctctcatactctggacttgaatctcccaagatagacggtgctgcatccaacctcgttaaaacttcaggaatcccggccgtgttccttattatctgtgcatcaaaaccagaataaatattcggatataacaatgttttgattcaattatttgtagataaaaatagtattgtatatgaataccctttttttatttgtaggaattgattgcggtaccaaaaagtttacaacactctacaccttactcaaccaactgagttagacccccttaatatatatggctaccctttaattgacctcacaa

SEQ ID NO: 7636 - DNA, 315 bp, Glycine max
ctgtggtgtgccctaaacctcgaagattgggcctgttgaaccactcaacctttgataaccacatcagacccttgaggccaccctttatcaagtattcaccctactttttcctaaaaaattacatcatacctttatttttgttgaattttttcaatcaatttattttgtaaaatttctgactttatatatatttttttactcatacagctaccaatcagaaattgaagattcaggagttggggctgagcttatggacattattctccccaaggttattttttgtctcaatcttcatgttgaaaagagttttttttt

SEQ ID NO: 7637 - DNA, 659 bp, Glycine max
ataatctccacgagaatatgttacaacaatttctaagggttgaaaaagtggtcaccacaatggcatttccaattcaatggcttgtaattggagtacctgttagtgttaccttggagaaagaaaacttccattgaagcagttgggggaagaagacctgggtgaactcgttcatggttaggcgaggttggaacttgcactgccatgcatggatgacactggttgcacttgttgtggcaagtgggaggcattgaacctaatctgttttgctcctcacataaagggtcctgcacataacataatacccaacttagtcattttcaaatcatacacacatcccccttaagtaaggtgttgggttcgaacattatagatgaaaaaaagcatagttggaaggagatactccactaaaagtgattagtcagatttttcaatgaaaattagtcatcagatgaatacttcacaccaatgtcatggataccagaaaaaaaatcacacacaacaacaaaacaaaattatggatttaattaaagcttactggtggaggaattgcatgttgtggttgattgaaacaagaaactggaaacagcagatggtggagtagaaatgtaatgagaataataagaagcaagattgtggtggtggagttctgaattgaattg

SEQ ID NO: 7638 - DNA, 778 bp, Glycine max
  misc_feature (771)..(775): n is a, c, g, or t
gaactttgcctttttgtgaaccaagctagtaaattcccccatgtgaactaatttgatgtaaaaggtagaagttattattttccatttgaaggtttttttacaaagagacactattcttttgcataggaagagttatctagtcaatttggataatccttgagaacctcattcttatcttctcttgggattttctgctttttattttgttctgctcaagtttatggtttttgttgaaaatgatgaaatctccatcacaatcaacatatgaagcaagccattatgatgactatggatttgatctgcaacaagacttttgccaggtaataagaactcgattgttagttttcaaattttaacaaaaatgttgcactttatgaactggttaataaagttctcatgtcaaagtatgcgataatgtgagaaaagatttcaacaaacattctccaattttggtgttgtattgagatggttttcgtttttactttgatcttgtaagtaatgttttgtttttttgtggtgttgactagttcttggaggaagcaaggcaacatggaaaggaagcaaaacttaagagttcatcagtgcatccataccttcgcatagcgaagagcctctgggcaatggggtacgaagttttaattgagatggttttcatttttactttgatcttgtaagtaatgttttgtttttttgtggtgttgactagttcttggaggaagcaaggcaacatggaaaggaagcaaaacttaagagttcatcagtgcatccagnnnnntct

SEQ ID NO: 7639 - DNA, 640 bp, Glycine max
  misc_feature (553)..(557): n is a, c, g, or t
  misc_feature (573)..(576): n is a, c, g, or t
  misc_feature (579)..(581): n is a, c, g, or t
  misc_feature (583)..(587): n is a, c, g, or t
  misc_feature (589)..(590): n is a, c, g, or t
  misc_feature (592)..(593): n is a, c, g, or t
  misc_feature (595)..(595): n is a, c, g, or t
  misc_feature (601)..(605): n is a, c, g, or t
  misc_feature (614)..(615): n is a, c, g, or t
gacaattaatcatttcttatttgttttccttttgtcgtaaaaacacataaattttcttttgcatttgcaagctccattgtaataacagcgaccaacgcaccaatcttaatccttgtttttctcatttgtcccaaacaaaattaatttttgaggaacactttttcgacacctcaaaatcccacctgcagattctcttccatcaatttcaggtttcactttcttctctttcctaaaatattgaattaaggttctgaatttaactaattttccttttccatgggacttttcaatttggggaaactgaaaaaagatgatttaatatatatggggagtctttaaaatttggccttgaatctaatttctgggtttatgaaagaaaagaaggattttttttttttttggttttgggggggttaaaaaaaaaaaaatttaaatttaaggcctttaaaaaaatttaaaaaagggtgggggaattttaaatggtaaaataatgaatggttggaaaaaaagggttggggaaacccaaaaaagggaatggaaacggaaaaaagannnnngacccccaaaaaggannnnccnnngnnnnncnncnncntttcannnnngggaatgcnnaagggaaggggggaacccggtgggg

SEQ ID NO: 7640 - DNA, 394 bp, Glycine max
cttttagtcactacgaatgagaaaacgtttttgttttcattttctgttttttacttttaattacaaatctgtttccttacttccaatctatttcctgttttgaaatatgtgttcaaaactttccaccttgattcattcttatgtggatgcaggtgaaggcgatggagttgattgatgagctggaggtgacaaggagggggccttacagtggaggatttggatacatctctttctctggtgagatggacattgctcttgctctcaggacaatggtatttccgagcggaaccaggtatgatacaatgtactcatacaaagacgtcgaccaacgccgcgagtggattgcttaccttcaagccggagctggtatagttgctgacagtgtcccagtccc

SEQ ID NO: 7641 - DNA, 569 bp, Glycine max
cttatacataattagtgcttacataatgaacgtttattcaataagcatttaattaagttgtttattaaaatgtgcccttctcatgcattaatttcaatggatttagttgttacaacatgtagttaggtaatagtgagaagggtttagttggtttgagggacttgttaattcattgtgttctgattttgataagggagcccgcgggttgagggagatgatgacgaggaggatgtggatgatattgaacatgaatttaacatcgaggagcagaacaagcataaccattctgctgaagccatgctgcatgggaagatgagttacggaagaggtcctgaagatgatgagaatgctcaattcccagctgttattgctggtggtcgctctcggcctgtaagatttgcaaaacattaccactctataaaacttcctatattcaatagacacttataacaagttttcatggatgcaggttagtggggagttaccaatagcatctcattatggggatcaaatgttagcttcttcactgcaaaatcgatcgcacccatatctggcgtcggatcctcgta

SEQ ID NO: 7642 - DNA, 758 bp, Glycine max
  misc_feature (64)..(67): n is a, c, g, or t
tgtctttgttcttacctctgtaatttggtgttcatactctctagtatcattcagagagcttacnnnntctctgggtatgcaatccccttacctcttcctctttcataccgcagaaagaaccatgatttgattttatcgttttcatactatgattcttttttatgttggtcctttgactcctttctgctcatgttcacaagccttgatgcttgacactataagtttctgtgggtagtagactataatattctgatctaaaatgagactcaagtgagaagcaattattaagtttcacagttcttcaatattcttgtaataagctatgatcaagttgcaaacttatgcaggccaaactctacaaattcaggtgccgatagcttaggcaataaaaacagcagctacgtaaaagggcctgttgtggaggaattcacttttcctgaaagatcaactcccttcaacagctgtcatgcttctaccattgttgaggttgtaaattacaaaatagtttttgttctggtccttgttttaaataatcattgggtttttgtcatagtattataacagaatatctatttttacttcaccaggttgggaagggtcattttttggttgcctatttcggtggctcatctgagggggcaccagatgtaaaaatatggttgcagacttataaggtagatgcattaattaaataattaaatctaccgtatatatagatagatacaatgttacattgtcatctatctaacatttgccga

SEQ ID NO: 7643 - DNA, 447 bp, Glycine max
ggctggagattaggtagagacaaaattgggcaagagatatggggtagtttttatgatgctttggggaatgaatttaatatccatctatcgagaatgagtttgatgtcagcactggaatggtggctggtataccatcccagcatccagaagttctcatggaagcctcctcacacccctttctcctcccctctcttccttagtctctccatcctcagctacctctccctcaccctcctcctcaccctcctccctctcccacccttcccacaccgcctcctgaagcccatcaccgccctccacaacctcctcctcctcctcctctccctcctcatgctcctgggctgctccctcaccctcctcatccacacccctcacctccgctgggccgtctgcttcccaccccacaccaatcccaccgggcccctcttcttctgggcctacatcttc

SEQ ID NO: 7644 - DNA, 889 bp, Glycine max
  misc_feature (786)..(788): n is a, c, g, or t
  misc_feature (824)..(833): n is a, c, g, or t
aatgtttctttcttgccaaaggtgttaaatctttatttccattaatccattttattttattctttcttttgcactggtgcctttgtcattcatggtctgtgatgtattgtctctgtcttatcgctggatttaagccgagtcaatgaagcttctcatttgtcttcctgtgtaaagctgagaaactctcctgtatactttttaaaatcagaactggtaatttgttgcttgatgtgtaaactgcattgatcaggaaagagagcctgcatgtccacatcactgccctcggcgatgccatcctggagactgtcctccatgcaaggtgctcattaaacggtcatgtcactgtggtgcaatggtccatgtgtttgagtgcctatattacaacagcttgtctgcaaagggtcaagagactgtccgctcatgtggtgggccatgtcacaggtaatttagaaagtggcaaatttaactttaaaaaaaaatctagtttagcatttgaaactaactgtaagttaaaaatctgttaggctttcgttcctccttgttccttgttctattaattgattattgaagttagatgacggctctattggtcacattgctttgcagaaagttgccaaattgtacacatttatgcccagagacatgtcattctggtcaatgcacaaatgctgagaaatgctgtaaaaaggtacaacacaattcaatcactataacttcatgccttgaatttgaatattacacaatcagctcaaccagtgcttttgtattactgttctagctactgcnnncgaagcaaatgactacacttattttgtatccaatcnnnnnnnnnnatatgaaatcattcttcacaggtcactgttcgatgcaaatgccatacatgaaaaaa

SEQ ID NO: 7645 - DNA, 855 bp, Glycine max
  misc_feature (35)..(36): n is a, c, g, or t
  misc_feature (62)..(63): n is a, c, g, or t
  misc_feature (794)..(800): n is a, c, g, or t
  misc_feature (802)..(803): n is a, c, g, or t
gttctttgttgcttcttttgctgctgcttgcactnnggaaaagctccagcctttgtttccannttttatggttatcgacactcggcctcagacacaagcagacttaactccccctcttcacaaacctggctttcctgtcttggtaacttgctcacacagtcacaccaaaaacaccatttgcttctaattctaatttatcatcgtattgttgttattgcttaggaaaaatatgttcttcacttatcaaaatattaattctagtctttataaaagttctatacgttattaggttctatatatgtgtactaaaaattaaggaattttagtctcttattagaaacaaaaaacacttgtttttattaaactatgaaaattaaaaatctatataaaaaatttagagtttaatccttatatattgttttacattgttatttaattaaatttttttattaatatgaattttaagataatttaattaactataggtgttaaactgttttatatcatgaatacatgtcctttttattccaaatttttatagtaattaaaattaacatttcaaaatattttagaagagtaaaacatgtttgactcatgttattattattattctgcaaggaaacaattaatgagttttgttttgtggtgttcagatgatgaggcataaccgatgtgagagcttgccggtgctgatgccaggagatgaggttccaaaattcatagcactagcatgcccatgtcagcctccaacaaatgaaatgatcacaatccatgtgcagaaggcagcaccaaannnnnnngnngcggtgcttaaagggacacaaattaattataaattaaagccttaattaataa

SEQ ID NO: 7646 - DNA, 492 bp, Glycine max
tccaagaacatgaatggagtctttgctagtaactcccatctcaaaagcttcagcaaatcatccaagagcacgaatggagtgtttgttagtgagtctcatctcaaaagagtctgcaaatcaaagagctggtcgttctggaagaacgggtcctggaaagtgcttcctactgtatactgcatacaattatcacaatgatttggatgataacactgtaccagaaatacagaggactaaccttgcaaatgtagttttgactttaaaaagtcttggtattcatgacttattgaactttgattttatggatcctccacctgctgaggccttattgaaagctttggagcttctatttgcattaagtgcgttaaataagcttggtgaattaactaaggtgggcagacagatggcagagttcccacttgatccaatgttgtaaggtgaattaactaaggtgggcagacagatggcagagttcccacttgatccaatgttgta

SEQ ID NO: 7647 - DNA, 384 bp, Glycine max
tggactgtgtgatctgccaaagttaaagtatgacatgttgaagccatttacacatctaaatcaactctgtattcaaaaggtatcattactacttctatatatatgaacaaattgccatcctgttaaaattaaaatgttgtgaacctttcccttatacagttatatatgctatgttgagtcttctatccatcttctacgcatattagcttccatttttttatgatttatctacattaagtcagataatacagttactattcaatgttgatcatgatgaatttatgatggaacatgttgcaatattcatgatgtgaaaaagcatttgaggtatgatccttattctcgttattttcttctataaccttcctaatgacttgtttgctc

SEQ ID NO: 7648 - DNA, 545 bp, Glycine max
  misc_feature (55)..(57): n is a, c, g, or t
  misc_feature (382)..(382): n is a, c, g, or t
  misc_feature (384)..(384): n is a, c, g, or t
  misc_feature (387)..(387): n is a, c, g, or t
agcaccacatcccaacatgtcatcatgagcacttatcctgcaatcagataatccnnntctggtggttcatcattatggttcagtttgtcaggactactatcagaggctaatcctccattcctgcaatctttcaagctctgttcaccactcactggcaatgccactggaaagccattggcttctgaaatatcattcctacctgcgatagagcctttcaatggaaagatgcttctattttctggtagatctgagtgcttcaagcaaaaagcccgcaactcaacctgacaaagcatgacacataacaatcaactcccatatcactacacttgaaacacttgtgacataaaaaacaagcgttattgataaattaaaaactattccnanatnaatatacaacatcttgcttaacttccttttttttactttctttctcgactcttaaaaagaaaaatgaatttgccccaaaacatacaaaataatcccattattgttaccctactttgcccaaacccccctcccaagtctaacttcccttggacataaag

SEQ ID NO: 7649 - DNA, 593 bp, Glycine max
tgcatattaaagagagtcacaagccaattctgaaccacacactcacttatttgtttctttcaactcactcacagagtaatggcatccatggcggctataggttctctgaatgttccttgttctgcttcttcgcgttcatcgaatgtgggaagaaaaagctttccacgcagcctttcattctctgcatcacaactttgtggagacaagattcacacagattcagtttcattcgcaccaaaaatcggtcgcaatcctgtaattgttacccctaaagcagtttctgattcccaaaactcccaaacctgtcttgatcccgatgctagcagagtgcgttcacctccattttctttctttccttgttattacataaaattagtgagaaatttgaaatccccattcttatatttcttagggtgtacttgttgatcaaattagaaacatgaatttttttttttttagatcacaatagtgaattttgatcgtgcgatatttgattgattctggttctgattgtgattgcaatttgaaaatgtttatagagtgtgcttggcattatacttggagggggggctgggactcgtctttatccacgg

SEQ ID NO: 7650 - DNA, 731 bp, Glycine max
  misc_feature (432)..(434): n is a, c, g, or t
  misc_feature (437)..(444): n is a, c, g, or t
  misc_feature (446)..(449): n is a, c, g, or t
  misc_feature (451)..(454): n is a, c, g, or t
  misc_feature (456)..(470): n is a, c, g, or t
  misc_feature (475)..(476): n is a, c, g, or t
  misc_feature (478)..(480): n is a, c, g, or t
  misc_feature (482)..(482): n is a, c, g, or t
  misc_feature (486)..(494): n is a, c, g, or t
  misc_feature (499)..(504): n is a, c, g, or t
  misc_feature (506)..(506): n is a, c, g, or t
  misc_feature (509)..(523): n is a, c, g, or t
  misc_feature (525)..(544): n is a, c, g, or t
  misc_feature (546)..(546): n is a, c, g, or t
  misc_feature (548)..(553): n is a, c, g, or t
  misc_feature (556)..(561): n is a, c, g, or t
  misc_feature (564)..(567): n is a, c, g, or t
  misc_feature (569)..(580): n is a, c, g, or t
  misc_feature (582)..(583): n is a, c, g, or t
  misc_feature (594)..(598): n is a, c, g, or t
  misc_feature (603)..(610): n is a, c, g, or t
  misc_feature (612)..(612): n is a, c, g, or t
  misc_feature (616)..(621): n is a, c, g, or t
  misc_feature (623)..(631): n is a, c, g, or t
  misc_feature (633)..(638): n is a, c, g, or t
  misc_feature (640)..(648): n is a, c, g, or t
  misc_feature (650)..(657): n is a, c, g, or t
  misc_feature (659)..(664): n is a, c, g, or t
  misc_feature (666)..(669): n is a, c, g, or t
  misc_feature (673)..(683): n is a, c, g, or t
  misc_feature (686)..(697): n is a, c, g, or t
  misc_feature (700)..(706): n is a, c, g, or t
  misc_feature (711)..(725): n is a, c, g, or t
actttgcgaattcctcacggaaaacgttacggaaacgtttcggaagcgcctcggcttagattttcttcacggaaacaatttttccaagcaaattcaaaagaaaaagaagtgcctaaggggctgaacccttttcttcttcacttcctcccctatttatagaaaaataggggagatggttgccgcccagctcgcccaggcgagctgggttgcttcctccaaaagcaacagccttctggagaaatcttcgggagggcccaagggggcctgggggctatttgcacccccgtttttactaagtacccccccttctgttttttttgggccctttttttttaaaaaggaaaaaaattttaaaaatttttaaaaaaatttttttttttttccaaaggggggaaaaaccttggaaaaaaaaacaaacccttggaaaaaacnnnctnnnnnnnntnnnngnnnngnnnnnnnnnnnnnnnctgcnncnnncncgtnnnnnnnnnacgtnnnnnntnagnnnnnnnnnnnnnnncnnnnnnnnnnnnnnnnnnnntntnnnnnnccnnnnnnttnnnnannnnnnnnnnnncnnttttttttttnnnnnctccnnnnnnnntncctnnnnnntnnnnnnnnnannnnnngnnnnnnnnntnnnnnnnntnnnnnnannnncctnnnnnnnnnnnccnnnnnnnnnnnntcnnnnnnntttannnnnnnnnnnnnnnttccat

SEQ ID NO: 7651 - DNA, 681 bp, Glycine max
  misc_feature (656)..(657): n is a, c, g, or t
  misc_feature (659)..(661): n is a, c, g, or t
  misc_feature (663)..(663): n is a, c, g, or t
  misc_feature (665)..(666): n is a, c, g, or t
  misc_feature (674)..(676): n is a, c, g, or t
tgcatgtgaatattaattaattaatttgtaatttgtgttgtgattatatatatatcactattatatagtatatgtcaaaatttaattttatgtattttgctttgttaattgttgagataggtccaatgttcatgtactccactggaaccaatgagcatctatatgtggagacacccgaattagtaaaatggataggcatgcacaagtccttgcacctaggccggccatcgtatctaaccaaaacattgaagcctttgctggggaatggcatcattaggtctaatggactgcactgggcattccaaaggaatctacttgctcctgagttttttcatagcaaaattaaggttagaacaatataccctatggtcggcataaattaatatacatatagtatcatttaatatatttttattgtcaatgtgggtatatagagacaagtagttaaggttctagaattaactcgtatcttattcatgggttaaagttataaactcacttagtgttaaacctttctctaggagaaccccctaatgtctcatgaactagttgagtataattgtaactacataaaactgtatgtcgtaggctagtgcagtaatttttcaagtgagactttgctggaaactccaacatgtcatttgcgtctgctcgtnngnnntncnnctccaagnnnatctt

SEQ ID NO: 7652 - DNA, 234 bp, Glycine max
tgtagacaaattcaacatgaagtataaaaaatcaagttaaaccggtcaaagattgaatgttgttaatctgtctcttataaatttgtataatttcttcaggtatgcttcaaaggagaatgtaactggcttctgtcgttcgtctcagttgaaagtagcagacttctcatttaattttttagttggtagcatacccaaatgcttggagtatctttcaaggtacttttctgataccct

SEQ ID NO: 7653 - DNA, 601 bp, Glycine max
  misc_feature (35)..(38): n is a, c, g, or t
attacacataatgggacctatattgtgtaattgcnnnngctttcattaaaagaaggggaaaaaaagtaacttataaatgaaattatgaaagtgtccatttacatattagaggtgtgtgtatcttaccacaaacatggcaatctgagttgctgaacctaatgcaacacccaatgagatgtcctgtgttcaaggaattactttagtttaactaaattaacattttaattaaataaatttattgcttggccaatatgataatattatcactctctcagttctcaccagcttgttcttgaaggcaaatataattgctcctgcatgttcagctgcattgccaactatcggtagcaagattatgcttaggaagctcacagacaaaccccatgaatctgatgcatcctgttatgtttgacaatattaattaccatcaatatttattatagtcaaaactaaatggacttcattttttgaagaaaaaaaaacattttatgtcaattattacctcaattgtatccaccacatattcagacaacacagcaatgaatacagtcattccaaccaaccaagcaatgccactccataatccaatcacagcttgttc

SEQ ID NO: 7654 - DNA, 404 bp, Glycine max
tctcgtctgagaagaactctgatcattgctggtgagatccttcttctctgttcctccaattccttcccacaaaaccctaattttaattttccatcgcaattccctctccccttgttgttgaaaacccattattactcttttttcctctcaaaaacttagaaccaaaagcgcaatgctatctgggagattctcgtttttcggaggcggcggggattccggcgcggtggtggataacaccaattcgtcaccatcaaagtgtggcgaagaacaactcgctgttgttcaacccacactgaagctcgagaccgataggcaggtttacaggcccggcgatcctgtgattgtgaccatccagatctcaaatcccgcaaaggggtactcgtttctgatggaaagactcgatt

SEQ ID NO: 7655 - DNA, 605 bp, Glycine max
gcagcaaatttggtccagaatggtcctcttgcaggtaactttctttttcttggctccctatatccccttcccggcttccctcaaaggaattgttaaaatatccacaggattcattcaattctctgattgtccccacccccaagaatgagagggtaatttattttaaagatatattgatatattgattctctgattacagaaacacctgacttttgctttgcatggtacagttggtatcaatgcagtttttatgcagacatatattggtggcgtctcatgcccatatatctgcggcaagcatttggatcacggggttcttttggtggggtatggttctggtgcttatgctccaattcgttttaaggaaaagccttactggatcataaagaattcatggggggagagctggggagaagagggatattacaagatctgcagaggtcgcaatgtatgtggggtggactcgatggtctcaactgtcgctgctatacatgtttctaacaattaaatataaggatggatgcctaaacgtggtaggggcaccagtatagtatgtatgtaaataatttgcacgatgtaatgttatgaaggaggaaactgctaaa

SEQ ID NO: 7656 - DNA, 343 bp, Glycine max
tctaacggagtatttttctagttgattaatctcgtacctgtaattggtctgcgaagaagctggacagaggggctcgcgagagagaaacatcgttactttaacgttagttcatgttgtactgttatttattttgcttcttactgtagttacttctcaaacgaattgaagaagggtagtggggtccacagtttagggcctgtgattttttgtgctgagaagatgacgtggcgtttggttggttttgttttgttttagacttaagagagggactcatgtggtagagggcgaagagtatgattgtgtggccaaatgagtggatggatagataaaatgttcaacaagt

SEQ ID NO: 7657 - DNA, 416 bp, Glycine max
  misc_feature (410)..(410): n is a, c, g, or t
ttttttgttgttgttgctttgaagtagtgggaacaaagagaaacaaaccccattatatcattgccacacttttctctccatttcaatactattgctgggtttgcattttgtcccttttgctccttattatcactttgtttcttcttcttttctcttctctttttgttttatgcaccgttgatccctcttttctctcaaaacattgccgaacaactcttggattcatgtgggttttatcatttctcaagcaatgataaatgcaacaaaatatttggtttttgtggattttcctttttctgtgaatagtacccttttttcttttcaaattggttttgattttgcatttggagtcagtgttttgatgcttcaggtaactaagtagcttcctgatctgtgctaggctcccattngtgatt

SEQ ID NO: 7658 - DNA, 826 bp, Glycine max
  misc_feature (767)..(773): n is a, c, g, or t
  misc_feature (809)..(811): n is a, c, g, or t
ggcaggtcatcatcatgtcagtagatacagagaaaaaataatccatgaagttgtttcccttgtgaggagattcatactgggttatcatcatgagaaacctgaagtctccaagtgacaaactgaatatatgcgtagttgatgcccatagcaattccaaaacccaaaactgatgaaagtagtatggcatatatggctgtcaaatgcaactgcaacaaagtcacaaagctttagcatatcaaaggtacacttgagtcagacaagtaatcaactaaggagctgggatgcatggttttcttaattaccaaggaagactgcatgacaaaagaggaagactgcatgaaataatcagaacaataatattgcatgcggacagacatcttaacacgctctgcaattcctttagacataaagtttgcaggatacggcatttttgggtgatccaacatcacaacttgacagtggataagatctgataccacagtagaaataaaatggacttaactacaaaaagctaattcaaggggaggagtggggcgatctgcggaggcttataagaagagctttgaccaatgaccattatatctagaggacatcttaacacttctattccagaaaaacacaaaggataatgcatgaatgcaccagatacattcaaagttgtaacttgcaactaaggaggcagaagtaacagattaatcatggcggttattaatatgaaaatcttgaagtaatagtcattattatgcctttgattcatctagcatcannnnnnnaataatgaacaagaaatctctacattcatactcacnnntagtataaaatagat

SEQ ID NO: 7659 - DNA, 713 bp, Glycine max
  misc_feature (59)..(59): n is a, c, g, or t
ctctgagagcctattactggtctgttgatgagaagcttctcatctatgattatgttccnaatggaagccttgctacagcaatacatggtaactttcatcaaaggcaattctatattttttctaatcacaatttatgatctcttcttttggtactatgaccttgtttggataattttttcacaaacacatattggtatagaaaataaggtaacatgaattgaacttctttcataaactaaaatcaacttcggtacataacttttataaaagctctctcatgtaacttctcacaaagttgagttgtataagttgattttagtagcttatgagagaagttcaattcattttactttttttattttcttctcttataggcttttatgaagaaatttaccaaataggacttatgtcactttgtccattgattgttggttccatttgatgtcttcagggaaagctggacttgccacatttacaccactatcttggtctgttagagtgaaaatcatgaagggagttgcaaaaggattggtctacctgcatgaatttagtctaaaaaaatatgtccatggagacctgaagcctggtaacatactgttaggacatagccaggagccctgcatttccgatttcggtcttggacgccttgctaacattgctggagggtctccaaccttgcaatccaacagagttgctgcggagaaatcgcaaga

SEQ ID NO: 7660 - DNA, 425 bp, Glycine max
  misc_feature (387)..(387): n is a, c, g, or t
  misc_feature (411)..(412): n is a, c, g, or t
ctctctctgggttctctggcatcaagttcgtaccttttgtggtttggatggatctaatgccagtttggttttctggggtgtctgtgttccttaacccactttcctcctttttaggatactcgtctaattgaatttttttttccttttttgctcaagttattttctgattttggttcttcagtttgcttatgctgttttggtggctttggaagtttgaacaagggggttcttagatccttttgcacttttcccttgctgaaatttttcagacatatcaaatatttgcgtttatttttttccatatgagcatagctcttgaaatagagaaagtctctttagcttatttttttttattttttttttggtttaaaaaaacttgtgaggganaaggggaagaaatcaagggggggnngaatttagtttgg

SEQ ID NO: 7661 - DNA, 632 bp, Glycine max
gtcaagaaaggatgatggatctgacagttgagatagaaggggagatagcaaccctggaggaggcccttcgacagtttacaagtgctgagactctggatggagaaaacaagtaccgatgtgtcaggttggttgatcttggagaagcctcatgaaaactttcaatattatcttaccatttttttcagtgtggtcatctttgacacatagtttggactactagtttccttacatttttgtgttgagcaggtgtaaatcttatgagaaggccaagaagaaaatgacagttttggaggcacctaatgttcttactattgcattaaagagatttcaggtatttgttacatttaaggataagattttatcaagcatcttgtatgaagattttaagatttgttgtgttattgcagtccggaaaatttgggaagctcaataaacctattcggtttcctgaaatactggacttggcacctttcatgagtgggactagtgatttgcctatatacaggctatatggggtagttgttcacctggatatcatgaatgctgctttttcgggtcattatgtgtgctatgtgaagaatttccaaagcaggtggttcaaggttgatgacagtgtggtaacagatgtaaaa

SEQ ID NO: 7662 - DNA, 479 bp, Glycine max
  misc_feature (429)..(431): n is a, c, g, or t
  misc_feature (434)..(438): n is a, c, g, or t
  misc_feature (443)..(448): n is a, c, g, or t
  misc_feature (454)..(463): n is a, c, g, or t
  misc_feature (468)..(469): n is a, c, g, or t
  misc_feature (471)..(472): n is a, c, g, or t
attaagaaagcatatacctaatatccaaaagtaggcaatgctttaagaaattacatagcatatacattttctcaattccgcggctaatgtgtatacatcaaataattaagagaagacaatttaagttaacatacaggtttctggcaagttttaacaagtttggggcattttatcagattactatagcttggtatagcacaaccaatcttcttcaattcttgaaatgcttgtatggtctcaagatcaaagccacctgcaaactgaaaggcttcatggttgatgagttggataagaggaaatgttaacttagggctgtttgaggaatgtactctacctggtgcactctgaatgcaaacttaactccttgtacaaaaaggttatcttcctgcaaaagttcatttgactctaattccttggtcatacgtaaannngannnnnagttnnnnnntgcctnnnnnnnnnngcacnnannagaattt

SEQ ID NO: 7663 - DNA, 492 bp, Glycine max
tcttgcagcagtgtgtgtatattccatttttgatggggagtttgtcattcatgcttagtgcaattctcaattatcacgagaaatctagagatatccaccatggccttcacttacttgtaagtaccctagctagatacgtcttaattatttgatatatgaattcaattaactaaaataaacttcggcagtgattgcaatatgtgtactaatgagagagacaatgttgattattgacacagggtggtacttggatctggctaggcatctttggaagcctaatgttctttattggtggattgacaaacttaatcaaagtgttcaagatgcaacaaatgaatggaattaggctggagaaactgcgaggtgaagcacatgaacgactgctgagtgcgagagaagcacagattcccctgatcatggaacatcaaacaaatataagccatcaacctcaagagaccaaagttactttacctcttcccacaccttacaagg

SEQ ID NO: 7664 - DNA, 372 bp, Glycine max
cgtgcttggtgagggtggtgcaatactcgtgtgggaaggagagaaactcgctcacggtgccctgcgatgtgtggagaatggactgtggtgggtttgcatggagattagacgttaaaactgcgcttagcttgagattgggttattagttcacaaaggtatcacgaactcgaaatacaaaacggcgtcgctccatggtcgtagaactataacactatttcttctcttttaagagcttagaatcgtgaatatatatatctatatatctatatatatatatatataactactgacgctaagctagcttgtttcactgtaaattcatatatgcatgtagcttgtcttttgttctcttagatggttttttctgatttg

SEQ ID NO: 7665 - DNA, 505 bp, Glycine max
atcagaagaagataccccaaccacaggttcctcctcactttttactactgttgttttaatgtcgattgtgtttagggtttcttgggttggactcgtttctgttcatgtttgatgtctcatttccgtgaatggtgtcaggaggacgatgctccccttgtcgaggacttgaaggatgatgacaaagacgacgacgatgaagacgacgacgacgacgacgaagatgacaaggaagacgatgctcaaggtcctcttctctttcactgtgttttcctcttagcctaataaaatccttatttggtcctttttttatgtttttgttagtaaaccctatggttctaatcgattatttggtttccgcgtgcttgtgcatttttctagggtttgtgtggagttctgtatttatccgtgagacctaattcatgttggaagaattatgactcctatttgtgttaaacaaattggcatatagattggattttattcttattaatcatactggaacgat

SEQ ID NO: 7666 - DNA, 400 bp, Glycine max
ttggagagaatgactggttaacacgaagcacctcttggctgaagaatgtttctgaaaatgtaactgagatgattatgtcccccagaactcccaaggaatcttttcttgatcagcagctatgagcctatgaggtggtgctatcagctgccagatagctattccctgctcagccttctttggtttctgtttgctactgcatagtacctaacggaggctggatatttcctttatgctattaagaacagcagttttgtttacaggcaataggtacacgagaaataatttactattttctattacattttttctccaacccttcggttgttttatacagtatgatccgaataaactccaaattgaaaaggctttcagtttgaacatctttatacgggttatttgc

SEQ ID NO: 7667 - DNA, 406 bp, Glycine max
tctcactaaagtagcatcaggagtcagaggacactgacatcatattccagctgatacttcaatgagttctatgtaactgagcaaatgttggcacgtgggctaaaaatgaagcaccaaaagtaatattttaactgtggctatatcatactcctagggttgcaatcagccattactgatctttaggttagatggctcttgtgagacccagttttgattattggaaactggcttatgaatgccagcatttgtaaccttaagttttaaagggaaaaaggacttagaggatatctagaaccaattgcttaaggagtaaggagggtgcagagtttgaaaggcttgtgttgggaatattacttagcattttgatccgtcattaatgttcatttgagcactagtatgggatgca

SEQ ID NO: 7668 - DNA, 738 bp, Glycine max
  misc_feature (622)..(628): n is a, c, g, or t
  misc_feature (632)..(634): n is a, c, g, or t
  misc_feature (636)..(637): n is a, c, g, or t
  misc_feature (639)..(640): n is a, c, g, or t
  misc_feature (646)..(658): n is a, c, g, or t
  misc_feature (671)..(673): n is a, c, g, or t
  misc_feature (676)..(687): n is a, c, g, or t
  misc_feature (692)..(696): n is a, c, g, or t
  misc_feature (701)..(706): n is a, c, g, or t
  misc_feature (712)..(714): n is a, c, g, or t
  misc_feature (716)..(716): n is a, c, g, or t
tttttcaacccttcccaccgtcgttgtataatattaatgttttttttaatttaaaaattatttttttgtggcgaaattgttgtgttgaagagagtaagagcaagagggtttcgctgaagaagaagtacaaggtcataaggaaggtgagggagcacaacaggaagaaaacgaaggaagcgaagaagcttcgattgagtgggaagaagaaggttgagaaggatcctggtattcccaacgattggcccttcaaggagcaggaactcaaggccctcgaggcgcgaagggcgaaggcaattgaggaattggaacaaaagaaagccgaacgcaaggaaagggtaattgttgttctttccttcattgaacacaccgttccatgtattttttttttaattcccgcacgtaatatgttttgatttgtgatgagatagacagtgaaataaatgaaaaataaattgtagaaatttgatggagtgatggaccttgttcttatggaaattaatgggtaaaccgccatactggttgctgaaagtgtaaagtcatataaatttttgaatcatggaccgaagggagtgacggattgcactttcaggaactttttttttttttttttttttatgggggnnnnnnngggnnnanncnncccctnnnnnnnnnnnnntgggtttttttcnnnaannnnnnnnnnnngggannnnnggttnnnnnngccccnnnanaaaaaaaaaaaaaaaaaaaaaa

SEQ ID NO: 7669 - DNA, 1066 bp, Glycine max
  misc_feature (884)..(884): n is a, c, g, or t
gctcctttccacacgtgcttggtgcaatatccattctctcacctacaccttcaacaacccgctattttattcataatagaagaggcaacagcgtaattcgagaaggtacaacgcaggaacgtccatgaacgtggtgcaacataacagaagttgcggttaagtttttttatttaattaaaacaatttacgtgatgtgataaaatagctaaaaaaatgtgattgatttttctctgtaaaacagttttccacttaaacaaaacaataattagttattaaagaataatatcttttcatacaataatattaaattaaatctttataataatgcacaatgagtggagacaaaaacttgaaaaaatagaatattttggtatcacaatccgatgacccaaatgaccgaagcaataaactaatcagactgattttgattcagattgaccgaaatcttttttaaaaaacctaaacaaaaccaatcaaacaagatattattgattcgattttaattttactctgaatgagaatcaatctaactcatcaacacccattaaaaaaaaagaacaaaaaaatatataacaaaataactaactctcttttataaggaacacaaattattaacaataacaaaggagagtgttagtaacattcatgctcttcttaacacactttactattaattagaatttattaaaaattataaaagactaattaaataatatgtgaaacatgtaatttttaatagtcaaacttaattagcacatgatgcccaaaagctggccatgaaaaggaattaaaataattaacttgagaaaaacaaattgttacataaatataagacaagagtactaaccactccaaagtaaaaatggcttttctatcatcagttnttaagcaattggcgtatgaaccaagttcaacccattaccttacagctttcttctgcttcgtaagcctcctgcttatgcttaagctaacaagaagaaacaagtccaattttcctccatcaccaccaaagttaccaataattggcaatcttcatcagctaggcacactgccacaccgctccttc

SEQ ID NO: 7670 - DNA, 415 bp, Glycine max
tgtgttgatccactgtgaatgaaaaaaacaaaactaagagagagaagagagaaaaattacaacaacattattatttattgtaactaattagctaattaattggttattaaaaattataaggccatgtttggcgaaaccgttccgcgaccacagttcatgcaatcggagccgagaatgtcgacgacggaggcgctcaccgacgacgagttcacgatgcaaagcagtagcacggcgtcaccgatgagcccttactactacgagcagggaaggttaagcggcgaaggctcgccaatgacgatgtcaccgtggaaccagacaacgaactccccattctccaaacctcaatggtctcaagaacaaaacagcgtcccgcaaaacgcgctcgtaggttctcttgtccgagaagagggacaca

SEQ ID NO: 7671 - DNA, 378 bp, Glycine max
  misc_feature (367)..(367): n is a, c, g, or t
ccttgatttcataagcactagactctgcaataataaatatgagaaatgtttatacttgatacttacttctctcattctaagcaggacgcacattctgctgctgagaaagcttacaatatggcaaaggtggatgacggggtgaataaagtagtggctgcagctaataaagcagcaaacacagccagagttgcagctgtaaaggctgtgcaaaataggatgcaccataataatagtaataataaatgataataacccatttcctcagtgtcatcctccatcataagtttgcatacacagaacattattagatatgcgaaagcaaaggaagcagaatgaatgcaaggaaggagaatcacaaagatagacnatcacagagat

SEQ ID NO: 7672 - DNA, 831 bp, Glycine max
  misc_feature (702)..(713): n is a, c, g, or t
  misc_feature (715)..(717): n is a, c, g, or t
  misc_feature (719)..(729): n is a, c, g, or t
  misc_feature (737)..(740): n is a, c, g, or t
  misc_feature (751)..(753): n is a, c, g, or t
  misc_feature (755)..(758): n is a, c, g, or t
  misc_feature (777)..(782): n is a, c, g, or t
  misc_feature (787)..(795): n is a, c, g, or t
  misc_feature (797)..(797): n is a, c, g, or t
  misc_feature (800)..(802): n is a, c, g, or t
  misc_feature (821)..(823): n is a, c, g, or t
tgtgtaaaggagcggttcaggttaatgcataatgcatttttttaaatattgtgaaagtttctatttacgcagccaagcttacactgttatacctattttcacaactgcataattaaatttagtcaaatttactttagaattttgcataaagtactccagttttgttaagaggctcaaacccacattttaagaactatttaagtttttcacaatttattaaaacatttaaagtaaattttgaaaatataaaaaatgaagtttatgtgagcaatttaaactctaaacaaaactggagtactttatgcaaaattctaaagtaaatttgactaaatttaattatgcagttgtgaaaataggtataacagtgtaagcttggctgcgtaaatagaaactttcacaatatttaaaaaaatgcagtatgcattaacctgaaccgctcctttacacacgatgtcttcacaaagcttgtcagagttgcgaaccagattgctaagtgcacctgctgcatttgccttagtcttatcttcctctgccatttgtaacaaatttgccagttgaggaatcgatctcctcagctcttcatacaaaaggcggaggaagatacgactaaggcaaatgcagcaggtgcacttagcaatctggttcgcaactctgacaagctttgtgaagacatcgtgtgtaaaggagcggtttaggtccttnnnnnnnnnnnntnnncnnnnnnnnnnncttttatnnnnttttccccccnnntnnnnaccctcccccccccttctnnnnnncccannnnnnnnncngcnnntttctccccccccccctcnnntccccttt

SEQ ID NO: 7673 - DNA, 372 bp, Glycine max
acggatggttttcaagcacttttgggaaaagggtcctctgcttcggtcttcaaaggcattctcaacgatgtaacttcggttgcggttaaacgaattgacggcgaggagcgtggggagaaagaattcagatcagaagttgcatccattgcaagcgtgcaccatgtcaacctcgtacgtatgtttggttattgtaacgccccccacgtctcctaggtaccttatttatgagtacatcccaaacgggtccttggattgttggatttttccattgagggagaatcatgcacgtaggggagggtgtttgccgtggagcttgaggtacaaggtagctatcgatgttgcaagagagttgtcttatcttcgccatgattg

SEQ ID NO: 7674 - DNA, 1436 bp, Glycine max
  misc_feature (66)..(67): n is a, c, g, or t
  misc_feature (1382)..(1384): n is a, c, g, or t
ctcttctatataaaagcagctgagatactctttacacaacaggaattgagaagctttcactgcttnntgataattctgtttttgtacagcttttacagcagctactctagctgcattggctgctctattagaagctgctacagctctgttcaccccttcatctaccttagccatatcataggctttctcggcagctcgtcttgcttcctatttgttaaacaaataaacacaaaatttatagtgaaaattgactctcaatgctgtaaattatataactgtctgcaatttgttttttctctttccattgacaagattgagcctaattttatgcacaaaagacaagtacaaaaatctgtaagtagacagtatcctcaacttcaataaaattttccttctggcaatttctaagctaaagagtaaagactcaaattgaaacaaatacttaactaatacctattctaagtgaaacataggcttaatggcaccaaatatctattataccttaaacctcaaccatgatcaactcctccctactcaaaatcaagggctaaatataacaatgaaataattttactacaaaaattaaaagcaaaaggcaagggataaccaaaaccctgaattgctaataacataaattttcaaaacacacaaatggaatgaatcatgtaataatcataattgagaattgatgcaacctgaaccaagaaattaagaagagcagaactgatttatattgatgataaagaaacaaaagaaacaatataacccaggtaatttgaggaacccagagcctcctaaacaattttcaaatatcccccccaccccctcctaaatattatctcctactcctatatatagtttctacctcccatcctcaatcctaattataattagtgtaatttataaatatcctaattaaatcctaaaaagataaagataatgatctccaaataacagaaaaggcaaaaacaagaattccctaataacagaaaagattatgatcttctaaaaaggtaaagataatatatccgaaaaaggtacaaataatgattgcctaactcctttttgtcttccttctcacatagacctccctaatagggaagcacaccctatcaagaatactacccaagcaaagttaatcagcgaaagactgggacatcatactaatctttggaataatatattcatagcaactagaaatgacagacttgtttgattccagactgatattcctgggacaccatgtcgacaaacataaaatgatagacaccaacaggaaagaatatttaacataactaaaggaaataactcattaacataaagaatgaacctgcactgcattgagtactttggaataatagacaccaacaggagaaactggnnnaggggtgttccgtgtgcttggaatgtcaaggactccatttgccaggaccaga

SEQ ID NO: 7675 - DNA, 376 bp, Glycine max
ataagtattgtgcagtgggtgtggggactctatggagaagggagaattcttgaagcagcagatcaaagactagaagggaaatttgaggaggagcaaataaaatgcttgatgattgttggtctttggtgtgctcaccctgaccatagtaatagaccttcaataaggcaagcaattcaagtgcttaactttgaagctcccttgcctaatcttccatcaagtttgcctgttccaacatatcttgagcacccactgcactcatccatattaccattcagcataaatgcctcagaggaaggtcaaagccagatcacaggctgcagttcaaacacaaattcctccggattcaccacaacttctgatgatgcttctccatcta

SEQ ID NO: 7676 - DNA, 613 bp, Glycine max
  misc_feature (57)..(60): n is a, c, g, or t
  misc_feature (65)..(65): n is a, c, g, or t
  misc_feature (507)..(509): n is a, c, g, or t
  misc_feature (553)..(555): n is a, c, g, or t
  misc_feature (578)..(591): n is a, c, g, or t
  misc_feature (596)..(599): n is a, c, g, or t
  misc_feature (602)..(609): n is a, c, g, or t
cttcttttgtaggtatgcaggaattgcccctctctctgttaccgtgatcgcaccacnnnncattngcaaaatgtagagcttttcggagatgctcctcattctgccacgcaaaataaatgcataaactctcataagcgatgaagacaacatatcaaactatttgctgcaacttcttgtacaatattcataattcatttcaaggatatcattccattattttaaattgaataccaaaaaaaaaacggaaaaccaaaattattaaaaacaaaaaaactaaaattagaagcatatattctgctgttatctcctccatttacatttactgatttattaaatctatttgcatttactgattacccataccagtgataaaaatctctcccactttcttttttctttctaaatattgttattcattggagaggaataagcaaaggacaataagtgaatatttggagaggaataagcaaaggaatgaacacacagcaaagagtacgtactacatcnnntctttctatgaaccgtaatacactggagcatgatgaacaactcnnnttcatgattgatcaataatgcannnnnnnnnnnnnntaatnnnntcnnnnnnnngagc

SEQ ID NO: 7677 - DNA, 355 bp, Glycine max
tgccatggatggttagacattaaattgttgttttacttttttcttaagtggttaaacattgattttagtttctgctcttgatggttaagccttgttgcttatgtcaagtggttaaactttgaggtataatttctgcttggtggttaagctttgataatttcctggattgattgttgttgattttgcttgatgtttaagctttgatgcttgctttggactcaagaagattgagaaagtcaatgttgatcgaagatttctaaaagctactgttttgactgatgtatttctagcatgtttagctatatttcaatttttcagactttatttttatttcctttgatgtagatgtattatc

SEQ ID NO: 7678 - DNA, 370 bp, Glycine max
aatttacgaacggggattgatgcgcatatttgagtttatttttgtgactttatttttatttcttttggtgtttcctcgtatttggtgcagtcgagaaaagtttggggagatgcatgctagactatggtgggaagagaaccgtgccagaatacatgaacaatacttgtgagctagatgcctagatttatcaaaggggtggctgctgatgtttcacaaaatgtggaggtggtgtttctcatcaatttgcttaatcaatgtttttgttatataaagtctccttataggcaagatgtcagaacgagtgctactatacatccctagaccctagcgctcgtgtttcatcttcatgcaatcaattctggttattctc

SEQ ID NO: 7679 - DNA, 660 bp, Glycine max
cttttttcattcggcaatcaaaccatgcagcgcacggcggcggcgacagaggaaccacggcggagctccggcgacgcgtcggcggcggagggggagaaggtgttcaagggaagtgaggtgttcggtgatacgtcaccaaattatttaaagacgattttggccctggcgctgtggctcggaaccattcatttcaacgccgcgttggtgctcttcgcaatcttcttcctctctctccacaaagcattcttgttcgtttgtctctcctttagcttcttcccttgaaattacacacacgtgtgtgtatatatacatgcacgtgtgtgtctctctgtgtgtgatgttaataagagaaggttgttatgccagacttttcggtttgcttttcgtgctgatggtgattcctgttgatgaaaagagcaaattcggtagaaaattatccaggtacttattattattattattattattattattattattattattattattattatgcttttcatgatacacagtttgagtatcttgtttttgtgtttgaataaaaaaatgtcttctccagaagaaaaaaaaaaatttgggtgtgtttcaggtacatatgcaagcacgtttgcgcttactttcccatcacgcttcatgtggaggatatgaaggcttgaa

SEQ ID NO: 7680 - DNA, 631 bp, Glycine max
  misc_feature (28)..(30): n is a, c, g, or t
  misc_feature (34)..(34): n is a, c, g, or t
  misc_feature (526)..(530): n is a, c, g, or t
  misc_feature (532)..(534): n is a, c, g, or t
  misc_feature (551)..(551): n is a, c, g, or t
  misc_feature (573)..(592): n is a, c, g, or t
  misc_feature (601)..(601): n is a, c, g, or t
  misc_feature (604)..(606): n is a, c, g, or t
tgagtagtaaacgcttctttcacatctnnntttngtcgttgttgtgttactgcaaaaccctaatgccacgtgttcattcgtgcaattttctctaatgggatttgttctgaatcaggtatctccagagattctatgcacaagaggcgtgccactggtggcaagaagaaggcatggaggaagaagagaaagtgtgtgcccctttcatttattcattttaatattatgaatgtttttatttattttaatttggtgttgtttttgtttttttgctgcttagagtttcctaatgctgttgctgaaagtgaaggatgtgtttgtattagatttttggtcgttttgattggtatgatggttaggatcttttcttggttgttcatggcatttgacggtttgaaattgaaagtgtttttttttattcttatgttttttttttggggtccggaacaaatgggaaaaccagggggaactgttcttcgggttttaatttttttttttttaggggaaggggaaaggaaagggtttttgnnnnnannnttcccttaaaaatttantgcaaaaggggaaactttttcnnnnnnnnnnnnnnnnnnnnttttggggncgnnntttttttccaatttttttttttttt

SEQ ID NO: 7681 - DNA, 413 bp, Glycine max
ggtaactatcatgttatgtttttcttcaagattttgatactgacaacattgcactcttttgtggcagacctcgtattaaaagacaaaatttttgtctacgatcttgctggtcaacgcattggatgggctaactatgattgtgagtatcacctacactacactgaagggacatagagaataacgtgtaaataaggattccttgtacttatgaaataaggcttctttacagagcaggtccaaggataaggctattaaagctcaaaactttaatcccaccaacaaaaaactatttgttataaatttttatgaagttaaaaaaaccacatatattcacaaaatggcccaacatatatagctctctcatttaaagtaaacaagtatctttcaaattttgttttaggtcttgttcacca

SEQ ID NO: 7682 - DNA, 443 bp, Glycine max
cgagcgttgcagaataaacgacattgacaccgacaccaagttctctcacgttcccgttatgctgggcgaggtcttggacgtcttttccaactccacactaacctccttcgtcgattgcactctgggcgccgcgggtcactccaccgccgttagtattcattcttgtttttttaactgagtaaaaagtgccacaactattgaatggaatgaaacaggttattaggggccatccagagttgaagtatttggtggggatggacgtggactctctagcacacgacatcgcccagcctcgtcttgatgccgttttgaacgctggtgtcaaagcgattaccgttttgaggaattttagagacgtcaagtctgtgcttagagaaatcgctgagctacacttgttgggggttgacgccatcttaatggacttgggaatgtcatctatgcag

SEQ ID NO: 7683 - DNA, 618 bp, Glycine max
tgcatcaaatataaaggcagttgagaatattggtggaaactgtgttgaagagtctggaagctataattctcgaaggaaacaaaaagtttttcacaagcaaccatcttcccttaagcagcggtttttctcaagtaattttagaaatcatggaactggtcggaactctcatggaatcatatctgaaagcccgcctagcaattcggttgggtttttctttgcttctacgcctcctgaaaatcacgggtcagttcaaaatgattgttcccagtgctaatgactgtaattatggtttgcttagccagcctttttttttttcacttttatcctttactagaagaatatatagtatataatctattaaaaaaagaatataaattattactgtttcagagagtatgatatgacatgttgattgtttggtttgacaactgaagctatttccattaattatcttaattttgcagttttaagccttccaaattgagtagttcaccacatggggggttttctggtagtccacgtggggggttcgctggtagtccacatggggggttcgctggtagtccacctgggggttcaatgccaaagtcttttccactatttcagcatccaagacaa

SEQ ID NO: 7684 - DNA, 405 bp, Glycine max
gcatggtttctttgatgagactgagagtggcaattcatcttcaaacctccttgatgcattatttgttgatggttgatggaaaatgtgtgattactttacagtaatgattactttacagtaatgattaattgatctttgggatcgtaggttgagggcttaaatgcttaagttgcaacagaggataacgaataacttctctacttattggggattggaagaaaactgattactgattattacatgggctggctttatatatgtatgtaccatttgaaaaagagctattagccgggggaaggttgctactgagattaggtgtttatattgtaacttatcagtgagtttgctgcaattgccacccgtgacagggcatgaagttgttaaagccaatattgttcttgtaac

SEQ ID NO: 7685 - DNA, 375 bp, Glycine max
cgcctcggtgcgttctcgaccgggttgactcggagttgaactccgagtcagattataacgaccgtgatcatcaagaagaggtgttttcaatatttactaacatcgaagaaaattcagttattaaaaatagaataagtaaattagcgacagagtcgagggtaaattgggaaacacatggttgggtagtggtgagggaagttgagtccaacggagaaccaacgacaacgggaacagaggaagaaggagcgtgtacgtgtgagcgtgatggtgttggttccaacaaagaaggggtaaattgggaatttcacaatgtggcagagactggtatggtatattcggattctgtaggggcaaatcggagaataagaaagtttg

SEQ ID NO: 7686 - DNA, 425 bp, Glycine max
acatccttgaatactgagcttccctttggttccttttcggtgattgctgagtggggaaacggagtggagttctgacaggacacagagcagctacagaaacacgcctccttctaggctgacgggcttgtgatgttgatggtgggggtgggggtcttacagctatggataccccccttcttcttggtttcataaggtcttgcgtgttaattgaggttgttttggcaacgctttcctgtccatccatggaagagctgcatgagggccttatcagtgattgccgagtgggggaacagagtggagttctgacaggacacagtgtagctacggaaacacgcctccttcttggctgaagggactgtgatgttgatggtgggggtgggggtcttaccgctatggataccccccttcttggtttcacaaggtct

SEQ ID NO: 7687 - DNA, 439 bp, Glycine max
ttcttcgttattgtgttcccttctccaatgatgccggaaagtgacatcactctatcctctttcaggcttcgttgggacgtgttcctgagcttcaggggcaccgacacgcgggacactttcaccatgagcctctaccacgctctccaccgccgcggcctccgcgtcttccgcgacgacgacgggctggagcgcggcgacgagatccagaagaagcttctggaagccattgaagactccgccgccgccgtcgtcgttctctctcccgattacgcgtcttcccattggtgcctcgacgaacttgccaagatttgcaagtgtgggaggctgatccttccggttttctactgggtcgacccttcccatgtcagaaagcaaaagggtccctttgaggattctttcgggtcccatgcaaacaagtttcctgaagagagtgttcagc

SEQ ID NO: 7688 - DNA, 396 bp, Glycine max
aatgagcgaggtggttgagtctcttggaagcattattaatgacacagttcctcatgatgaacacatcccccaagctgctgtagcagcaactggagaagaaaaagaagaaaagttatctgtagaggacactcaacctgaacctgcagctaaacaagggaacaattacctgaagaaggtttttgaattgaaagacatggtcagcttaagaaacaagtccgttggaaggttggattggaaaagttgggcacctgggctagtaagaacttggtgataagtgacctgtatatcttggaaagaaaaatcttcttcccctacagtcacctgctaatagcaatgtttgttgatcacatagttttcactctgtgaaatcgacattgtcaggcacacaggtaacat

SEQ ID NO: 7689 - DNA, 377 bp, Glycine max
aaactcttaagaagggggatgttatggcattccctcaaggcttgcttcatttccaaatcaatgcaggcaaatcttcagccctggcaattgtaagcttcagtagctccaatcctggtctacaaattctggacttcgctttgttcaaaagtagtttccccacaccattgatagtacaaaccactttccttgatgctgctctggtgaagaagcttaagggtgtacttggaggctcaggctaaaccatgggaagttatccatgaaagagactgaagtcaagcaagcatattgtctattacctttaagtttatttatctccttggtctacaatttggatttagtatgcatgtgtaggtagaactcttctttcagcaggcaaa

SEQ ID NO: 7690 - DNA, 460 bp, Glycine max
tcgttggggtgttacccgccttccccgtaagactcacagaggcttgaggaaggttgcttgtattggttcctggcatcctgcaagagtttcattcactgttgccagggctggtcagaatggataccaccaccgaactgagttgaacaagaaggtttacaagcttggcaaagctggagatgaatctcactctgctcttactgagtttgataggtaagtgttttgttgattatggttttgtgcaataaatttagcaggaagtattttgtttgtaagtcaaactaacccctctacttgttttctgattcaggaccgagaaagacattaccccaataggtggtttccctcactatggtgttgttaaggatgattatatcatggtcaagggatgctgcgttggtcccaagaaaagggttattacattgcgccaatccctccttaaccacacttctcgagttgatct

SEQ ID NO: 7691 - DNA, 534 bp, Glycine max
  misc_feature (526)..(526): n is a, c, g, or t
tacgattataataacaagcttaaagctctagtggatcagttcaataacaggttctctgttaattccaaattcatccttatacacaatggatcaaacgcccttgacattgcacatggtaataagtttggctttcttattcttcaatccacatctctaaccaagatgcatacaatattgttttcttttttatcagcaaatgttagttgttagttttttgtatagcattatatataaccatgtatagtccatgtgtctcagggtttttggtttcggatgctgcttgctgcccatcagggtgtaatcccaaccaaaagccgtgcaataataggagtgactatgtgttttgggatgaagttcatcccaccgaggcatggaacctagttaatgcaatatcagcttataattctaccattgatccagcctttacttatccaatgaatatcaagcaacttgtagactgtgaagttaagagggaattggagttcaggaatgaatccacttcacagctcagtgccactgaataagntctggata

SEQ ID NO: 7692 - DNA, 244 bp, Glycine max
  misc_feature (221)..(223): n is a, c, g, or t
ttatgtgcctagtcgtaacagaattctgttaacatattaacttaaggaattatacaagagttgttacattcttcaaggttgagtttagtggaataaggttttccgtttgaattttgtttgtactgtgtttttaatagatacatcgtttaacatgcagaaaccagcgtcgaaggatgcccaaccgatgaatatcgacagcaaggcataaacatcatgagatnnntcttttctctctagtctctca

SEQ ID NO: 7693 - DNA, 393 bp, Glycine max
  misc_feature (61)..(63): n is a, c, g, or t
  misc_feature (367)..(371): n is a, c, g, or t
  misc_feature (373)..(374): n is a, c, g, or t
  misc_feature (379)..(380): n is a, c, g, or t
ggcacataactgtgtgaagtgaaacccataggtcgttgccacaaaccaaatcagtttctcnnntaatgggagctctagtgaaacttgtaagatccaagatacattgggcactcgggctgaattatgtggtgatgctactggtgataaatcagagacatgcctaaagtctgctgataattccaacttaaagcatgaatcacatgatgaatatagagagtctaataaatctgatggccaagtgaatggaagccctgatgttcttgatacacttagttacaattctgaatcatgtaatgactcaagtgatgcctcagaatcaagcgataaagtatctaccaatagtggtgactcaggctaatgtccactnnnnncnnccaannaatattttttcca

SEQ ID NO: 7694 - DNA, 441 bp, Glycine max
gctcctccgccgtgctgcacgccaccgccgtcgagcccatggttgacttcggcacatggctcttgcgatcaaatctcatgcacgtgcatggcatccgcgacctcatcctcgccaccgtccgcaacaccttcttcgaccacttttgcgccggcgaggacgccatcaccaccgctgccagcatccgccacctaaaccgtgccggcctccgcggcatgctcgtctacggcgtcgaagacgcaaacgacaacgacgcctgccaccgcaacttcaagggctttcttcacaccatcgacgtcagcagatcgcttcccccttcttcggtatattcctcttctttcttcccctttacttttctaaatcagaatttttgaatctgttttgatgtgacaggtgagctttgtgatagtgaaaatcaccgcaatatgtcctatgagcctgttg

SEQ ID NO: 7695 - DNA, 370 bp, Glycine max
tcgtatctcatgtgacaaagtttggacttagttcggatgtttcagttgcaaacagtattgtcaccatgtattcaagatgtggacaaatcaaagaagcacggaaagtttttgactcaatacatgtgaaaaacctgatttcctggaatgccatgatggcagcatttgctcaaaatggtttaggcaataaagcaatcgaaacatatgaggatatgttaaggacagaatgcaaacctgaccatataagctatgttgctgttttatctggttgcagccacatggggcttgtagttgaagggaaacattattttgattccatgactcaagtgtttggcatttctccaacaaatgagcactttgcttgtttggtaga

SEQ ID NO: 7696 - DNA, 780 bp, Glycine max
ccctaattggaggatgtgatttattgcataatcgatggaaaaaccctagattcggagcagggggcgcaatcgacgacgccgtagatgcttgttgcggttggagcgtcgtgggatctgaattggttcctgcaattgttgctctccgtcatcgtcgtggccattggggttcactacttcgtcaaggtcaccgcttccaaatacttcttggtcgacgccaatttcgaaggggaccaccaccacgccctcgccaccgacgccatgcccggtgccctcgctgccgccgatcctctctgtgccgtctgcgccacgccagcccctaagaagtgctcgcgctgcaaagccgttagatattggtatggtaccttccttcaatcatcaatgtgattgtgatcgttatgattatgaggagttttattaattgattgattgattgattaattaattaatgtatttatttaatgttatggtaatttagagaatggtgcttcttttggtagtatttttgattcgtaggtagctgaggttttacaataactcatactcgctatccaaccaattgagctagacccccttcgtcttcttgtggtagtttttggttgttacttgttggttaattaagtcttggtgtgaaatgaattctgggtttgctaatgaaattgacgagtttatttatttattttcttaaaagaaatttggtgggaatagtaagtgtttgtttttaaatgggtaagaaggggatggctgaatttaatttgcatttgtgtggattttgcagttcgc

SEQ ID NO: 7697 - DNA, 520 bp, Glycine max
catcatcagagtcctgagcaaagtctctccgtttcctcaagtgattctagtagtagctgcagcactaacagtactagcagctccgccgactctcccttcagaagccttccccctctacttccacactctacttttcctattcctcataacttttttttccactcaaattcaacccaatcttcaatcaatactacacttggattcttcgacaatcccctcgctgaaatttctgattcagcatttctacaacaatttgagagaggtgtagaccaaggtacccgtttccttcctctacacactactccattcaatattaatgttgacccgaacaacacagccttttcctcttctttcacaaagacaaaaactccacctccgcagatgctaattaagacagaagcagaaggagagccttttctggcaggaaggaaacaaaggcagcgggaagagtatgaagcagatggaagaagcaggaagcaatcggcaccatacatggatgacagtgagctatcccgaattg

SEQ ID NO: 7698 - DNA, 423 bp, Glycine max
  misc_feature (398)..(398): n is a, c, g, or t
  misc_feature (406)..(406): n is a, c, g, or t
ggcggttttgtaagaggagaatggtgaaggatgctgttgagctttacgagtttgctatggccggtgcaaataagcctacggtacagtgctgtgtctttctgttgaggaaggttgctgctgggaaagagttggatacggatttgttttcaagggttttgaaggtttttactggaaatgggaatgtgttgactgattctgtggctaatgctgtgctgaagtctttgaccagtgttggtaggactggggagtggaacaaggttttgaaagaaatggaagattgtgggtttgttgctggtggtagtttacagagtaaaattgcctatagacttggtgcagcgggtaacaaggaacaagctcatgagttcatgaatagaattgaggtgtctggatccaaaacntctcttgncgtgctgcaaccttcct

SEQ ID NO: 7699 - DNA, 668 bp, Glycine max
agcaatggtgaaggctgtggcagttcttggcagcagcgagggtgtcactggaactattttcttcactcaggagggaaatggtaagtttctactcttcattggtaatcttttcaattaagcacttgtgggtgaaaaaaattaacaagtcaaaatgagttaaacttctattctatctaagaagttaaatgaggtaacatttataaaatttgaagtgtgtaagttgattttaacttgtgaaatagatttaatttttttttacctttttttttgctactgtaagtgtttattgagaaatttattcaaacatgcctatgattttgttttctcatactgtactgactattgagccaaatcaaatgacatatattacaaattgtccaggtccaaccaccgtaactggatctcttgctggtcttaagcctggtctccatggcttccatgtccatgccttgggggacactaccaatggttgcctgtcaactggtatagtctttagacaataacccgaatcattttttgatactatgaagcattaatgacctgaaacaaattgtatactctcgctttgctttaatgaaaagaaatgaacatttgtgtgagagattgagtcttcaaagcaccaagcaataaaatctgttataaagcaactggattatgaaatcccgtca

SEQ ID NO: 7700 - DNA, 432 bp, Glycine max
ctgtgcctgaggattgtcccttgaagggaatggctttgtgtgttggttattcatcaacccctaaaatcatggcaaccaaatgtcttattagtgtcgtaatggttaattacacaaagtgcaccatccagatattcaagcgagacacagtaatttcctttaattatgaagattggcagggcatagtatcacattttggtcctggagacaaggtgaagatttttgtgctttttgatcatggattagttgtcaagaagacagctgtctatctagcgtgtgataaatcaattggcaaggaaatggagtctccgccttctgccgaaaagttcagaaatatgttagtggcaaaaaagttcagaaatatgttagtggcaaaaaaactggtaactggattagtaccatttggcatggtaattgccgacaagctcaaagtag

SEQ ID NO: 7701 - DNA, 454 bp, Glycine max
  misc_feature (409)..(409): n is a, c, g, or t
  misc_feature (442)..(445): n is a, c, g, or t
  misc_feature (449)..(449): n is a, c, g, or t
  misc_feature (451)..(451): n is a, c, g, or t
tacccttctcctctatcagtcttgccagagccatctgatgatccagaagtgggtccccatggcacccactcaccagcacccgccacgcaagctgcctcacccgatccagaatcacaggcccatcgccagccgtcggattgcaatactcgtgatcacggtcaacccccaggggcagcgacaactcccacagtaagtcacacacgtgcggcggcaaaaccggatcgtccacaagcctcacctcagaaggcaccctcttcgttcctccgaagaacggctgactcaatatcagccctctgatcttaagtggcgccagataattgtctccataaacgttaagctccgcagctacacgtagacccacgtggtacgcgatgtttgctccggcgctacttcccataaggaaacaaanaatcgccgccgtggcgccgcaagtgccagctcnnnnttancngat

SEQ ID NO: 7702 - DNA, 443 bp, Glycine max
  misc_feature (419)..(419): n is a, c, g, or t
  misc_feature (431)..(432): n is a, c, g, or t
gtgagtggtgcagttgaagataatggggtggattcttctcagggtgctgaggatcatgaggaagtgttagtgttcgatagtggaggattgccacatagcagcgatgatggggagaggaacactagaaggctttttgtaaaggtgggcagaaatgtggtgaaagagcagcttcaagcgcaccaagagaagcttctgttctctgctcctttgccacttaagatggaaaacagaagtggttcaaagaacagtaaaggggtgaaaattttgacgtgaatggccatggcttgaatcatgtaagactgagtttctgtttgatttgtattgtttaattgtaatctaggagtttttttattggatttcagactggtagagctcatttgtgtgtctaacttgtcattggttctgtagtggacatgtanaaaaaaaaagannctttctcaccc

SEQ ID NO: 7703 - DNA, 525 bp, Glycine max
ccttcttcttcttcccacttgtagctagcatggtttgtgtttatttgcccatttctcgagtttgataggtttaattagtgtgggctattatttattcattttttaaaattctgttttgttttgattgcaggggcaagaagctggtttggtgtttctttcatttcacttttatatgaatagaagtttgaagggttttagggatttgcatgatgttaggttcattacctatattgccactccctgctcctccttctgatggaaatctaggtcctctccctgagtctcaagtgattgaggaggagcagaaccaatcaaattctgcttctgttccggcgccggtaacagttgccacccacaccagaacgattggaattatacatccgcctccggacattaggaccattgttgataaaaccgcccagttcgtcgctaagaatggtccagaatttgaaaagaggattgttgcaaataacacaggaaatgccaagttcaatttcttgaactcatcagatccatatcacacat

SEQ ID NO: 7704 - DNA, 397 bp, Glycine max
  misc_feature (375)..(377): n is a, c, g, or t
  misc_feature (380)..(381): n is a, c, g, or t
  misc_feature (384)..(385): n is a, c, g, or t
  misc_feature (387)..(387): n is a, c, g, or t
  misc_feature (389)..(394): n is a, c, g, or t
agtgcaagtgttttgtcctcgagtacttcttccaagggttcgaagaggtggtggctgaaggactttttgttgttccgtagtgcctccgaagggagaggttcaagcaaagatgcattgaagaagtactacaagaagaatagtaacgaagaggttaaagggtcgtcgagttttagatcctcggattcgtcgagatcaagaaaggaaccgctttcggcgcatgagttgcactacgccatgaagagacaagagtccgaggatatgaagaagagaaccttcttgccttacagacaagggattctgggaaggttggctggtttcggaatctagttttaattaccagatcatggtgatgatgatgaggtttccttgatgacnnnatnncgnngnannnnnnggt

SEQ ID NO: 7705 - DNA, 761 bp, Glycine max
tacttggggatgaaatggggagtgctcacttcttcccttcattagacatgcatctacaaacagaattactaggacatttttagttatttttacaccaagtttgaatttgatcatacttttttagtagtgatcaattattctcccttgacttcagcaactgcatcagcccaattagcagcacttccagtgcgaggaatgctgggaatctttgtgtacaaatccacctgaaaatatacactcaagatgtttccactgtcatcttcatgcgcaacagcttgaaccttgtgcagtggatgatcaaagcttgtcaacccacttccattgatgaaaatgcaccctgcattccaattgaagaagtaaatgaaaattacaaagcattctgcctaattgggagcagcaaggttgcagaaaatgttaagattttgtttggataaacttctcagtaagcactcataggagaaaaaaataagaagataaaaccaacttttgaagaagctaaataaaagtctagcttatacattcactaattttaacttgattcatttaaacttcttgttttcttaaccttaagtacctatttattgaaagtttatctgaataggtcccaaataattaagacttcagcgtaacagctctcaggttaaatggtaaccataataatcaaatactagttattttttatcggaattgagaaagttgagagctgaatggaaagatagtaaagctaaactaacccggagaaaaagctgcacaagcttgtc

SEQ ID NO: 7706 - DNA, 348 bp, Glycine max
  misc_feature (288)..(288): n is a, c, g, or t
ctcttgagtttttgacttttctctcagtattttgtatacacatactagtagacgtatacattgctgggaaacctaggggataaaaactggggtataaacatgtgtaaagcacgttcttaattacgttgctttcaattaatattaatatgtctgtatggttctttctatcctaattcctagccagtagtgccagtggtttatgtacggagtgagtatctggaagtctgttagagagagagagagagagagtgtgtgtgaaaactgagaggagaaggacggggattaaangtaatctcatgatgggtttggaacagaaacctcgtttcactcgcttatgttctaatttag

SEQ ID NO: 7707 - DNA, 1259 bp, Glycine max
  misc_feature (52)..(54): n is a, c, g, or t
  misc_feature (56)..(58): n is a, c, g, or t
  misc_feature (1224)..(1229): n is a, c, g, or t
  misc_feature (1249)..(1251): n is a, c, g, or t
gatcaggctcatcggtttgcagagtagataaaattggtgtggaaaccacatnnntnnnatcgggttctgccatcacattaatttctacatcagattcaccatgagcaggctccttataaacatttccttcattaattcaacatccaacattaaaggaaaatatggaaccaattgaataaagcaacagttaggacaacaggggtagtagcttgaaagaaaagggaagacatagtaattaattagtttgttagaacaattagttagaaattaacagagagatggagttcagggaaagttttgagaagactgggcaagtgttccattatgttatgaagaggaaaaagcctcagaagagagatctctctccctattctgttaattttcaataaaacattaaaataatttattttctttatttgaattcctaacagcaacagagagtttctgataggccatgttctgttggacctgctcagagagatggccagaggccattgaaggcatatgttaggaaaattttaaaacagaccatgcaatttctattagatagttatattcttgttaattcagaattaggcaattatgttttatggcatgactgttatagtgttatctgtgtggagtgacagacctataggggagttaatgtgtgaaacttgttttttgtggtgaattgaaggtggaaacacctcagtagggaaaaaccctgtgtagttgtactgttcttaaaatatggtctataaaccagattactctagaaaaaagtaattatgatttatgtgtgtgttcaatccttgaattcaatagtttcaatgttttaaattgtttttttctgcttcacagtcatcatcattgtcaggtttatgaatgcagaatgcccatccttgacaggagatgcctacatagactactcattacaggcgaacaattacctagaactggagcaatagattttgtggatctttctaaattatcaatggatgtgtatgtcgcagccatatactcagcacctgtctccgaatgaaaacgttgcgctacaccaaaattattaggtttttgttagaatacagtcttgctatcagtaattcctgaactaacatcatgaccaacaactttaccatgatgagaatcttctggatcagcctcctgtttcattccattgataatatgatcgtcagggtcaggcttaccattaagtcctttctcaacattgatggccataannnnnncttcaatttctttggaggcnnnatatcaca

SEQ ID NO: 7708 - DNA, 708 bp, Glycine max
  misc_feature (56)..(60): n is a, c, g, or t
  misc_feature (685)..(685): n is a, c, g, or t
ggtgctggggagttagttgaccatcctaagaaaatagcccttcactaccttcggannnnntttgttattgacttatttgttgtacttccacttcctcaggtaagtctctcctcatctctcttgcttattataacttcagtatctcatatgtctaatcatctaatttgtgtgcttgttttatgtacaagcatgcataaagtaacagcaattatctgattttgtttatggtcgctaaatctaagatgcaatgtgtattgccgtcattaaattttcagttgccatatatatatgaagatcttaccaataaagtgatccatccttagaaagaaaattttctccccacataatctgcttgcccagttaaatttaatgctttccctttccttgttttgtttaggatattataattttctttttaaagaacttcagattatttgggtgtttgatctgtcaataaatgtgacgttctcttaatttctttctaagctgaatccagttctacatcatcatgtttgaaattcagatgttatgtatttattgttctcattggtgtggacaacctgaggaataatatgtattggtttactatctttttagtccctaaactttttaggatttctgtttaagtccttgaatgttttttagtccctcaattttttttccttacttttaaggatgaaaaaanttaagggactaaaaataaggaca

SEQ ID NO: 7709 - DNA, 748 bp, Glycine max
  misc_feature (374)..(374): n is a, c, g, or t
  misc_feature (376)..(445): n is a, c, g, or t
  misc_feature (449)..(537): n is a, c, g, or t
  misc_feature (540)..(550): n is a, c, g, or t
  misc_feature (552)..(559): n is a, c, g, or t
  misc_feature (562)..(568): n is a, c, g, or t
  misc_feature (571)..(575): n is a, c, g, or t
  misc_feature (586)..(588): n is a, c, g, or t
  misc_feature (590)..(591): n is a, c, g, or t
  misc_feature (595)..(596): n is a, c, g, or t
  misc_feature (600)..(602): n is a, c, g, or t
  misc_feature (605)..(613): n is a, c, g, or t
  misc_feature (618)..(625): n is a, c, g, or t
  misc_feature (629)..(638): n is a, c, g, or t
  misc_feature (641)..(648): n is a, c, g, or t
  misc_feature (652)..(658): n is a, c, g, or t
  misc_feature (662)..(662): n is a, c, g, or t
  misc_feature (666)..(673): n is a, c, g, or t
  misc_feature (675)..(690): n is a, c, g, or t
  misc_feature (692)..(694): n is a, c, g, or t
  misc_feature (696)..(701): n is a, c, g, or t
  misc_feature (704)..(707): n is a, c, g, or t
  misc_feature (712)..(732): n is a, c, g, or t
  misc_feature (734)..(740): n is a, c, g, or t
tcagactgtatttgtttactttcattaggtttaaataattatagtagctcagaacatgccctccacgatgaagcttcacttcccctttcccttatccaagagaacacatattgaataattatggtacaaggtgttcctagtacaagaaaactagattagaaagtaaaaacatgtccaccctggccacaattcaagcatagagcacttgacaagtacaaggtgagaattcgcggaaagcagacggcgcctccacaacctcccacgtcacactaacctcaaaatcacctttcccttggattctatcactcttcatctttccaattgcaacgtttaaattgtacgatgccacgtagattctgttgtccaaaccaaanannnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatnnnnnnnnnnnannnnnnnnaannnnnnnatnnnnnattaataaaannntnnaaanntatnnnaannnnnnnnnataannnnnnnnaaannnnnnnnnnaannnnnnnnaatnnnnnnnaaanaatnnnnnnnnannnnnnnnnnnnnnnntnnnannnnnnaannnnattannnnnnnnnnnnnnnnnnnnnannnnnnnaaaaaaat

SEQ ID NO: 7710 - DNA, 402 bp, Glycine max
tcacctcagggaacagctaaaggaagtgcaggttagaaagaatgctacatcagatttctcaaaaatggagaatgatggggatgagtggcccaaaattagagaaaaggaaaccaggatgcacaaaaatgtggccgataatgacaaaaatgctgaagtgacagaggaaataaatgaggttcaaagctttcatgatgaaaatggtgtcccacctaatgttaatgaaactgaaatagtgcatgaagaaaacatttcaaatgctggcaaaggaagttggtttagaaaacacatttatgaagtcacatatgtagaagataacactgttgaagtgaattgggaagcatcaaagaaccatgctgatgaagaaattaatacagtaagtattactcaagtcgacccttcagg

SEQ ID NO: 7711 - DNA, 375 bp, Glycine max
agagggagccagatgccgaggaccctgttgtggaatcgatgttagtattcaatgatgatgatgtgatggaaccgaacttgcacaagtatgtgacagtgaatagaggtggttcacttggtggtgcggacatggatgaccaagagtcttcaggaagcaacagcttcactgtgagtagtggtcaacagcattggggtgtttcttcttcttcatgggaaccaagttcagttgaatcgaaagattgctggacttcgaggtcgaactactccaaagaggaatgtcagagaagtccattaggcttggaaggaacggtggcatctgaagtggcggggcgtgatgcgggtggagccaagaagaaattgaacagccaaaggagag

SEQ ID NO: 7712 - DNA, 425 bp, Glycine max
tgaagagatctgttgtgtttgccggcgttgatagctcctcctccgacgaaaactccgaccaatcgctccccgaaatggaagcaagaatttctggtaaagaggtactaatcagaattcactgcgacaaaaacagtggaggagctgctgctatactaagggaattagagaagcattatctcacagttcagagtagcagcttcttgccctttgggaataacacacttgacataactattgttgctaaggtaaatacattaacttcaatttttaaagaaataatcatcttctgtatttccattaagttataaacgaggagaaattattacatagtcttgaatcattattctttcagtcaatatctacatgatacataatcaattctttttaattaactctcgctcgttaattgaaaaattggattatgt

SEQ ID NO: 7713 - DNA, 577 bp, Glycine max
gataataaagtggaaatggcgaggggttcaaagcaagctgttaatggagcaagtttggtagaaagagatcctagcctggccttgacaaagacaaagaaatctacaacctctaaagaacttccaccactggaagagctaaaagttttgccctcagatgaaggattcagttgggccaatgaaaattacaattccttgcaaagatcaattgatgtttggtcttttgttatttctttacgtattcgagttctgttggacaatgcaaaatgggcatatttgggtgactttacagaagaaaaacaggtaggttccggaagctattttgttgccaaattcttctcttcctgactttaatcattgccggtggagaccctctcaacaaacatttctccagcactcatcccaattagttttgtaactgattaagtttctgttgtgtttttgctttgctgacttgaagtattttaatattgcatttcagaaaagcagaaggcggaaaactgctgcatggctaagggagtgtgtattacagcttggtccaactttcattaaacttggacagttatcatcaacaaggtcg

SEQ ID NO: 7714 - DNA, 425 bp, Glycine max
atttgaccatcaatagcaacagcagagtctcccccctgctcaacatggacacagaacacaaacacaataatcaagttcaagagcaaggtgacatcacaaagtccacaaggtcattctcctattctgcttcatcatcagttggtggtaagaatggtaaccacaacatgatcaacaacaacaacaactacaaagctcattcatttcatgttgcaactccaacaccaccaccaccttcttcttcttcttccaaatccactttaagcaacaaagctggtttgttatttcaacaccctgaaagaagtaaaatatcagttaaagctcctcaaacctcctccaatctcacagagaaactcaaaacttccttgtcaaaacccatttggcttttaagaagaaaatgcccttgcaatgataaaaagtcagtgcaa

SEQ ID NO: 7715 - DNA, 619 bp, Glycine max
gagaaacaaagagccactagaattgcaaacaataaaatgaaactatgaagcaaaatcaccccgacaaagttccaaacaattaaaattaaaagagtcatctcaaaattaaacttaaggagtttactttgaatacaaccagtgcagttcagtgaatacaaactaggcacttcatgcaaagtctaatagtaattgatagcataaacaaaaaagcttaactctcagtttgctccctcaacctcctgatggtgctccgtacagtcacggcacttgcggtactgtcaaaacaatgagaacaatgtcaggtctctcgtttggaaaataaaacatacaagtagaaagaacaaagatcattacttcaaagtgtaagcaccgccagctttcactttaccacagtccttgcatccccatattcccacagctttcctcttcacagcatactgccacacagaaaaaaaatagatcatcagaatagaaataaaagattaaacaaaacttctggttagaacacgtgaccctaaagacataataattacacaataacaacacaagtttcagctacctttccacaaaattcacagaaaaacttgctgtgttgactaacttccatcttcttaatctg

SEQ ID NO: 7716 - DNA, 754 bp, Glycine max
  misc_feature (745)..(746): n is a, c, g, or t
aatgtgcaatttgtcgctatattactaatgtcagtgtaagtatacattaatagaatgattaatgtgttgcatgttcactttctatttttacaaatgcgttagaactcttaaaattaaattgacatgagttttgtcacatgatttggggttcattttgctgtaaatttaggtggctttctgttgcaacgtgaatcagaatccttatgtgataaatttgtagctagaaatttgtggttgattggatttgtaaagtaatatgagtgtaattatttgactatatttggaattttaaatctgatatatcctcttatcactgaaaattgttttgagaacccagaagctctagttaaatttgttgttcaaactccaaaacatctttccttcctaggggctgttatctgattcaacattggacacaagttcggatttctgcgccttttacatgttataaatgacatgaaaatcttgaaatatgatgcaaatgttttgcattttatgtaacttttctgactaagtttttctaccatttaatgggttctgcttcttctgtagatgacgaatggaaggcttccaattcctgtacagagaccaaatggaacagccaactctggaacagtatcttctacttcatcggtatgcctttctccttttcttttggtgattctgttagagcaattgttgcattcttgttatgatacctgatacgtcattttattagctgcagtcaatgcctcattctcagagnnaaactgtc

SEQ ID NO: 7717 - DNA, 683 bp, Glycine max
aggatcggcagggaacaagttccgcatgtcactgggtctgccggtggcggcgacggtgaactgcgccgacaacaccggcgcgaagaatctctacatcatatcagtgaaggggatcaagggaaggctgaaccggttgccgtcagcttgcgtgggtgacatggttatggccaccgtcaagaagggaaagcctgatctccgtaaaaaggtgctccccgccgtcatcgtccgtcagcgcaagccgtggcgccgaaaggacggtgtttacatgtacttcgaaggtatttcactttttcttctgtttccttattattgatctctgtctttgttaatttttttttctgttttctaattgttattgtttgcgttttggcagataatgctggggtcatagtgaatcccaagggtgaaatgaaaggtatggaatatctcttattggtgtttttggtttcaatgattgcaattagaatatggttgtttaaattttttttagtgtttgtttaagtgttttaattaggctctgtttagataaaactttgtttatataagcacttacatgagaagaaaataagaagctagatgcattagcattttttataagctataatgcattttaaatttttggaggagataaatgaaaatacaagaagcgtagctcaatttttttgttagagaagtttatttga

SEQ ID NO: 7718 - DNA, 175 bp, Glycine max
tgacaactttctccaacatccaaactttctccagcaaaacgaccctgacaaatcccaggaaactgtccaatttacatcgtacctgcatgcatactgcacattatgagaataattccagtgtgggagcacagtcagagtttcaattaaaggaagctaataattaactaaaaaacat

SEQ ID NO: 7719 - DNA, 682 bp, Glycine max
  misc_feature (35)..(35): n is a, c, g, or t
tgattcagatgacactgataagaaaaaacctcagnatggtgaaatgggaggagtacgttcaattctcagtttcctattgcttgatcaatttatatttatgtcaaagtgattttccaattggattatatccacactctcagtcttaagaataatacattaaaaagcattaactttacattgctgtgcttacctgagtctggcttcttttgaaatatgcatcaggtgaatagtgaaatgcttagagagagtctcgagaaaatagttggagaagatgattccacgtttagtggatttgaccttgctactcttatcaggaacaaatatgggaggtcttatgatgtacagttgataaagaaggttagtttttaaacaagtggaattatatgcgtgatttacttgctctgagttatacatgaaaaattcagcccatataatatctggcttgtttgttccaaagtataattattgagaaatgagggggagttatccagcacttcgttggaaattgtacactgctgtttcttctgccatagaaatttcattgttcagctgatttatcttcttgtcaactctatccagattgcatttgttgatcaggcatatactttgaaattctcaaacatacatgctgttgttcatagacatgcaaatggtgatcaaatccacagtgcacattgccatc

SEQ ID NO: 7720 - DNA, 557 bp, Glycine max
  misc_feature (382)..(384): n is a, c, g, or t
  misc_feature (404)..(405): n is a, c, g, or t
  misc_feature (427)..(432): n is a, c, g, or t
  misc_feature (435)..(439): n is a, c, g, or t
  misc_feature (448)..(449): n is a, c, g, or t
  misc_feature (453)..(455): n is a, c, g, or t
  misc_feature (458)..(465): n is a, c, g, or t
  misc_feature (470)..(477): n is a, c, g, or t
  misc_feature (479)..(481): n is a, c, g, or t
  misc_feature (489)..(492): n is a, c, g, or t
  misc_feature (505)..(507): n is a, c, g, or t
  misc_feature (513)..(515): n is a, c, g, or t
  misc_feature (535)..(536): n is a, c, g, or t
gcagcaaaacgaggtgttggaattaacaagagcattagtggtgtcactcaaataaggacaagaagaatgagagggtgtagtttgtaatcacctggtctcagaatgtggtaaaataagattgttggagctactatttgtctctagaaattaaagtttctgatgtaggctttcaggcttttgttactattaatcaattgctaagaggctagctagctacatgcatttcctatccaaactttgtgcttgaactttcctcgatgtgtatgaggagaagaagagattgaaagggcagagtgtgattgctagtatcagtagatgaacaatatcagtatgtacatgtaattgcgtatatagttgtagtcgtaacaatggtcactgccannnttggaatctgtgctactacnnaacacatcgaggaacgtttatnnnnnngtnnnnntgggggatnnctgnnnttnnnnnnnnctgannnnnnnntnnntgagtaannnngctgaaagctacnnntagacnnnatttctagagacaaatagtnnctcacaatcttatttttcacc

SEQ ID NO: 7721 - DNA, 425 bp, Glycine max
agttcaaatggcttctatcacggaggccatgctaaagcttcagaaaactatagaagataatgccacggtggccgcctccaatacagctagggaagcggaaccggtgctacagcccgcaataaacttgggccgagacaaaaacatgacggtcttcagtcggagatatagtcctcaagcttacccttatggtttgcctccggacttcaccccccgaaccgctccgaacgatttgagccaagcccctaccttcgagggacaactccctccttatgccgactatcccctgcaagaagatgatgaaggagatgcccatctaggcactctacttcccctcaaggatccggccccccatgaattgtcccaaccaaacatagtccgccatgtcccgtctccacccgcacccgttaaagagtttgatccctttg

SEQ ID NO: 7722 - DNA, 190 bp, Glycine max
ttctcggggcagcaagtgttgccgctcgacaacgacctagtctcagagttgaaccaagacaagagtggtggggtgtacgagatcgatgtgaagctctacttcaggattaggttcaggctcggggatgtcaaaacccgtcgcttcaagcccgaggtcaaatgtgatatcagggttcccttgaggaccaatg

SEQ ID NO: 7723 - DNA, 545 bp, Glycine max
gattgatgaagtaggcagggttctggctcacctttatagccttccaaaggcacaatatataccagtctgcaaggatggagactttacattttccaacaaatcatcagaaacaaagtctcaatcaacaccaaaggtgatgcccactttatccatatttattgtaatttgtcttagtggtggtgcaaatcagcatcggttggatgttataagataaatgttggcatttgtaaacctgtattattggcaatcaactataaggtttgatcaaacattttaaatcactgccaatttgtaggatgttccacaaaatagttccccagctgatactgacaactcagtgccaaagggagctcaaggagaagctaatactgaatccaatggtggcaagggtgcaatggtaaatgtagccattgataagctgaaagattctaaaaggtctgatgatgaatccaaaggcatgagtacagaaggagaggcaagagacgaacccatactgaagtccaaggctgaccatattggggagacacgcaggaaccgggatcggg

SEQ ID NO: 7724 - DNA, 800 bp, Glycine max
  misc_feature (782)..(784): n is a, c, g, or t
ttgccgtagtggggatggagatgttttttcatttgtagactggaacaaccacagaactgactgtcctgaacttgctacggacatggttgctcgtggtgcactgattaaagttagtatcaccctggttcaactgaccattctcatttattttagtttgtcattgagtattatgtctcatgttagttgtcttcattagatgcattatggctgcctgaccttgacaattatttattttgaattatgtcaactatgactgtgttgtgcagccttggatatttactgagatcaaggaacagagacattgggacatcagttctggcgagcgtctaaatattctcaaagattttgtgaattttggtcttgaacactggggttctgacacaaaaggtatgttttactgatggagtagctgtattatatgcgtatttggaatctttctggtgcttgtgttttttccttgcaaaggatgcaatgttttgattgaggaaggggccttttggactataagaacatatagttttggggagtgtcatttaagattgacaagtctgcttgcatacatgtatatatagtgctagtgcataatcaagttttgatagcaagtattatttatgctaattttattccccagtttaagtgtggctattctctctctctctctctcttataattcgaactttttatttatatattgtgctacaggggttgagacaacaaggcggttcttgttggaatggcttagctacactttcaggtatatacctgttggtcttttggatgtnnnccacaacgataaactg

SEQ ID NO: 7725 - DNA, 355 bp, Glycine max
tgagcaacgatacttgtggtcatttagcttgttattttcagtctgcacctgtctggcactggggcaccttgtagtgggttttgtgtcccaaacaataatgaagtaattttgattctaccactattattggtctatgtaatggtccagtctgacacttacaacctcccttccaattttctatacatttataccgttgtgggctgagtttcttctagggttctagaaatattttttatgcttgttttaaaataatattagaatgtgatattcgttattcagccgtttgcttttaagtggagagttagtcatcagcatacttctttgcaattgtttactgttaagtggagttgaatta

SEQ ID NO: 7726 - DNA, 485 bp, Glycine max
ccaagtctagttctcatttacaccagttcaagaaaactacgaattcaagactgtccaacttttttagatgacctttttctggccttggtctcattgataatgtaaaaaaatgatttctctattttgcttctactgaaataattgcattactctatgacttgtgaagaagaatactgcatcttttgtaataaacatttaggatgttaacatcataggcagcaaaatcacagataaaactaacaatattgagcataggagatgatacgacaatggcattgtggaggatgcatttaatatcatgattgtaagtaaaactatctattttccaatgcataataacattttgtataggattatttatcaattaatctctggtgtcaattcaacagctctgtgcggttttgaatgtcaacaaaagaagtgtggatcgggacttggatgtgtatcgtaacttgctttccaaattggctcaagctaaagagctt

SEQ ID NO: 7727 - DNA, 341 bp, Glycine max
tgctcgttgtattgcaatgctaagagcatttcaagatgccattagagattactgcacaccacatgaaaaggtccttgttagggatttagcttcaaaaatcagtagttatgtatctttctttactgaatgtagaccactttctatgagcatgggaaatgcaattaggtttgtaaagagtcgtattgtcaatctgactttaaatcattcggagtttgaggcaaaaacaaccctgtgttctgatattgaccggttcataaatgaaaaaataattcttgctgataaggtgattgtccgacatgcttttacaaaggttaaggatggggatgttcttctcacatatg

SEQ ID NO: 7728 - DNA, 366 bp, Glycine max
ctcgccggcggttgacttcactccgcccttaatagcaatggtcgtcgtcgtcgccgccgcgtttcttgtcgtcacctactcccgcctcatcgcgcgccacctcagacaacccgtccaccgcctcctccgccgcttccgacgccgccgcttcctcccctcctccgtcggcgacctcgagtccctcccctacgattctcccttcgacggaccgcacgtgttctccccctacggtttggacgaaacggttattaaaacaatcccgttctcgctttatacagcgaaatacgacgtgcgttttgatgagtctcgctacgactgcgccgtttgcttgctcgaattcgaagacgaggattacgtaagaacgca

SEQ ID NO: 7729 - DNA, 611 bp, Glycine max
aagaggttgtgttgcaccaattttaaaagtaagttgagggtggcggatttaggatgtgcttcgggaccaaatgcacttatggtcatgtacgatatcgtaactatcattgataacactaaactaagcttaaatcaagagggacaagtgatttggttgcaaatttatctcaatgatctgtttgaaaatgatttcaataatatcttcaagttgcttcctagtttctaccaaagggtacaagaaaggcgagatggagtaggtgcatgcgttgtcaatgcaacaccagggagcttttacggaagactctttccgaataattacattcacttctttcaatcttcctatagcctccattggctctcacaagttagtatatgtaccaaacaaaacatctaattaattctgataatatcctatgttatgctttacacattaagctaacaacttcaattttttttttttcgggaacagacccctgaagagttgatcaagggagcaaaaccactaaacaagggaaacatttatataacaactacaagctctccaatagtctttaaagcatacttagagcaattccaaagagatttcagtttttttctaaaatcacgttcaga

SEQ ID NO: 7730 - DNA, 431 bp, Glycine max
ggtcatctttagtcacctttttatgtttcaagtacaaaagaattatttccaaaatttaaacaagttatctccttgtcaactcgattactactcaatcaagagtctaaccaagaacaagaaacttataaatcaccctaatccctgaaactaataattctggagaagtgagggttgcccaagagaccaatttgtaggaagggggaaagacagaggcagcaatgtatgagacattagttttccaacaccaagagtttatttgtcaaattcccatataacccctccatcttctgcaataccaaaacaaaagaccatggcaacaacctctaatttaaaattagaacaaataagagtaaagtaatcatttttcaagcaactaaaactttgtcatttaacatatgagatagccataaacttgaagcaagctagcaaag

SEQ ID NO: 7731 - DNA, 722 bp, Glycine max
  misc_feature (64)..(65): n is a, c, g, or t
agagtatgattctattattaatgttttctaattgttgattctagtatatgcccaaagtctttcnnctgacagctattatacttctatatgtatttttttctgtttattgttgtgaaactattttcatttatatttaggatgttgatagaacaagcacaaaaagagaaacgtgtgattttgacgcgggatgcaaagttgcttagacatgattatctgacaaaaaaccaaatatatagagtgaagactcttctaaaaaatgaacagctactcgaggtatggttaaattaactatccacataaagagattgataatatacattcttgtgaaagtaataatttaaattatacaatattatggttatgttgtcttttaaggaacccttatttatttaattttagaatgttaaattttatggacaatgcaaaagtctggtgatgggctagagtttagtacatggatttcgaagttatctttgtgttatttctcccaatatttccacacacacaaaaaagtctcttccaccttagttcaattattgcaaagtgaacagaaaaattaagcatttcttacttgagagagcgatgctatggtgtcacaaagcctaaacttgaagtgtttttcaggttattgaagcttttcagataaaaattaatgaggatcagctaatgtcaaggtgcacaaaatgcaatggaacatttattcagaagccactgacaactga

SEQ ID NO: 7732 - DNA, 332 bp, Glycine max
ctttcctttactccttcaatccttgaagccatccctcatgcaattcttcagctacatggttgaaaaaagctacatgttccttctctgcaatggcctccttcttgttttaatagccatcaactctgctccaatcaatgcctcttcaccaccaacaactgaacgtgctgctgtagctgttcacatagaagagaaaagtagccagttagaatccaaggaaccagacattgcagttgcagcaccaattgctggtgaggaaactgaatccccacataaagaagaaaagattttggtgagagtagaacaagacaatgtgctatcagatacccaagaaa

SEQ ID NO: 7733 - DNA, 575 bp, Glycine max
gtagaagaacaagacccacaccctctgtgtgaggtgtggccgccgcagtttccacctccagaagagtcgttgcgccgcgtgcgctttccccgctgcgcgcaccaggaaatgtgagttttttacttactaaagtaaatgggattgtgtaaaaattcggtctttgaattgtttgatggttccagataactggagcgtgaaggccattaggagaaagaccaccggaactggaaggatgaggtacttgcgtaacgtgccccgtagatttaagagtggcttcagagacggtatgtggtaatttgtaaataactatgcaaatgttttttgtattgtgttaagggtttgggtttgaggttttgttaacgtgacgcctttgaatcaggtaccgaagctgcacccaggaagagaggagctgctgcctctacctaagctttgaataatagcaatttttgctgggtcagtgaattatataggatttaatgtttctatgttgatgccgagctctttggaacacgtttctttctgtcgttttaatttcatttaatatgtagtggctttgtatttcgacgtgaggattg

SEQ ID NO: 7734 - DNA, 491 bp, Glycine max
  misc_feature (54)..(56): n is a, c, g, or t
tggtattagcagtttcattatccagctgttcttggcggccacaacatttgccannntttaactcgtcccaaaggatgaatcggcacagtttccttcgtgaacttgtgcctcaaaagttccattagcctgagcatttgcttctgggatcaatgcagctgctctctctgcagctgctctcttgtaatgagcctcaaagtaggctttcttcgcggcaacagaacccggcttggaatatttctcagcttcttctacatagcgattgtgtgaaaatgttgaccatttctcccaatccaggccttctgtcataaacctcccaaaagagatagattctccaagcgcacgaatagggttaccctggaatcacaaagaaaatttaaaattaaataaataaataccaatatatataacaagtcaccacagactcaacaacggagaagaaactgcaaaatcgtaatattgatataaatcttaaattaaaattaaaaaaaaaa

SEQ ID NO: 7735 - DNA, 379 bp, Glycine max
tatctactttgtcttcctcacctaccttctccttcacactgaaaaactcctcttcaccatcttccaaaccctccctttctactgcttgcagaaaagcctttttcaactcctcttgctcatcaccataagtcttcttcccatccttaataacaaagtctttatctttcaaaggcattaccttcttacccttacgtttttccttttcatctatctcctcctcttcatcaccaaaatctgccccctcctcaatcaaatgctttgccaccacatccttcaaatacattggcttttcacccttcttgtcttttgatttaactttctccttctcatcactttcatcatcactgctatcatcagacccaaagagcctaacatcatc

SEQ ID NO: 7736 - DNA, 350 bp, Glycine max
  misc_feature (303)..(303): n is a, c, g, or t
gctctgatgatgatttggttaggcagatggtggttaaagaaggaggggttcgtgttcttttgcgtgttttggatcctaagtggtcttgttcgtccaaaataagagaggttgtgatgagggctattgataatttgtgtttttcttcgcctagttgtgttagtgttttgctgagttatggttttgtggatcaattgatgtattatgtgagaaatggggaggctttgattcaggagttggcgctgaaggtggcgtttagattctgcgaaacatcggaggaggctaagaaggcgttgggcgatgccngcttcatggctgagcttgtgaagtttctgaatgccaaatcatttgaa

SEQ ID NO: 7737 - DNA, 1066 bp, Glycine max
  misc_feature (48)..(50): n is a, c, g, or t
  misc_feature (987)..(989): n is a, c, g, or t
  misc_feature (995)..(1004): n is a, c, g, or t
  misc_feature (1012)..(1015): n is a, c, g, or t
tgaagggaaaaggtattaatcttacaataggacagtacagatattctnnntgaaataaaaaagataataaaaaaaaggtagaaaaggtgaatgaaaataatttaaacctcactgttcattaattttgctgtggtagttagttaaagtaagagattatgaaagaaaatctttcaataatggtctaaatctaaccaatcaatcatcaaaccgcatcaaaagcaataaacctgtcatgcaatctattttcttgtttaaaagagaaaacaagtttgggtgatgaataattataacaagccttcaaatgaggttggctcactgggtttttttttccagtgttcctaatggctctaaaaactcaacaataagcataattgtaacgatgcaagatgtcagttatcactcggatactttccaagttagaattcaattcagcagcatatatatctaaggtgcatatataaaagcgcatagcaggtttattaatatcataaagaccacaactaaattctattaattcagatttcagaagactcggacattgatatcattaccattcaccgatcctaaaagaattgaatacttagtaatcatttgcattgtgaaaccaaccgtgcttaagcattggaaaaaaaatatagttcaaatcaaaactcaaacaacaaataaaattttatgtatataacaaccaaagaaactgaacaaggaaaccgtaaataagaaacaatttgaggaataaaaaggaaattaccagaggcagaggagagtggtgtctttcaacttcaatcccaaatccaatccttatattaataaattaataaaagaaaaaacacgcagcccgcgcacaacccgagcgaatcgataccctgacaatgatgtgcgaattgcgatatataaacaaacacactacactatctactactactcataaattcgttattttcacgttatagaatcaatcgaagcactttgttgctttatttgactctnnntttaannnnnnnnnntgctcaannnntctattctttcttttttttaataggaggaatcgaagataattcagaaaata

SEQ ID NO: 7738 - DNA, 381 bp, Glycine max
aggactctacaggtactattggcaactttctactccattgcacaatggaatggacctccgcgaaaatcagtagcctcattgatttcagatcatagtctccgccttcagaagcggagaacagaatgctgcatcattgagactgaaaatgcattggtgccttatcatgagacatctgaccatcaagcaggagaaattgttgagcttgatcaaaatgaattattttcccataaccgagcttcacgtttgaagctcaagtgtggtgacatattggccttggatgatccacagcagggacagaaaagtttccaaattcatgaatctctggtaggagggaagtattatctctatagtgcagtttgtcttgatcatccctcggagata

SEQ ID NO: 7739 - DNA, 483 bp, Glycine max
ggagctagcggaacccgcgtaggagccccacacttgatggcattcttcggaatctgaaatgagtagtagggtttggtttctactattccttctgctgatctcgaaatgccatcaagtgtggggctcctacgcgggttccgctagctccatcgtcaacccttccaaggtcaaacagatttcctggaagccaaggtagtaacctctcttctcttttgcactctttctctctgattccatattttaacttcaaatccttattatatatgcagagctttcgtttatgaaggtttcctcacggatttggaatgcgaccacttgatctctttagtgagtattcagtcatctctacctctatgcaaaaactatgaggctgtttctgttaagcaacttaacttacggttgttgctttaggccaaatcggagcttaagagatctgccgtagcggataatctctctggagagagccagttaagtgatgttcga

SEQ ID NO: 7740 - DNA, 607 bp, Glycine max
cctcatctttaattttttgtctggtgagtgtttttattatattttttaagagtttaatctgtgctattatcaaaagttgttggtgtagtggttgatacttgaaccttttaatcaaggtccaagattccattcttgtttggaaaataaaattgtaattaagaaatatcactgacttgaaaatagatggagcctatatagaaagaagattagttaagtattaaataaaagtcttaaatacttatgggttacaacaaaagaatctaccattcaatataattttttatattgttaattagtcaatcaaattataggcaatataattttcaaaataattattataaaaaacaataaatttatagtacataaaaattcatgattttccattaaaaaaataattcatgatttataattagatattaatataaaaatactttacatgttcataacataaactattcaatctatttacaattatattaatttttgttatatatatcatatacaagcttcttgttttgtttaataatctaatcattcttttcttactttttgggaaattaatcttagatgtgtccccaagttaccaaagggagaagatcacagagtt

SEQ ID NO: 7741 - DNA, 378 bp, Glycine max
accctacagagttccaaccagagaggtttcttaataaggagattgatgttaaagggcatgactatgagctattgccatttggtgctgggagaaggatgtgccctggctaccctcttggccttaaggtcattcaagcaagtttggccaatttgttgcatggatttaactggagactgcctgataatgtcaagaatgaggatttgaatatggatgagatttttgggctctctacacctaagaaaataccactggaaactgttgttgagcctaggcttccacaccatctttattctctctgagcagtgcccttgcacaaagggtttctctctaataagattgctgtaggaataaaatgggtcttgtgtgagcttatgtttg

SEQ ID NO: 7742 - DNA, 462 bp, Glycine max
aatgatcagactatgttgctttccactgttttccaactacaagttacttatctactattctctggtgtaggtattctaaagaagaacaaattagcttgcaagaatttcagcagagaaattttacttttcttataaagtgagttatctattaacatgatgatagtgttatttccagtactttgtctgacacacataaattggataacacatgctatgtttatgatgagagatcctacagactgttgacacaaagtgttggtatcgtcaagtgagtaagtctgtgaaataaaattgataaactttgtacttcagattcgtccttgaagagtatgtgttgttggcaaggactgcatcagcatgtgttgtgtgcataatggtcattgccgtgaaccaactatcctacaagctttagttttatgtaaagacgcatgaatagttttatattacatctcaattatccct

SEQ ID NO: 7743 - DNA, 469 bp, Glycine max
catacaagtacaggctgggattatggaggccacgtgctgagttcatcactgcctgattggtttctaagtagtaagtagtcgctgtttgttagaccatattgcaaatgtttagccgcagcagaatgacaatgctctacttgaaaagatcaagtcgcactgtctttggagaccacccatcttttccatcacattcatctcttgtggacaaagtttggtttttgcaccagttatgtaatgtacaatggacttgtcttaattgacagtttgtgtttgttatttcataattcatatcccgtgacatcattgcatattatgtaatgtatcacttgtttttagccaaaagaatatttcgggcttaggagtccgcaatgctttcatttacttcatgatagctgcggttcaatccaaagatgctgttgcagtttttttgcatcccttattagttgttccatgattgaccggataatct

SEQ ID NO: 7744 - DNA, 315 bp, Glycine max
ttcaaatggagtgatgcatcttgacattttcttttggaggtggtgtgtgtggtggtgcatactgtgaacccatcttgacaagtgtgcaccttatatggtgtgcacgatgctctgttagagtggctacaatagcaatagtaaattggtaactaactcaacgtaaatgaagaatgaaaaatatacccaatagtatctcaatgtgatgtgattatttttactttgtgccttttagttaagaatgttttgataaatgtaacttctacttgagactcaacaacaacaaaaaagccttatcccacatggtgtttagactcg

SEQ ID NO: 7745 - DNA, 728 bp, Glycine max
tactggcccacagattaagaagatatttgatactcggccagaaatttatagcagcactgaaaggatctcgcttgttagttccttcatggcgcgtctcttctcgttggcgcttatgctgccattgatcattctgatggtgcaggcatgaatttaatggatataaagtcctggtctaaagttgcacttgaggtttatattgatattattaactcttgttgatttggtttttgttgtgcctctatgtgtggcgggggtttagtgactatttattttgaagttcttgtttaaccaatgtatgtggattctaatggtgattgcaggcaactgcccctggtttggagtcaaaacttggagagttagcccctgcttatgctgtagctggaaatattgctccatattttgtagagaggtttgttggacatttttttccactaagttttcttttggaatatgagaaaaattaagacaggttgttatatgcttagaagctaatgtactatcaatttccaatgaattttatagtacaccaattcgcaacaaatcaagtcaacacttgggtaacatactaacttagaacctagagagctaaataatatatgctggagttgatgtttatttgtacaatgagaattttcctattctgaaatttgaatatttttcaatttgatattcaccacttgcataattgccagccaaattactctaattatctcccacatgtcatggtc

SEQ ID NO: 7746 - DNA, 393 bp, Glycine max
ctttaatgaaaattaaaaaataataaaagaagtgtatgtgtgtgtgcttgtaattctaacttggcaaggaatccatccattccaatccatcatctccctacaacgaagacagggagggaatgaacgaacctaagaacagatctcactttatgtccttttcaattcacatacacagaccaacccctaaatctccataacacattcattctctctttctctctaactctctggataagatcttcagatacagagggaccccacttcctccattaacataataacaatatccataacttctcaataccaaaactcagaagaacccatatgatctgggttgttcccgtgatgaagacgaatcctcgtttcttttgaggactatgctttgggtctgat

SEQ ID NO: 7747 - DNA, 602 bp, Glycine max
ttttgttcagaacaattggttttggaagcagggcttctctcatgtctgcagtgatcattggcagctttaaacctgtttcaaccctggtttcaattcttgttgtggataaatttggaagacgcacccttttcttggagggtggtgctcaaatgttgatttgccaggtacttccacccctctcctcaccacatcaagtccatgctgtgtggattttataatactcacatatttgatccttgggttaagaaattgattttaagttgaaacaactttaagtaacttttgcatctgataaaaaactatatactgaatcttaaaatatccaaacataaaatcatttcacatcaaaatcaattttgtatacccctctcaagcacaaacattttccatttcactgatttggttggttttggcaacagatcatcatgacagttgctattgcagttacatttggtaccaatggaaacccaggtacactgcctaagtggtatgcaattgttgttgtgggggtcatctgtgtatatgtttcaggttttgcttggtcttggggtcctttagcctggttggtacctagtgaaatctttccccttgagattagacct

SEQ ID NO: 7748 - DNA, 376 bp, Glycine max
tctagattctacttgtatccttccaagatagtctaagaatgaatgagttaagttgaatatggaaaaacaaatattcattaagatgttatggtttgattatcccaataacttttctcccatgattcaacttgttgaattgagctttcctttctctgtaatgttgcatacaaagttggagggtcaaaaggggcaggcatggtgcaagggtcggtatttgcaggaaccttgaccaatgattccatcataaatttctttactgatccttctgctccacaaaccattgactccacacatagttctgtagcattagcacttatggagggtttgtatctgaagagtttagcatatgaattcaggagatgaaacatgtagtcga

SEQ ID NO: 7749 - DNA, 411 bp, Glycine max
attgctatagccagacaacgtaattttccttgaacacctgatgtggatctgcccctaattaaagagtcagtaatgcgctgtaaagaagtgaaacgcctgcggaaaggagccaaatcacgaatgtgagcccaaacttggagagatttcctgcaagaaaagaacaaatgagcatttgactcagcctcatttgaacataaagggcagagggaacccttgttcaaaaaagcaactttgtcaagagtaagcagccgattccttttagcaagccacaaaatgaaagacatcttaggggggattgctgggttccatataacagaacaccaactaacagtaggcttgacacctctaatgtattcatagactttgccaacaagcaattgttcattggtgctccaagattgaatcctattt

SEQ ID NO: 7750 - DNA, 523 bp, Glycine max
ttccaaaactgcttatgttttgtctctctgtttaggttagtgcacgcaggtacatataggaggatatgattatggataaattaaaaaaatatctccaaacgctttcaatttttcacatcttttttgttctttccttcttctcatcatcttcttttcgaccatgatgcagagctggttctgactcgatcaagcttttgactccttaaaagagaaaaattatggagggtgacacattctctggtcttggcaatggtacccagattgatagcaagatcttgctgacatttaagaaaagctttgttcaagtccagaacatcttggatcagaaccgggtactcatcaatgagataaaccagaatcatgagtccaaggtccctgacaacctcagcagaaacgttggacttattagggagctcaacaacaacatcagaagagtggttgacctttatgcggatctttcaagttctttcaccaaatccatggaagtttcttccgaaggggattcaagtggtgctgtgaaatc

SEQ ID NO: 7751 - DNA, 420 bp, Glycine max
ttgcttatattcgagatcagagggagtataagagaagaaaataagaaagtaaaatgaaatgagcttctaacaaaaattgatttgtgaaaatcaacttatgcacttaatttttgtttaagtttttttcattcaacatttttaaaagctaaggtgcataagttgatcttaacttatggaaaagctcaacgtattttagtttctgctcaactcttagatttggtgccccttcatttaattggtttaacaggcactaaattatgaggaggctaaattcaaggcatttgacttggcgtcaaaaccagagggagctggttcagcaacaaaggacttgaaggctttattttcccagatcaccactcgcttttgattttggatgttgttgtcatggtcccaaaatccttgtgaattgaaccatatggg

SEQ ID NO: 7752 - DNA, 410 bp, Glycine max
gtattgtactgcacgtttggttgagatgttagattcctattcaaatgatctttatcgttgtgctgaaagtgatgcaagtaagaattttcttatgcaagagataaaggtactggacgaagcaaagtggattggtcttccaaatttcatgcctcgcactgcttttctttctatattgcaagggaaggtgaatggaattgcaagcaagccaataggtttggttgaaaatgtgtggaactatcttgaggatgtgctgatttctgttatcacgcgtcattccgaaaactactatcaacttttgatttctacctatcgtgcaggccagtctcttattttgaagaagaagaaaagttccatgaagccatgtaatggaggccattgaaatggagaagcataccgattacacatgtaac

SEQ ID NO: 7753 - DNA, 361 bp, Glycine max
taaagttttgtcccttgtaatttctttgtttggcttaatgaaaggtagtaaaatgatcaactagagtgaaaagaatgctgtactctgcctccgtatttgtgggcgactgttttatactttttaatttttagttaaggttaatgcttattctttttaaattagtaattctgtttacctttttagttgcaatatggttttatcagcgccatatatatgtgtgtgtataccggtgcagaaaataccactttttccaaattttggtatgtttgatgctaaatatttgtctttattaatcaggagctcatgttggaggcctacacaagcagctgtgaagtccaatttccatctcccaatgcgcagt

SEQ ID NO: 7754 - DNA, 445 bp, Glycine max
  misc_feature (24)..(25): n is a, c, g, or t
aaggcaggaatcatctattgctcnnttttacaagtggaaagacaagcgagactcaagaaaaagagatgaagatgatgagtatagagaaatacaaactagtcgatatgataggagaaacacagattctagccatttggagagaaggaatagcagagattataggaagaaacctgaagacagtggaacgcaagatatgaagattgactccggacaaagaaaaggaagtccaggtgatgaggattacaaaaatggaagggatcatgaggattacgaacgtaaaatgaaggatgaggattacagaaatagaaaggaagaacgtgtgcataaaagccaagatattgaagcggatgatggctacaaacgtagaagggaggatgcagattacaaacgcagaagggatgatggagattacagacatagaagggaagagcgtggacacgacagg

SEQ ID NO: 7755 - DNA, 509 bp, Glycine max
  misc_feature (6)..(9): n is a, c, g, or t
cataannnncactggaaatggtgctatccaatatttttcatataagcacagtagcacaaactaattgtattctgtacaccgagttacaaaagaatgattgtgcagtgaagtatgaattctgtcaaactaatctccacactgttaatagtaacaaccaacttcgtccaaagactcaaattcctctagcaaaatttaaacgctgtgctgcacgttcaatgcacactttatgtctatgtaatccatgccactcatcacttgaacgctcgttcatcagtcgaagcttggctatctgattatgcagtgcctccaagttgactagaggaacagttgttggtcgcccatgagcacactgcacagaaaattcccattttgtcaaaaatgctgcctttcctctcaatagattcacaaacatgaaaacgtatatcttacttggaaacagagtgatgtatgttttagctcttcaactataagggaacattctgatggtagcaaccttttccagtgagtct

SEQ ID NO: 7756 - DNA, 535 bp, Glycine max
ctggacgctagctgtggctccaagaagtatgaagcaaccttgtactctccttcggggcaaagagaaagggataaggtgaatgaaatccgtatgtatagggaccaatttttgttcagctgcttattttctgttcctgtgtttgtatttgctatggtgcttcccatgcttcctccttatggcaactggctaaactacaagatccacaatacgcttactcttgggttgtttttaagatggattcttagcacgcctgtgcagttcatagttggcaaaaggtactatgactatcaataactatttaattctaatttcttttcttgttaatgtttctctttattcaccaaagacaattttattgtattgttttcaagaaattggagattcttatagtcattttactatggctattactattaggttctatgtaggttcatatcatgcactgaagcgaaaatccgctaacatggacgtgctggttgcgctgggcacacatttgaaggacaagatttctttgagacaagttccatgatgatat

SEQ ID NO: 7757 - DNA, 371 bp, Glycine max
  misc_feature (364)..(368): n is a, c, g, or t
gatttgtgatcccaatttcgtatctttgtcaccctctcttcaagcaccttttggataaggcttatgaggtttacggctaccacaccgagggtcctcttaagcttccatgttcagttgatgattttcttcatctccgatggagaattcagaaagaatcctctacccatcatcaccataaccataaccataaccatcaccatcatcgccaacttcctcacgccttgtatttccatgcttgttaattcccacacttgtatactttctttctttctttttcttggttttgctagtgtttctttgtctgcctagctttaccttcttctttttttttcaagaaaaaaaaattgacaccgctctgtaaaannnnngga

SEQ ID NO: 7758 - DNA, 329 bp, Glycine max
cgtgggcgatggcgggacatggaagcgatagtgtgcacagatctagtggtatagaggttactgcagcccgcgattgatggtggcactcacgcatggtgaaggttctcggagaaggtggcgggagagaggaagaagaatggtaaaaaggggatattagataattatgaggtgcaccaagaaaaaaatggggtgcgttaaatagtttcaggcagctcgttatgcatttttggcttaatgggtcaaaattctccaaaatgctcaaactattactagttacttttgttgacagtggcccaactagtgtggcagcccactattactactcacaa

SEQ ID NO: 7759 - DNA, 387 bp, Glycine max
gacgcacagactttgttgagtggcgcaatgaccaacttgtacacgtgtcttgatggctttgcgtacagtaaagggcacgtgagggacaggtttgaggaggggctgttggagatttcgcatcacgttagtaactcgctcgccatgctgaagaaattgccagcaggagtgaagaaattggcgtccaagaatgaggttttccctggatatggtaagatcaaagacggctttccaacgtggctatcaaccaaggatagaaaattgcttcaggctgctgtgaatgaaacaaacttcaatcttcttgtggccaaagatggcactggcaacttcaccaccattgccgaagcagtggctgtggctcccaactccagcgcaactagatttgtgata

SEQ ID NO: 7760 - DNA, 388 bp, Glycine max
aattttatatatgtccacttgcattaggaatatatctgtgactgtgacttcaatttctttaatggttgccaagctataattaaccctctcccccatttgatattgcctaggttgagtgtatataataagaaatgtgcatgcgcgtttgcatggtacggtgttaatcttcatgacactttagtatttctgatagcagaataactctgagaaatggttttctcttctgcctcctcaatcttcccaatctttcttggtcttttcctttttgtctccagctagcgcctccagttttgtgttattaattggctccaagttacaacacagtatgatactccaagctaattaattaataaagttatgatgaaaaggacacaaacgtaaccttcaa

SEQ ID NO: 7761 - DNA, 385 bp, Glycine max
gtcgccgacgttgttgtcgtggtcgtcgccgtcggcgggagaatcttcccgctgcgatacgaccttactggctaagatggcgcacgagctttgccaatcggctcggctcgcgccgagtccctgcgagaaactcgcggattcgaagccgtaaccgcatttgactgtgaaacgggtcggagcgacccgaatgaccgagtgacgcgcccgggtgagatagttgagagggttggggtacggtggggtgagggtctgcatattaaaggacttaaatggaattaattaagaagaaaaattagggttggaaaggggaatttagttgcctattggtactagtactgcttgaatttgctgattggggctctggtctgaagcttgatgttcgtta

SEQ ID NO: 7762 - DNA, 765 bp, Glycine max
  misc_feature (55)..(57): n is a, c, g, or t
  misc_feature (752)..(755): n is a, c, g, or t
ctaggaagcagccactttctcctccggctctaagtgatgatttagaaactttcannncttgggctgatgaaataaggcatctgaaggtactgcaatgttctttatctgctgcagaagttgagttgaatatgagaaaatttgttttctataaattctcccacatgttgttgtctatcaggttatggcgaatgctgacacacctgaagatgcagtaacagctagacaaaatggtgcccaaggaattggactttgcaggacagaacatatggtacaaataaacattcaactccttgttatatcaatgagaagtgtggatagtgaatacattcttcttaaattgtaaatgctgtaacaacattgttcagtgatgttctccttacaaaagtgaaatcatgtggagcacaagataaaataaaagatatcctccttataagctaaaaatcgaattaatgaatttcttttaacctttctccagggaatccaaaagcaagaacacacattcattggaacacttgactagtcatatgcatgagcatgacacttgaaatgaactttttcattcttttttgataatcaacacagagtagttacaaattatatgaatttttgtgtatgcatgttttggtgtgttgtagttttttgcttcagacgagaggataaaggccgttagaatgatgataatggcagttacaccagagcagaggaaggctgcactggacctgttgctaccttatcaaagatcagatttgagnnnncttccgtgca

SEQ ID NO: 7763 - DNA, 364 bp, Glycine max
gtgcgttagtaaactgtttgcattccattttcttctatgcttctggttctggcattgcgttagttcctaggggagagaggaacccgttttgtgaacccttttgttttgtctttgttttttgtttttctcaccaccatgagttcttcacagcacttgaacaatgttggtgaagatagcagcagtagagacatgagtttcttccctccttcttctcgttatgtgggttcctcacaaacacagactcctcctttgtctctgagtcatggaaatggggtagagggttcaaattcaaaccctgagatgggtcttctgatttttgcgtccacagtgtttcagcagccccaggagtgcaggggaacaaaga

SEQ ID NO: 7764 - DNA, 225 bp, Glycine max
  misc_feature (48)..(48): n is a, c, g, or t
  misc_feature (54)..(54): n is a, c, g, or t
tagggaggtggtggtgatggagatggtggtggtggtgtcttataaacntatggnggaggaggtgagggagatggtggaggagaagatttgtaaatatatggaggtggtggggatggagaaggtggtggtggggacatgtagacatatggtggagggggagaaggaagaggtggtgacttataaatatatggaggtgggggagatggagaaggtggagggggagac

SEQ ID NO: 7765 - DNA, 414 bp, Glycine max
gcatgcagagtgttaaaattgaatattacagcataatgtttttaagtgggactagtcattcactcattcctatggccagggttggcggttcctgaggctgatattctttttgggagatctctcagttcagtttcctgtttttctttttgtttctggtcgatgttttccattccaggagtttgcaaataagcctcagggatagaatagaaggaagggttgaggcaatggagaggggttcaaggagactaatgaacagtttcaaaggattgaagacatgtaaactgagtaattgggaaatagtcagtcaagagaggatggagacaattgcattgaaatagagggcatccaaggagacagtgaactgagttgggaaagaggaggaggaggaggaggcagaggagatgaccaatttag

SEQ ID NO: 7766 - DNA, 409 bp, Glycine max
ccaagatgggaaagagttgagtttagaagtgtttccaaaggccattcttgtttgccatcttgatcccaggcattatcatcatcttgacctgtattatctgtacatgagtcctaataatgtcatccaagtatgcagtcctaatctgtatatgctctgtgatttcgatttgttgttccaaaagcttgcattgggtgtcgagaaggactggtttcgcagatgcaggaaatggtcaatgaatttctcgtttcgaaaaaagtttcctaagattgcggtatgttgttctataatatctagattgaaaagtgtcatggaaatggtgttgattttgaagttcagcgtactcatcaatggcactatgcaatttagttcttcatgtaattacatatttagaacatgggacccgataatc

SEQ ID NO: 7767 - DNA, 505 bp, Glycine max
catctcctatttctaataacataaatcatacttctggatttggtagtgtgacacagagatctgaaaacactactaaaagattggacaaccataaaatttctagaaatctcactaatcctctagaatctccagaacagctattcacaagtccttatccaaaaggtaatatgatactaaaatttcttttttccatttctggttttatggttagattaaggacatattttttttaataatgtataatactgcttatttatgtggaatatgtagcagcagttacggattcactggagaatattgatcaagaatatgttctggtgtctgggccccctatagatgtttcatcttcttcagtgggtgcttcaaggcccagccataccccatatcggtcaggtagtttaccccaagagtcttctagtacaatcactagactaagtgttccaatgccaatagttggtgtaccttccaatagcatatgccaaattggaagttcaggaagtcagga

SEQ ID NO: 7768 - DNA, 398 bp, Glycine max
aatgttatgagtctcccatcgaatagaatataaatcttaaagccataacgtggtatttaagccatggaactctcccatctgaaggattagttttttgggttgacctcttctcttatgcttaaatcataagttcataacctatatagcctggatttaagacatgaggctccaccacctaataacaattgagaaagggaagtaacctgtgcagacattttcttagtgatgttttcattaggtgcaattctatgtatgagacaggtgctggcagatgttatagaatctatagcaggagcgatttttgttgattcagggtacaagaaggaggttgttttccaaagcataaagccccttttggaaccccttgttacacctgaaacagcaaggagacatcctaa

SEQ ID NO: 7769 - DNA, 440 bp, Glycine max
aattgatgttcagggctgggaatatcacgttcttaaaggagcatcaaagttgctctcaaggaaaggaagccaagccccttatctcatatacgaagaagatgagcgcttgttacgggccagtaatagcagtgcaaaagagattcgagacttcctacgtagtgtgggttatcatgattgcacccaacatggcacagatgcacactgcgtcaagaaggattgatcataattttggtttttagtttttgctgctcctagatggaaaaccaagttattgccagttgactatgtcagctaattcttgagtggtggattgattgctgatggaaacgagttaagacgggtggcaactacatcgctaactgcaagctgcttcgtgatctctctatctgtccacgtagtttgaaatgcatgtgttattggacaagcatcacctatgaatc

SEQ ID NO: 7770 - DNA, 414 bp, Glycine max
tctgtttcttggaacactataatccgctgttatgcgtctaggggtatgtggaaggaagcgtttcagctatttggaagcatgcaggaggagggtgttgaaatgaatgtgattatatggaacaccattgctggagggtgcttgcattcaggcaatttcagaggagcacttcaacttatttctcagatgagaacatccattcatctggatgctgttgcaatggttgttgggttaagtgcttgttctcacattggagccattaaattgggaaaggagattcacggccatgccgtgcgaacttgctttgatgtgtttgacaacgtgaaaaatgcattgattactatgtattccaggtgtagagatcttggccatgcatttatgttgtttcatagaacggaagagaaaggtttgatcaca

SEQ ID NO: 7771 - DNA, 391 bp, Glycine max
atgactgcaggggcagcgaccccataaggggtcgtcttcggccgcaaatggccctggccttggccattgctttgatttctatcactttggtttccgttaatgctgatggttacccttactattcccctcctccaccttaccagtacacctcaccacctcctcctccttacctctacaagtctcctcccccaccctctccttcacctcctcctccatactattataaatctccaccaccaccctctccctcacctccacccccttattattataagtctccaccaccaccttcaccatctcctccaccaccctattattacaagtctccacctccacctgaaaagtctcccgctccaactccctactactataagtctccaccaccacaacc

SEQ ID NO: 7772 - DNA, 345 bp, Glycine max
aacatgcagctttttgttttcatttttatggaaccacctttcttgttatttacggtatggttattattatggggactgtattggagttaggagccacccctgctcctgctcctgcacctgcaccattgctgcctccatcggaagcaaatgctatactcaacagtggatggtggaatctatcacagttagattcacacaatatctgttcatggtatggtatagattgcaacgtcgctggaagtataactggcatcagatgtccattgggtacaccggggattcgattagcaacactaaacctctctgttttcaagaatttagaatggcttgaggtctcaggctgtg

SEQ ID NO: 7773 - DNA, 430 bp, Glycine max
ccctttggttcaagaagaactctctacaagaacacaagtctcacactctgttatctctctcttcccttacgtgcccagtgtttcctctcatatgtttctcacaaaaatctcagtacctctcacaatgattatagttagttacccttacacagatcccgtgacctctatttataggctccaaatcactaagactcaacaacataagcctaacagaaaacactcaatagtctgatgcgtatcaaattaatgaaacaaattgttccatctgactaagcctcagtttgataacagcagacgatcctcatcagaccgaacaatagattttgagtcatagacaacaatttttgttagaaatctcttgggaaaataaagataagagttataattttataaatattgccagtgcaaaacatcttcacacagcacaagg

SEQ ID NO: 7774 - DNA, 458 bp, Glycine max
gcgttcattttgtaatatagaagcgagaaagatagagagactgacaacacctctctctctctcccctcgttgatcccaaatctattagggttagggttccgtggcctttttatcaatttttttcgacttttatcggtttgtcatttttttttataattaatctgtttttctgttttctgtatgcagggtttttattcgatgctattcggcctgaagctttcgtttcgcggatttttttaattattttttttcctgcctatcaggttagattgtgtcttgtaatgttcgcagattttattttcgtttctgttgttgcgttcaaaatcatttgttcaggtttgaattttttttccaatgttttttaaggaatatgaattttggttgggtggaaaaatggatattatcagttatgcatgcagatatgagatatgcactaagggtagacaagtaggattgcc

SEQ ID NO: 7775 - DNA, 1180 bp, Glycine max
  misc_feature (60)..(62): n is a, c, g, or t
  misc_feature (64)..(70): n is a, c, g, or t
  misc_feature (105)..(105): n is a, c, g, or t
  misc_feature (1142)..(1144): n is a, c, g, or t
  misc_feature (1171)..(1174): n is a, c, g, or t
atacatcatatttatgcctgaggtgtctatatctgccttatcttattctaatgcttagannntnnnnnnnaaaaagtgtcttttttcttacttttgatttgtttntactgtttgctatagggatcaaaaacacacatgggaggcaccatgcgccttggatctaggaggacatatttccagaccaaggaatgcaaatctgcaaaattgtaagtattaatactgcattcaatttttttaaaagacatattttgtgtttatgatggacaatatgaatgagagtaatttgtgtgtagtatgactgcactataaaggacttcctatatagtttggctaaaatggtgagattattaggtttctaaccctttgacccttcttagatatggctgcaaaagcttcattgatgagagacatcggcatagatatgaggtatttcattgtgatgcacaaaattatcttgtgaatgtgagtaaaacagaaaatgatcttgtcatatgcaggtgaatccggatttagtagcctgccttgaaaatgctggtctttcttttactggaaaggatgaaacaggtcaacgcatggaggtatcaacattttcgtgagtatgatttttttaattattatatgcatatgctgtgcttataagatgtttgtctttttcatgcttcagattcttgaactacctaaccatccttattttattggtgctcaattccatcctgaatttaaatcaagaccaggaaaaccttctcctttgttcttaggtacttatctgatacatgtccacattatatgtccaagttgactttaattgatcttctttgtagtatatatgatctccaaacttcaatattcttaggtacttcattgttgtatgctttccgttggaacattgagttatacctaaattagctatagcctagatgctatttcttttccaacaataaaattccttattgaatgaatatgctttagaagaaaatacacatttaaatttgccgaggtagacattttcatcccaaagcatcaaacttgcattcctgaaactaagttttctgcttgaactgtccttatttattaatctcacttgtgcctagtaatggataagcaagggttcttgttaaattccttgctatcaaatgataacnnncagtttcagattttaaaatgtaatttnnnnaattgc

SEQ ID NO: 7776 - DNA, 478 bp, Glycine max
  misc_feature (432)..(435): n is a, c, g, or t
tcaagtgcacaccaaatccttagtgccaaatcacaagtgaaaataccaatctcatgttcttgtgtggatggcatccgaaggtccatgtcaaccatttacactgttcatgcagctgatacacttgcttccatatcagaaggctatggtggattggttagtgctgaacaaatcaagattgtgaacgccatcaatgccaccaaccctttgacatatagaggcacccttgttattccactgccatgcacgtgttttgacaatgtgaataatgggggaaatgctatttatatgtcatatgtggtgcagagaagggagagcctggggagcatagcaaccaagtttggtacaactgtttcggacttggaaactgtaaatggctttggggaagctacggtagatccaggagacattctatctattcccattgcagcatgnnnnccagtgtaaatggttgaaatggaccttcggatgccatccacac

SEQ ID NO: 7777 - DNA, 443 bp, Glycine max
  misc_feature (6)..(6): n is a, c, g, or t
tttatnacttgatggaccaatttatcaaggggaaaaaaaggcttaaagcttacatgtgttttactgatttaacatcagcataaacgccattgtgcacaagcataagtgtagtatactatatgttatgtactactatatctggtgcttactacctcgcgtaagcagcaagtttttcatttctttgtaaccatggaactcttccaatgcatcagctgttgttttcctagtggctatgatcccagaagacattatgctcacaggccttgatggctcaaggatctgattgggccctcgagtgttatggttccgggtttcagggtgtgaaccttgtgacaggtgttgtgaggtggagaaatcttgacgtagaggtggtgcttttttcatcatatgtacaagcacaccaacagcagcatcttgagactttctaatgggaaaaaagaaaa

SEQ ID NO: 7778 - DNA, 450 bp, Glycine max
atttgaaggcagctcctcaattaccacattgtaaaacttctggatgtcaaacagcattttttcatcatcctttgtgacgaagttaatggcaacacctttcctaccaaaccttccactacgtccaatacgatggagatagttctcaggctgcgttgggagatcataatttataactaaagacacttgctggacatcaataccacgggccaaaagatcagtagttatcaaaacacgggatgacccagaacggaattcacgcataataatgtccctggtattctggtccatgtctccatgggttgctgagactgtgtggtctcgacttcgcatcttgtcagtcagccaatcaacctttcttctggtgttcacaaaaatgacactctgagtaattgccaatgtctcataaagatcacacagtgtgtcaagcttccattcctctttctcaacata

SEQ ID NO: 7779 - DNA, 450 bp, Glycine max
gtttagcgagaagcctctcaacatacttgccgagaatatccacctcaagattcactttttctccgacattcttcagaggaatcaccactttctgctgagtgtaagcaaccaacatgaaattgaaacactcttcatggtcaaacacatcgaccacagtcaaactagtcccatccacagcaatgaaccctttaggcacaatgtacttcaacaaccccttatcagctttcaccttcacccagagcgaatctccttctggaatcttcgacacgatctcccccgtgccgtccacgtgaccctgcacgaagtgcccgcccatgcggctcgccggcgtcaccgcccgctccaggttcaccgccgacccaggctccaattccgagagggaggtctttcggagcgtctccggcgacaggcccaccgtgaagtcggcgactttggtgtcgaattctgtaa

SEQ ID NO: 7780 - DNA, 554 bp, Glycine max
accagattcctgagaatcagccttctgaatttcagcttcacagcactcaactgaatcagtctggttgaagctgcaactcatgtttcccatcaaaccattccaaatttgaaagatccagtgatcagcagcagtactcctctatgaagaatctgattaaaaacaagaaaaatggaaaaataatgagaaaaaaagaatcagtctgttcagataagagaagttatcaacatcttagaaataccaacaacaaaaaaaacttactacaatcaagacaaattgtgttaatctttttgacacaacgtctggcaataattaaaacatgacagtaaaaataactttccctgcccatcaaaatacactcccacaattcccctacaccagaatttctaagtttaaaaccttctcctcaaattcaatccacaaacacactaaaataaacttgccctacccatcaaaatacactcccacaattcccctacaccaaaatttctcgtttttagaatcttctcctcaaattcaatccccaaatacactaaagtttgaatcttgactcccaa

SEQ ID NO: 7781 - DNA, 404 bp, Glycine max
tactctccatctattgcttgtttgagaaacaccaatgctataccaaaatacatgcctaatctaccacaaatcaaggcaattcttcaagtttactctccagttatgtccttgcaccctgatgaagaattctttccatcttctgtggagtggtttttctccaatggagcacttctatataagaaaggacaagagtcaaatcctgtgtcaatatcaccaaatggggctaaccttcctcaggatcctaacattgatggtgcctattgggtggaccttcctgctgattcaaccaacaaagagagggtcaagaaaggagacttgaaaagtgccataagctatgtgcatgtgaagccaatgcttggaggaaccttcactgacattgcaatgtgggtcttctacccattaaa

SEQ ID NO: 7782 - DNA, 423 bp, Glycine max
ccgttgttgttccttctttcttctgcggcgaggagaagagttgtccgaagccgataaaacccgatttcgatgcgccacggagggagcagacggggacgttgagcaccggcgtaaccctaacgttggcggaataagagcgttccattccgcggtgcttgaagcggggcccaccgttgaaagtgcttggactactcgagcttcgttctaagctctgaaacactattttccccgaagagttcattctagggctgtccacggaaactcccctgcacgtgaccgtttccgattcccgccggatcggactcctccccgggcgggaaagctgggaaggctggtccgacgagtgcttgttcgcgtcgaatgagttcgtgcggtttttgactaggcgaattctacggttagggttgcggtggagtgagatct

SEQ ID NO: 7783 - DNA, 394 bp, Glycine max
gacagattgaagggggagcgtgtgaacaaccttgatctttcaaagggccccattgaaacaaggtcaagggataaatttgggttccaggaagagaacaaatttgattctcttaacttaagcatgttgaacctggactctaaatttactgagaatgtgagcaaaagctcgcttcgaaatggtgtttatggtatgaatgcagtgtatcagaaaaacaatgcaaacttggtgagtaatgtgatcagtaacaagtacaatggtaatattcttcataacaaagagatcaacaacaacaccaacaatgaaagcaacaacacaaatgcaaccgacaaaaggtttaagaccttgcctgctgcggagacactcccgcgcaatgaggtgcttggaggatacatat

SEQ ID NO: 7784 - DNA, 274 bp, Glycine max
tatttgtgtcagacacttcagagacaatttgtatatgtctacccttgtgatttattgtctttatgactcatgcttacttttagaacatggattgcttcttttcgtttaagatttgtattttatgtatttgtatacaaaacttatgcattgcacttagccctatcatgtcctatgattttgaaaattttccatatccctatgtccttgtcttattgtatctgtcattctgtctgtgtcatatatataattagagatgtcactttggaataaaccc

SEQ ID NO: 7785 - DNA, 529 bp, Glycine max
gaaaagactatcctaatgaagattggctgcatttgaccgcactcatccatggtacatacccttcgaatctgtttacaagagaagtgcaaccaataatacactcttactaatacacattttatcgttaattaaaatttattgaaaatgtgttaaatttattcaataataaaaatgtgttcaaaagagtgcacttaaaagtatattatctttttagaatgctcttttcgtatacgatagatcatagagtgtttgtctaaaaggtcaatttataatttagaagggatagttatccttttccttatttgacctgatatgatgacttgaatgtttggatcccattctatatatataaaaatatagcgccagttgtatattcaaagagaggtcattttcaactaacagagactaaattaatattgttgacacctttttcagatcttggaaagattcttgcgcttcctagctttggtgagcttcctcagtgggctgttgttggtgagagcggttccttaatccttatttgtattag

SEQ ID NO: 7786 - DNA, 543 bp, Glycine max
cacatctgtcattgtagaggctgaacagtgaatcagcatgaattaagtcataagttctaggataagtagacattgcttcacacctgaaacataattgtggccacaagcatttcagaacttagaagaaaaagaaaagggagagaacttcatcaaataaagactacaagagaatactgaatgaactaaccaattatggtatgttccaatcaaccccctttcataaattgcaccaagtgtgtcaaccttagcctggacaggaaccacattcatcacccaaacaggtaaatctacaagtgcagcagcaaatccacccaagtaagcattcatgtctaaaaggttgcggtatctcccagcttttcctagttgattattagccttcttataatatgctacccttttcttccacagttcattatcttttgagaaagtttcgggattcacaccctttatggtcccccgagaaatccttggtggggtggcttttagtctttcaggccattttttcaatgccccgcctgcagtttcttctttgctggacacttc

SEQ ID NO: 7787 - DNA, 762 bp, Glycine max
atccagtatctgtgagatgataaggaacaaggtccacatataataatgttgggtgaaatagaagctaagtttttagccagtaaatctgcatattttttaaagacagtgatatataaaagtaaattcatattaaataaaaatgggaactaaaaaaattaaaaacctggccattcatttctttgcgagctgcagcagctgtagtttcagaaacgaaccgcacaaatccataacctcttgatttcccagtcacatgatcacatattactttaactgcaaaagaaaaaaaaaatgaaatggttgcaactgcaacatagttacatgaccaaattgggacccaaaataagagaaaaggatctttgattttaccttcaatgatttcaccatgttgcccaaaggcatctctcagaatcggttcattggtatcataggaaagccctgtattgcaaaacaaaatgaaaaaactaacagttaaaattgaacattcaagatgaattatcaaaactcaaaaggtgcaaagtgcaattattattagtatttttttaaaaaataaaggagaaaagaaagaagctggagaagacctgtgacaaacaacttggttgatgaatgatgacgcacacatagaaatctaggtaagtggaaacgaagagcgctgccattcactaatgcactggttatttgcataactgtgaactttaaattgatatccgaaacacaataaagcattttccgcaggctatgggtgaaaccacaagccgttttcac

SEQ ID NO: 7788 - DNA, 538 bp, Glycine max
taggttgtacatgcaagagattgacaataaggcaggcaaagcaaattccacaggattggtgatgcttagtactagaaacattggaagttaccaatcaatccaagaaatgatgaaggctgattccaaatctccttgggggaatcatatttctttcttgcacgtacccatacctaagctaagccaagccagcctatccaacccccttgaatttgtttggaaagcccaaaaaataatcaagaggaagagaaagtctttcactgtttttctcattgaatggcttttagatatggagctgaaattaagaggacacgaggtgggagcatacatgtgccggtttaaagttttgcatgattaatttgttattaggcaaacccagttttttttttctgttttaaaaaacccttcttttattgacattataattataataattattataatttgttacaggccgtggctaaacatatctatgggacactaagaaactcaagtgttgtcgtatccaacttgattggaccaatagaacctatggctttgg

SEQ ID NO: 7789 - DNA, 729 bp, Glycine max
  misc_feature (54)..(57): n is a, c, g, or t
  misc_feature (59)..(60): n is a, c, g, or t
  misc_feature (454)..(454): n is a, c, g, or t
gtggtataaccgtgctgagccaatcctaatgtcatctgcggtggcctcgtgggnnnntnngataaaaatgatgacttctctgatgaaagatccaattatgaacaaactgagcctacaatttcaggttctgctcctcttgtaggcatcttcgctaaactgcaaagtttgtatggtaatcataatataggtgaaggtgagggataaccaccatcctaagctaatctgctctgttgtcttccacttccactatgaagcctcaatcatatatatttttctcctgtcacacaggttacaaccataatgaatcaccagtgccccagcaaaaaacaccaagtgagtcctaaatatgatttttcacatttactcagcagctaatagtgtttgttttcacatgttgttgcataactgacattatttctgactttccaaacatgcatatagtaaaataaactancacaaggtcaaaaaaagagtttagaaaatttgtgctcatgcagcctttgcaccaacatctattggattgacaggtacaaatccagggaaagcaacagtgtccaagacatcatcagaatcagaaggtgatatctaaatctagccatcgttgctttccaaattaattttgcaagcactggctgaagaatggtaaggttgtgttgcaggtgccgcagttgaattccttcactcgataagtagctcatggactgttggaggagcaacttatttaccatc

SEQ ID NO: 7790 - DNA, 771 bp, Glycine max
caccaagaacctatcagggacttctcttttggtaccatcagttcaagaattggctaaagaaaagatatctaatgttccacaaagatacattcaacctcaacatgaagaggacattgtgatcctctctgaagaagctaatagtagccttgagattccagttattgacatgcagagcttgctttctgaagaatctgggagctcagaattggataaacttcaccttgcttgcaaagaatggggattcttccaggtctctttttttctctttatccttcaattcctttatagctgtaagtctgtaacacatctttctgtttgattctggactctagaaattgtagatacatgatagaaatcagtcgaatcacttcaaagctaaaattatatatgtattagagaaaatttaaatataatttcttgagtacttttcgtattgttctctactcagaattgaagtttaatataagtagttttcacaataaagctttgtactttgtattatataatagcataggttatccaaataaaactctgattctgataagagaacaatatcaaaaatacttaaggaactgcatttaacttctgtccatatgtatatgctaaattcaaattttggaattatgaattgatttattacttaaatgttaattcccttgtagctgataaaccatggtgttagctcatccttggtggagaaagtaaagttggagattcaggatttcttcaagcttccaatgtcagagaagaaaaagttttggcagagtccac

SEQ ID NO: 7791 - DNA, 680 bp, Glycine max
ctgcacagtttttggagcaaacattctccacttaatgtaattaaaaaatgtagatataacattccccatccccaagggaaaaaatgcaaattaattaagtatatgcttaaacacatgaccatggcctaaaaaacttttattagatcctttgattttgtgtttgtctgtttggtccctctgatgactgatgaaactgatagtataaaaaagttaaaggactttattttggaactggtggtgatgtttgcaggtacccagttgttttgattgctatgtataatgtggtggatttcatagcaagatatattccccttgtgccatggctaaagttggaatccagaaagggtctactaatagcagtgttttctcgattcttgctgatcccagcattctactttacagcaaaatatggtgaccaaggatggatgattctactcacctccttcttgggactcaccaatggctatctcacagtgtgtgttctcactgtggcaccaagaggttacaaggcaagttacaaggctttcgttatacaaatacattctacgtatataataatttctctttaaaatattagtaacatcaaataaatgactttggagtctgtggtgttgctgcagggtcctgagcagaatgctttgggtaatttgcttgtcctgtgtcttttgagcggcatattt

SEQ ID NO: 7792 - DNA, 393 bp, Glycine max
aagaaaagagcagagaggctctgcatacgaatagcagatgaagtacacacagagaactacttattcacgagtaccaaaaacaggagactagtactacaatttgtcaaaaggtgcaatcatgcataatgcatgatagctcataactgggaggactcacggattaactggaactccaccaccactgccagggtttggaaactcaaaaccagggtttgggacaaaggtgtcatcaccacctggaacataaccacgacctagtggtcctgaccctagtccactaccaccagtgtttgggctttgaggtgtaaacccaaagaaaggtggcagccctactcccccaaagccaggaaaatggaaattaccttccggagggaacaaaaattgaggctcttt

SEQ ID NO: 7793 - DNA, 331 bp, Glycine max
  misc_feature (268)..(268): n is a, c, g, or t
aataacgaaactcttcccaaaccataaaaaatgcagtgtttatctgaaagcaacggtctaagattagaagcctcaatctcaaatcatttcgttcttcacgaggccgaaaaataatagtaaaaaaaggggggaaaaaaagaagaaaagaaaaagctcagtgtcacgtacacccatcatcatcgaaccccttttgctttttccttcaaattttattttttttttcctgggtctttgctggttgcagcaatcagagctgaaataaaagctntagaataaaaaatacggagaaagaaattcaaaagggtatccgaaaaatgcctttcgtccgcat

SEQ ID NO: 7794 - DNA, 389 bp, Glycine max
acatggcaaacacaaataacttcttaacccaacttcacaattgcacccgcaaaaaacctaacaccctattcaccaacctctaccttctcacctttgctacctttctttgtacccttttctacttcctcggcctctggcgccactaccccaccaccaccgccgctgccatcgccgccgtcgcagaatcctcctccctatgcttccaccccaacaccaccgtcacaacccaatcatccaccagtctcgacttcgccgcccaccacctcctcccggaccttcctcccacggtggcgcgtgggccctatctccctccttgcgcgtcccccttctccgagcacaccccctgcgaggaccaacaacgatccctttcattcccgagacacaaacta

SEQ ID NO: 7795 - DNA, 409 bp, Glycine max
tttgtgctttctgtcactgctaccaaggatgtaagagttggttgcaaaggtttggcctaaactccataagtgcataccaaagctgctaatacaatttctatcggtatttggttgctagtatatctttgctaacagttggacacaacttcgcactggaatcagccaacaaaacaaaattatatattcaatggtcgtcatgcaacagcttcctctgcagctgcttggtcagtcttgctgacagtagcattcaataatgattatttgaagctcctttctggatgtcctggcatgcttgattccagagtgcccttgatgaggaaaaacgtgtaaagtttaaagaaaatattgttcatatattttgaatcttatgattctgtaatagatccagaattccaggtgactaatttgg

SEQ ID NO: 7796 - DNA, 369 bp, Glycine max
ttttgtagattcctgcgattgctacacctgaacgcaaaaatgagacgcaaacaaaaattaactaaaataatctatattactaataaaataatattaaattaactaaaacctaacaatgagcaataaaaattatctatattactaataaagaataaatataattcaagctgtgaatgttgagagcctctgcatcaaaatgtaaattgaaatccctgtgacccaaaaaaaaccataaacaaagaagtccaaaactactatattcaattatctgaccatataaataaaggatgacatatatgtgataataaaacatgtcatatatttgaaaatcaaagttgaaagtgtctaactcaaagggattgaacaaac

SEQ ID NO: 7797 - DNA, 689 bp, Glycine max
ttgttatgcattcgagccaagtacaaaactttatatgtgttagattcgatgcatgataatttctcaaccagcaagaagaacttggatgatgcaatggtagtatttaacatttattttccctcaggaaatatttacattagttttgtcaaatttgtatccctagcttttctgtctgatccaaccaaaccaatggtatttttatgcaaagaaacatcgttttaaggagcttctggtattaatgaatcctggtttgaccaaagagagtgcatcaataacacttcttcacgttgatgttcccaggcagcaaaacatgtgggtagtgtgtgtagctctaatgttcatttatgtagaaaactcaattcatttttggtgctaatagtatattgtttctcattgatgctttatatgtttgataaagtcatgcttgtggcatccatgtgctgaaatacatggaaatttgggatggatcaataaaatggcaagacaaaaccatgcctgattatcaacacgtgagtatttatttgtcttttactaaactaccatgtggaagtgggacttacttttaaaaaaattgcagaaagaaatcttgaagattcgacaaagcctatatgtggatgggttcgacatcctaaaaacgagattagagaagagattttgaaggcagcaggagtatgggggaaattatgctg

SEQ ID NO: 7798 - DNA, 360 bp, Glycine max
tataagcagcaaattcaatttcagttcacgtattaattcatgtttctttcccacgactagcatctatactattgtcgctatttcaaatagctctggtggagcatataaggcttccaaatacatagagaaggttcacgtatctcaaacaacaatcagctttttttaaagttgcttttgtcttatcccagaagtggactaattgtaaaagaggaaaaatcagccacattaaaattactttaagatccctttgatatccaaaaattgtttaataacagacaagtgagaaatgttagagtaaaccaacaaaatttaggtagggccggatataaatattggctaagtaacatcctgtaggggtag

SEQ ID NO: 7799 - DNA, 4784 bp, Glycine max
  misc_feature (3589)..(3589): n is a, c, g, or t
ataatgtaggcacatatagtgaagagtattttgtttatcacattttgttctttttctattttatttattgcaatttctagattttgagatatcatattttaatttttattcattttgtgtatttgtttcaacgattattgatggatttgcattttaaatcaaatggtaaaaatcgggggaaagtaaaaccggcaaacacggccttgtcctcacccgatacacacacatataaatagggcgaaaactcaatagttaactcaaacattcttcagttctaagaaaccttaaaaaacaagtagtgttccgaaaagatggctcagcaggaagtggtagaagggttcaagttcgaacagaggcacgggaaagagcgcgtgagagtggcgcgcgtgtggaagacgaggcaggggcagcacttcgttgtggagtggcgcgtgggcatcactctcttctcagactgcgtcaactcgtatctccgcgatgacaactctgacatcgttgctactgataccatgaaaaacacagtaacaacctgaaccttctcagttctcacccgctatttgttttctctttctttctttcaatttttattattgatttctgtttttttttttttttaccgttttactctgattggtgatggcttcgttttcataagttgtaccttgatctgaggttttattcagtcccattttgactttttttttttctggagttttgtcgtatggagtgataagtgtaaattgataaaggaaaactgcatttaggtttgatttaaaatggattagtttttttgaaccaccctaattaagatttttgacattttgttaggatcttgatatatctccacaaattttggtcatttgggtcagatttgaattgctttaattttgatcatgacacacccttgttttgtttcacacctttcactacagaggaatgatgtgaaattcatctttttattgtatttttgggtgtttggaggagagaggctgagcggtgcaacttgaacttgtttgctcagttcatgatcattactcattactcaatgagtttcactgcttgaatttttctaattttctgcagagaatctgaactctgcatcttgttgtgcaaatgaaatcaggtgtttgggtttgtgaagtatagaatagaattttgattattcaggttcttcaaaggggctgaatagaatagccagtgattgggatacccttttgatcaaatgtgtgctccttacttgagatctattttgaatggtttattcatattagttgaatttcaatatgggggtttattatgctacttgggaattgattggattatagtcaaacatgttttattgcaaatgagactcacctggctattcctgaagcattggtatttaaccatgccgaatgacgtggtgtggtccatgtagttgacctcacctagcgaaataaggctttgttgttgtttttattgaatgttggtactcacctggctaatcaaaatgcttttattgtgcttgtctttcatgtggaacttatgaattttcatgaagtgggtaaactttgacatatcaaaggatgtagtgcaccactcaagcggaaatatctgaaactaatatgatattttccttgtgccaaagacatagtaataggatttagtttgaacttttcagggttagatcatatatataaaagtaaatcctattttcttgttctagtacatatttctgtgaagttgactttatccagaacaggaaatgtttgcctgtggttgtgtgaaggtaacatatcatttactactagttcattttcatttggtttttattcaccattgtcagttcactgagttttgaatttttaactaatgtgccattaggtgtatgcaaaagcaaaggaatgctcagacatactctctgctgaggactttgctattttgcttgctaagcactttgtatcattttacaagaaggttggtgactgaaaatctaatatcaatcttgagattatttgtaattttcttctctttatttgtttttgttgttcctttatcttgcactgtgttttttctttgatcttttttaggctaagcattttgctttgaactttgttttatctgaaatatatgctacttgatggaaagaaaattcttgcttttctgtaggttactggtgctattgtgaatattgtggaaaaaccatgggagcgtgtcattgtggatggtcaacctcatgaacatggttagtcaaactataatacactgttgtaacttgcttgttttagaaggtgctcacatatatggcagtctctgtagagggtctgcttttgttagcctttgtactcaatttgtgttgcagttgaagattcttgatttaattatagttatagtttgtttcttttctgtcctcaagtccttggctttgtttgtgttaggtttcaaacttgggtctgagaagcatacaacagaggcaatagtacaaaagtctggttcacttcagttgacttctggtattgaaggattgtcagtgttgaagacaacccaggtaagcttgagataaatgctttaaaaatgtgaccatttgctcaaaaaaaattctgcacacatcatttacttatagtaaatgcattatacataaaacatgggattgtaacacaggatgactgattctgcattttatataatttattcataaatacataggaaagtaacacaaataggctgagtacttttaaaatcacaacttgtatttaaacaaactctattgaaaatatataaattgcaactatatcaattcttataaagtattgtagatttttagttaaaatcagtattacagtaccatatgtatgataatgattctaccaaaattttcacttgtgtagaagatgaggttactcaaaatgattttcagtaaaataagagagagaaaataatttctaaataacagaaagagcaaaagacaaaatcaaacaaataaaatggcaatgcacttcaacacaagagtctaattcgaaagctgctgcattacctggcatagcatcgctacacccctttttcatatttttcatgttgaaatttccttggtgctcaaagggtgaggaggatcattcttttatttgtagttctgaaattgttaaaagaagagttacatatcttcatggatgatatgaacttgtccagatggtaaacaaaattaaactgtttgggttatggaacttgtaaaatttgcatgagcatatagattcatacacagcatttattagagagctggttttctgcatacttagaaattacaagttgatgttcaagtttatttatttatttatttttgtgacatgggagcagtctggttttgtgaatttcataagagacaagtacacagcacttcctgatacccgtgaaaggattctggcaacagaagtaaccgcactgtggaggtaacttttgtccccatataatttaaaatggtcccttaatcttatggaagccagtcctgttggcataattatggtcaacttcattacaatttctaaaaaattttcttgtcatttattaattgtaaaatgaaagagttcatatagcatcacgaattcaagactgaaangttttctcattgatcattacaccggtattctttaacctggatgtggttgtttgtaggtattcgtatgaatcacagtatagcctccctcagaagccactttactttacagaaaagtatcaggaagtgaaaaaagttctggctgacactttttttggcccaccaaatgggggagtctatagcccatctgttcaaaacacactctacctgatggcaaaggccacactgaacaggtttctcactgtctaactcactgcatgtgtacaaatctatctactctctattgtctctgcatttcacagccattttagttttccccctaaataaccacaagtttaatgcatgtgtgataatcatagagggagtgactattgatttttatgcttcagatttcctgacatagcttatgtcagtctaaagatgccaaatcttcatttcttacctgtcaatatctcaaacaaggatggtcctattgtgaaggtgctgattctttttcctgaaaatcttgcagaagttaatggacccattatgaagtcttaattgatgttcattgttcaccatttgactgtccttagagcatttccaatgatgaacacaattagagattttaactcctttttaatgggtcttaccatgttacatcagttttaagtaagattatagcaactttttacgccaattatgaaattgtttaagaacttaaattaggactaataatttattccatatttttatatttctttaaaatgggttgtagaggttacctcaattattttttaatggtttacaatcggttctcatataagaatagttcttacaagtagcatccacatcatcttcttccaatgttgaacctagttaaaagcagattcttaactttaagaacccacctaagagctaccattgagatgcaattatgttgaaacttgaaagtataagttgttcaaacgattatcacatcaatcacctaatgtgttctaaattttagagtttaccttttcttcaatatcttacagctgttaatgatactgatgcttatgcagtttgaggatgatgtgtacttgccaacggatgagcctcatgggtcaattcaagctagcttgagccgcctttggtcaaagctgtagaaactgcagaagctatggtgctcatcccttctgtggtggattgccagtgcagcctaaaataccgaacctgg

SEQ ID NO: 7800 - DNA, 808 bp, Glycine max
  misc_feature (163)..(163): n is a, c, g, or t
  misc_feature (807)..(808): n is a, c, g, or t
agcacaaaatttactttttgacccatatgctaaaaataattcattttaatctccaatcaaacatttttaaattccttttggtccctaacattacacaaactttattttttcatcctatgtgtactaaattttatttaaaggattaacctctctcaacatatgntttatcatatgcttgaatcaataatcaaattatgatgatatatttaaatgataagattatctactatgaatcatatgacatcttatttggttgtttaaatattatgctcccaaaaaataggtgctaaacatatataataaatcatatattttctaatatcttattattatcttttcttaccttagaagatttaaatagtttatcacgccccaaacaataaaaataaaataaaaatcctttattatcatgcacatgcagtggccataacacttggtccgatgaattaattaaagttggcttgcgtgctcggggatttctataagagccccgacaagtttggcaaaactgggaaacaaatggagcagtgtccgatcacaattaattcaagttgaggaccatgctcgtaaatatattctcatatgttattatgttatgttatgtgtttttgttgacatgacacgagtagttttttatttttttccgttctctgctttttgttcaaactccaaagggtctttctttcatcttccttcctttctcttccatttctataaaataatttagccaacttttttttcttttcttccccctttttttcaccggttcttggttctattcttagggacaaaggggaccccaagccnn

SEQ ID NO: 7801 - DNA, 25 bp, Glycine max
cgttctcgacttcaaccatatgtga

SEQ ID NO: 7802 - DNA, 17 bp, Glycine max
ccatggtatcataggca

SEQ ID NO: 7803 - DNA, 17 bp, Glycine max
ccatggtatcgtaggca

SEQ ID NO: 7804 - DNA, 25 bp, Glycine max
gcatggaataaagcggaaaggaaag

SEQ ID NO: 7805 - DNA, 31 bp, Glycine max
tttaactcactacttgagcttgatttcatct

SEQ ID NO: 7806 - DNA, 18 bp, Glycine max
ctatgcctaagtattctt

SEQ ID NO: 7807 - DNA, 18 bp, Glycine max
ctatgcctaaatattctt

SEQ ID NO: 7808 - DNA, 32 bp, Glycine max
caacaaacttagattaacaacaccaattaggt
